United States Patent 7,892,730 (COMPOSITIONS AND METHODS FOR CANCER) - sequence listing, part 16

SEQ ID NO: 1672 - DNA, 160921 bp, Homo sapiens
caatgccactcatctgtcccttgatttccattcctggagcacccccattgactaagcacttactatgatgtctctggactttttcagtagccacctaaatgcttttccccatcaaatactaagtaatggccaggcacggtggctcacacctgtaatcctagcgctttgggaggctgaagcaggcggattgcttgagcccaggagttagaaaccagcctgggaaacatggtgaaaccccatctctactaaaaatacaaaaattagccaggcatggtggcaggcacctgtggtcccagctacttgggaggctgaggtgggaggatttctggagcctgggaagttgaggctgcagtgagccatgatcatgccactgcactccagcctgggtaacatagcgagatcctgtctcaaaaaattaaaaaaaaataattaatactaagtaacatcatcaaattagtctgtgtaaaactttaacaaggtttaccttttatttatttgtcctaaggtaatacattcacttgctacaaacatttaaaagtacaaaatgatatacagtgaaaatttattattttacctttatcctctagtcagccaaccgactccattggcaaccactgtttttagtttcttatacatccttccagagagattttatgaatttacaaattagaatttcatttttctctcttttatacataaatagcagcataggataaaaaactgttctctattttgctttttttacttagcagatctgggagatccttctctatcacttcattgtttgtttggttcttcattgtttgtttgggtgtaatgtattccagtgtatggaggtactagtgtttattcaactagtttttagattatggccatttatgttgttctcagcctttactagtacaaatggtgccccaatatgtgctgatacttctttgaacatatcactcaccttaaaaaacacgttgactgccaggtgctcacagagcagagtacttgattgtagcattcaaagccttcttcagtaaggctccaaatagctttctaatcttactttttgtatgtgtcaaaatgaactttctgctttagccaaatgactacgttcaaggggtttcccccccccccaagtacctctttaattcactcttccataggtccccaactgaactgtcttctttagctccctgtgataacgtttattgttcctcagatgggcctttgctttacctagctctccggcctggatcctcaccttcgggctttgcctttggaggtcgtgtctgtccttcacagctcagcttgagttccaccttctctgctgagcttcccaggctttctcaatcttcaggaacatctttctctgataaagcatagcccttgctgtctctgtcattctttttacttttagcaattgtgcgtatacacacatttccatccagacttacataaatattaaatgtgtacatgtcccttttctatcagcaagattgtcaggtattgaagaatatcttttagtcattttttttttgagtcaggatcttgctctgttgcccaagctggagtgcagtggcacagtcatagctgactgcagcctcgatcttcaaggctcaagtgatcctcctgccccagacttccaagtagcttggtctatagatgtgaggtgtgtgccacgacacccagctaatttttaaatgttttctagaggcagagtctcatcatgttgcctaggctggcctcaaactcctagtctcaagtgatcttccggccttagcctcccaaagcgctgagatttacaggcgtgagccacggcaccaggcatttttagtgttttgtgtacatcttcatggccctcagaactacccagtgcaattctttcctctgtcagtttttgttttctcatctgctatccttaaacattcaaaaatcttacatgctcctttgcatgaaagtcctcgttggttcttctttgccccatgtggattcagcatcctggtcctgggctgaagatgatggccactcagccgggcctcgcctggccacactcttccctcccagatctggctccttgcctcagccagatggactcgcccttgaggctccacaaatgccttactatttctgtttccatggcaacattcatgccatcctttccaatatgctgttcccttttcccttttctaaatgatgattccccaacctcagtgaagccttgatacaacaggcttttctagatcgtctctccggtgtctgtagtcatggtgaggtataggaataacaatactgatagttagcttatattgagagcttttatgtgtcaggcactgtatagctatattatttgtatgatctcactcaatcttcacaacctagaagatgggcacactgcccacactgtgtacttatcccattcttttttttttgaggagtctcactctgtcacccaggttagagtgcagtggtgcgatctcagctcgccgcagcctccgcctcttggattcaagtgattctcctgcctcagcctcctgagtagctgggattacagtcatgcagtcatgtgccaccatgcctagctaatttttgtattgttagtagagatggagtttcaccatgttggccaggctggtctcgagctcatgacctcaggtgatccacctgcctccacctcccaaagtgctgggattacaggcatgagccactgcacccggccatttatcccattatatttctcaatgaaaaacacacaaattatgactattttttgtcagatgtcttgattatctgtgtgtggatttgccggtggccaataccctttatttctagctgctcaggatgtaacacactgttttttcccctcccagagtgtgagagacattgtgcttagggaaagcaaactcgttttaacctcctcccaaggagatggtggctgatcaggtaatctgcagaaattatttttaggttattcagtttggggattttacatattagtgctggttttttgttttgctttgttttgttttttaaactgcagacaatactttcgtattctcctgtctcctccgcagattgtaaactttttaggccgggcatcgtggctcgcacctgtaatcccagcattttgggaggccagagtgggagaattgcttgaggccaggagttggagaccaacctgagcaacatagtgagatcttgtctctacaaaaacaattactaaaattagctggttgtggtggcatgtacctgtaggcctgtagtcctagctacttgggaggctgaggtgggaggatcacttgagcccaggagcttgtggctgtagtgagttatgattgtgccattgtactccagcctgggcaacagaggcaaccttttctctaaaataagtaggtagatagatagaaaacttttcagatgcaggaactgaatctacagttcctaaaatttctaattgctaatatcattgttaatacaaattttcccacatagttcaataaatgttgttgaattattcagttttgtattaacttgtggtatattttttttcttgtttttcaggaaatcatttgccagaagaatactgtgagtactttatttaaccttccagagttttaaaaatattttcttttccattaactaatctttggtatttttaaaatctccacaaattattaatttatatctctatttttcctctttagattttctgatgtatcaatataaatatggttatctaagtacttcattgtagtgaaactttatttttcataatgagagatggcactgatacctgtctttttctgcatataattatgttttggaagaaaatgtttcatagtatattcaggccaggtatgatggctcatgcctgtaatcccagcattttgggaggcagaggcaggcagatcacctgaggtcaggagttcaagaaccgcctgggcaacatggtgaaaccccatctctactaaaaatacaaaaattagccaggtgtggtagcatgctcctgtaatcccagctactcaggaggctgaggcaggagaatcgcttgaacccgggaggcggaggttgcaatgagccaagatcataccacttcattccagcctgggtgacagagtgagactacatctcaaaaaataaataaataaaaagaaaatcttttatagtgtattcaatgttgtggaattatgagtggcactaaagcagcctatatccacacacagatacacacacatatgtgtgtatgtatatgtgtctatagtatgtttccatggcagcattcatgccatcctttccaatatgctgttcccttttcccttttctaaatcgtgattccccaacctcagtgaagccttgatatgacaggcttttctagatcgtctctccagtgtctgtaatcatgataaggtataggaataacaatactgatagctagcttatattgagagctagctagctcaatatagtataattacatatacactgatatatagatatctttatctattttctacttgaagagattgatttaagttcctaagtattgtattctgcctctgagaccacactacagaattcctaccctccacacagaattaaacaaatgtgaaaacatgagaaaagtaaattttaaactttaaaaatgctgcgtgaagaagaattataatataaagtggaaacagccttgttaggccaatggttgtggccaatggttgtacatttatttcagaaagtaagccagtatttaaaaaccttaaagaatgtacctctgcaactcggagtgaagataatatacaatatattataaaagcctgcacaagatttgatttaagacgacaaaattaacaatacaattgctaatttctccttaaatcagaaattttaagcctttttttatagtagtgattatacaactctgaagtaattttgaaacttatgcttaagatttaaccagggcagaggcatatttcagcataaataatgttgccattataaactcttatccttcctatctcaacaggaaatgagcaattattgcttcatgcttcaatgcactgttttaaaatactgtttaatttgttaaaggtgtgaaactgtttaatttatctcacacgtttttttaaacaaatactgattggacatgcgctgcacgccaggctttgggcttggtacctcagggttctcacaggggaggctggaagtggaaacaagcacatgtgtaactgttgtgtagacagtctaattggtagaaaatcagcgaacaaagaagcagacaaattagaaaatgaacgtaaggtgatgtgctaaaaagagggtagccattatgtcagtgtccttcagagaaggtagcactccctgagaccggaatggcagaaagaagtccatcctgcctagcccagcttggacttgtggagaagcaggctgataaaagaaccaaatattgtacattttgaagaagttgcccgctgacttgagagagaggtgttgcgtttcaggtgctgaatgtccttataaaaagttgaatatttcgagcatctctatcaatacatttgaatgctgagagcttttccttccagaagctcatgtcattttcaacacacacttctatttacctttatgtagtttctaaaaattgaaaaccagaattggaggttttttaaaaaaaaaagaaagaaaaaacggtgaaaataattaattaggagccagggcagtggctcatgcctgtaatcccagcactttgggaggctgaggcgggaggatcatttgaggccaggagtttgagaccagtctggccaacatggtgaaaccctgtctctactaaaaatacaacaagtagccaagtgtggtggcgcatgcctgtaatcccagttacttgggaggctgaggcacgagaatcacttgcacccaggaggcagaggctgcagtgagccgagatcatgtcactgtgctccagcctaggcaacagagtaagattctgtcttaaaaacaacaacaacaacaaaatgaattagaacaagactagattttgagctgtgggattttatagcatgtgttgttatttcatgaccatgcctcagtgttttgaaatttaaggaaacaaggtctttgaagcaagtttaaatattttagaatgagtactttattaataaaaggcaattgttccacttaaggtgtctgttcttgatcacataggggttgtttttattttctttggattatcagctatttcaaactatgggtttggtggcaatctgcacacagaaaatacagaaataacatttctaagttacacgtgagccaacttgggaaataaatgttcccatgctattagttttcattattttgcaaaagtgcttttctgggcaattatatctttttgaaaaacacaacttttcctccactgcatactcactgggctgtctcttagctcaggcccagttgtatccatgtggcttctgcagcttatcaccccccttttttcctgacattggcaatgggaaattgaaaaaaaaaaagattgccttagaaacataggaaagaaactctaaagaatgcactgaagcctagaacttgggaaaacccttagcatgcttaggtattttcagcgaagactctgaagccttataccatggggtttgtttcaggaactgcttttctctgctgtttgcgtagtcattattacccctttacctctcctctgcctaacacacacccagacatctgatagtcattctctcccagaattagttttacacaggtgcagtattccccattgccccgtatttcaataataatatctgataaactaatatatgtagtatcaaggtttctgaggctacataattttatccagcagctaaaactctgataccactttctgctttattggctttttggctctttgttctcattttgtgacttggaggattcagataattttcgtttgtaattttgagttacggtgcttgtctacaatagtgtttgattctgttgttcttttagaacaattctcatagttgaagctttagatgctttggaaagcagcctctttggtatccttgcctttcttttctgcttcggcagtagcttgggtaaaaggattaaattgggtggatgtgctgtgggatcttggtaacattttagaagcaggacatgttcactttcccttttccaattattgtttcctcttctaattattgttccatggaggagaacttgagacaggaacaatttagcatacttgattttcaaatcaaatctcactctctggaggttcttcttgtgctttaactggaagtgaggtttggtttctgcttcattacctgacatatgagaagcagccttaaaggataacatagtcataaataattaagtccggtcataagggcatttggcatttcttgcctgttttctgtgaatagtcatttggctcatacagagttcccgtagaaagtgacagaaggttagagagcaggtgtgtctgctgtaaaggccactcaggagggtgcataaccccctagtgggaaggacatgccatctagagaaagagtccctgggctggagtgccaaacatgtcacagaccaactgtacgatctctctaagccttacctgtctcctcacttttaaaatgaaggccacagcagcttctttgtaggttgtgacccactgacttatgactgttcataccctggcacacacacatggtgaatacatgtttgtacttattacttaagtgctaagggtaagagaaatgctgtattattctccgtatgctcatatggctaggaatggataacctggactttttttgttccccataacggcagtagtcgggtgtcccacgtatctctttctagttctcagcctctgcctttttctatgatttttctcatagaggtctctcccacttcttttgattctaccatatccaataattctcaggtctgtattttggcttgaaactattttatgtttcaatcacatatttctagctctcttttggacattttcacattaggtgttgtgccccacctcaatcccaacctctttaaaagtgactatttcaccccatcccaccaaattcaaatctcaaccttttgaagttcttctcatattttaactagaattcagattctttgattaattacctgatatatgagtgtcttgaagaggcatgtgttcataaataacttagtctggttctgctttctgaattcttgctttctgttaatgataccactctgtataggtagtcgcccttagaagtgcagaattgcctttgatgccttaccctttctcaggttgttatcagttaccagatccagctgattccttcttcttcagtcacgcacgtgtctgtttctctatcgccacctctgccgacctggtcatgccacagcatgactcatctcctcaaacctcatatctcttccctttagtgcatcttgttacctgcccaggctgccaaaatgcacagttttgattgtgtattttgatttgtgcattttgattgtgcattgtgaaaatgcacatttcttcctccctccctccttcctcccttcttctttccttctttctctctctctttctccttctttcatttgttcattctttcgttctcctgacagagtctcgctctgtcacccaggctggagtgcagtggcgcaatctcggctcactacaagtgattctcgcacctcagcctcctgagtagctgggattaagggcgtgcaccaccccacctggataatttttgtatttttggtagagacggggtttcaccatattggccaggctgatcttgaactcctggcttcaagcaatctgcccgccttggcttcccaaagtgctgggattacaggcgtgagccatcacactcagctgattgtgttttctttcctgctgtggatccttctatgattctgcattgtccagaatgtacagtctaacatccttaactttgcatttaattcccttccctgagcttcgagctccagtcagatttgcttactcagggtatccaactcactttccactttcatccctgctctgcttttgtttgcaccagtttatcctcgcttgggcatcatccaggaaccaagagaaggtcagtgagcccaggctgtagtgggcgaggggagagtggcagggctgaggttagagaggggcaggatctgcgtagtcaggcccttgtacattgcattgcaatttcttctttctcccaagagcaagagatggggctttaagcagctgtgggaagtgatctgagggacagtgttgaaagatcactctgatggcagagtggagagtaaattagaggacaagagtggaagcagggggaccagttaaagctgatggcagtggctcaggccaggtccattggtgcatggactaaagtgttggccgagaagatggagggaaatggacaaatatgacattatattttggaggcaggacagatgggacttcgataggatgtggaaggggaagggaatggaagcatcaagggtaacttctgggcctgtagttttagtagtggggagacagagagagagcagcctcccggggggtggatttgagcgggatctacttgcggcatcaccttacatgtaggaagcccttcaaatgtgagcttgtagcattttcatatgtgtatgctgcgccctgtgactaaattataagttccctgaaagctgaaggccatgctttaaactactttttccaacagcaataacttagtgccctagccttgaaagatggtgaataaatattaaattgatggatagaaactgttccactctttttttggtatcatctgtaagtcctaattatttgaagtatgcagtgaaaggaattggggaaattttcattgtcgtaggtcataaataaataatgaggcttttctatttccctttgcatttggaattatttaaaatgagtaagacgtgggattccatctgtgccgtgtctccaggccagctccccacttgccgatgcctcctctctccgcagatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctaggtaaagtttaattaataatgccatttggtgatgacaataaagtgttattctacatctttatttgtgcatgatatcaggtgctcctgagatatcagtatacagctaagaactagggggaaaatgtttattatcctccaagtagataaaatagatgccacataatacattttattcacagaacagcaacttgaaatcagcaaaaaattaaaaagtctactaaccgctttatagtgatggtagaactaaaaatatatacaaagcaagtacagaaacaataccaggataaatgtccagggacttctagtgtaagggcaagaacaattcaactttaattaactcttaactctaattgttctttcagtgaagaacaattatttatgttaataaatgataggctgagtcaggaagttaaggttatattatgttcaaatcataggtacatcacggccagtgccgtggctcatgcctgtaatcccagcattttgggaggccgaggtgggcagatcacttgagatcaggagttcgagaccagcctggccaacatgccgaaaccctgtctctatcaaaaatacaaaaattagccaggtgtggtggtgcacacctgtaatcccagctactcacaaggctgaggcaagagaattgcttgaacccaggagatggaggttgcagtgagccaagatcatgccagtatactctagtctgggcaacagagtgagactctgtctcaaaaacaaaaacaacaaacaaacaaaaaatcataggtacatctaatttatttagaacaatttgtactggaaacagtaaaatggaaaacaaagttttggcattttaagtggttttttgcaggaaaatttattaatatggagtacctttacctttaattctttctgaaggcagagtaataaaagaaatacattggcttctaaatttcttaataatgccagatgtgtaagatatttatttaggcatctgaatgaactgaaaactacaaatgctttatagctaatgctgcaatatcattcatgtctttattaaaattattgcttttcattgaaattgtttctaatgtcaaactctttgaaatgtgtgtgtttttaccagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggtgagaagatgtttaaagtgaaatctttgttgtgtagcatgttggagggataagggagtattaacctcaaatttcagtttgctggtaagcagttcatgttactacacgtaattttttattgactctcttaagctttccatcctataattttatgatgaatgaaaaagactcatgtgagttaaccatcagtgattgtgaaagacttgtatggtaaaggcctgactttttcctccaaaagaacaaaaagaaaaatctgctggcacagcgaacctgtggacacagtctattctactgttagcctcaggcacacctgtcagtgaaagctttgttttggcaaatagcagacatttttagagctttctggacataccttttatcccttgaaattgtattgcttgaaattgatagtgctgaatctaactcgcctgaaggaaaaaatatgtaattgattacttacagaaataactttaaaaatatgtaatgtaaaacacactaacaggttatatcatttttattgacatgtcttaaaattttaaaaatagggtaagtggaataaaatcctctccaagttagggatttgctcttaggttttaatagtaaaatttaagtgacatctggtttctcctttccattcctagcctttcaggtctgtgtaaaggcttcatgtgctcaagacagactcacatccatggagggctgtggcacataggatcctgtggctagagtgcttactcatgtgacatgaaactgtgttgctacttgtaacagaagttcaacccattgcctcatgtccttgacatttttatttccctgaaattgttagaacactgcataccgggaatctggctctatggggaaataaatcacccatatttagacagtagagcactatcatgcttggtgtttttgtttcttttgcttttttagtttttgttcaacatggtaactgtgtgtttctaatgtttttatatatacgatctaaaccttttagaagaaaaacaacaaaaactgtttattctaggttcttcaaagtgttctgtggattctagtgtctttttaatgtgtttcttgaattcagatatctggttgtcaaaagacacgttattgtgagaattttctcctaatggtttaattctgtgctattctcatctaatttgaaaggactatgattctattgtgaagctggtagagactttagaaaaactgccaacctttgatttggcctcccatcaccatgtgaagtttcattatgcatttgcactgaataggtaagaagaaaaagttcccttccagaatgcgttaacatattattgtgtaacctgcaattctttacagagaatgtgttcactgcagcattgcaagaagtccctattaaaatgtaatattagcatatctgcttcagccccatgaaatataggaagcatgcattctcatttttttctgatttatttttcagtaaaaaaaaagtcgcacactgttggtatatttaaattcttacaggttttctgctctgtcaaagtttgtatttgctattcatattttttagaattgtaaaagttacatgaatatgatgttatctttaagcaaatacactcaacaccagatggtcattcacacaaaagttttcactagagtaaggatggttatgtctaggtgaacatagtgttagatagttattaccaaggataaaaaggaatttcttggacagaagatttgaagtagtaattgagaatagaaatgataccttttttataatagctttattgaaacatatttcacaggctgggcgtggtggctcactcctgcaatcctagcactttgagaggccaaggtggtcggattgcctgagctcaggagttcgagagcagcctgggcaacacggtgaaaccccgtctctactaaaatacaaaaaaattagccaggtgtggcagtgtgcacctgtagttccggctactcgggaggctgaggcaggagaatcgcttgaacctgggaggcagaagttgcagtgagccaagatcatgccactgccctccagcctgggcaacagagcaagactctgtctccaaacaaacaaactaaatatatttcatcaaaacaataaattttaaaacattttcatcactccacaaggaaaccctgtacccattagcagccccccttccatttccctcccaaatcccccaactctaggcaaccacgaatctactttcagtctttacagatttgcctattctggacatttcatataaatggaatcatacagtatgtggtcccttgtgactgacctctttcacttagcataatattttcaaggtctaaggaatgataactcttatagaatttttatctggttttgtgaactgtctacacatactattttaaagcatgctacataaagcaacttccttagataatcagttagtcacacgtagaaatcaagcagttcttgggtttgatttgatttttggtatcatctgtgaatgagtttgctaagttttggagcaaaagccattgaaacctaaggtcagggttttgtccctacttggctttatttactctaccctattcaaagacacagactacaactctaatctcgtttcaccaacttgaacctgcatataggctgcagggaaattggaaggattgtggatgagtaagtacaaatccatcaccattattaacacagaaactcaaaagaaatccttgttagacctagtagacatacaatgggataaaacaaaaaattaggcttaggacagaggtttacagaggactctcaaaatctaattgtttctgtcctggcaaatttctctaatatgaatcaacatgttaaatagggtttttaaaaaagaattgatctatattgcttctgtaatgtatattgaaacaacaatgttttctgccttaggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggtaagtaaatagtatataaatgagctacttacttagtaaatccatggcataaaaaagtatttgcaaatgagagtgttaaagtattattataatccataagattgtgtattatgaactaaaccttagattttattttattttattttatttttgagatggagtcttgttctgttgcccaggctggagtgcagtcatgtgatcttagctcactgcaacctctgcctcccaggttcaagcgattctcctgcctcagcctctccagtaactgggattacaggtgcccgccaccacgcccactaatttttacatttttaggagagacgggttttgccctgttggccaggctggtcttgaattcctgacctcaggtgatccaactgcctctgcctcctcaagtgctgggattacaggcgtgagccaccgggccaatcttagagtttataactttagtaaataatttgatgaaattcatttaacatagtatagtaaattgggataaatagatgaaaagataatttaagaaatataattttaaaaagatattttaaataagtaatataaataataaaatataattttgtagaaaaatttatataaagacagtttaaaagacctgaatgaaaggaaaaaatataccgagtttgtagatgagaaggcttgatattttaaagattttaattccccccagcaggggttttcatgtgatttgacaaaccaattccaaaatttatttgaaagaataaaggactgagaataggcaaagcaattctggaaaagcacaaggtggaaggacttgctccaccagttaacaagactcattataaagctgtaatgattaagatattgcagtatggctataggcatagacaaacaaagcactggaatacaagagacagcctggaacagactaagatatacatgagtctagatttatggcagaatcagcttcatgagctgtaaaggaaaggatggaatctgtagtaatgatactgggaaaatttctttatctgcttggaaaaataaaataaagttctatccccattttaagccatgcacaaaaaaatgaaatctaagtgagttaaataccaaaatatgaaaaaatactttagaaaaatatttttagaataaagtgtacaaattatgtatgactattggataagcaaagatttctttcttttttttttgagacaaggtcttgctccgtcactcaggctgtagtgtagtggtgcaatctcggcccactgccacctccacctcctgagctcaagtgatcttcccacctcagcctcctgagtagctgggaccacaggtgtgtgccaccacgcctggctaattgtttgtatttttggtagagagagggtttcaccatgttgccctgactggggcaaagatttcttaaacaaggcttaaaaacgccatataccataaaagataagactgggaaaatggtctacatgaaaattggcttctgctcatcaaagtagtagcttttggaaacagcagagtagattctattgtgcttatcttcctgttgataacaattataaatgttggaaaaaagttggaaagcactgaagagtgattaaaagtagctagaaactggaaaggttttcatccttggatgaagggcaccgcataggataaactccacatttaaatggcttttccctcaagacattccctggtctgcagggagcaggacagatagaactctagcaggaaatcacagtcttattggcctgagagtgagtttgaggctgccggaggacctggacattgagtgggataagcctttgtgtgaacaaggtgaaccaccaataatttatttaccttttattaaaaaactacatactcttaagaggaggagaacaaatccaaactctctacagcttatcatccaaaatgtctaatacaccataaaaattactaagcaacctgggtgtggtggcatgttcccattgttccagctactcaggaggctgaggtgcgaagatggcttgagcctaggagttcaagacctgcctggacaatataaaaataccttgtcttattaaaaaaaagaaaaaaagaaaaaaaagaaagaaaaactctcaactactaaagtggtgaagaaataggaaagtgtgattcataattaagaaaaaaattattcatagaaataaacccatagataaaacagagtttagaattaccagacaaggacataaaaataacaatgataattatatcaaagaatctacttgaaaagatgaacataatgggtgaaaatatgaggaattataggagatatttggaaactggaaataaccaaatgggagttctagaactgaaaagtacaatatctgaagttgaaatgtcatcaaatcagattaacagcagataggacacaatacgataaaagagcaataaacttcaaaacagattattagaaatcattgaaattgaagcagaggaaagaaagagatgaagtcattaataattccaatgacctgtggcatttagtggtctaaatacttttttttttttttttgagacgaatcttgctctgttgcccaggctggagttcagtggtgcaatctcacctcactgcaacctctgcctccggggttcaagcgattctcgtgcctcaacctcccaagtagctgggattacaggcatgccccaccatgcccagctactttttgtatttttagttgagtccgggtttccccatgttgtccaggctggtgtcaaactcctgacctcaagtgatccacctgcctcggcctcctgaagtgctgggattacaggtgtgagccaccgtgcccagccttgagtggtccagatacttttaattagagtcccaggagaggagagatatactgttgcagggataatagttgaagaattagtggtcaaatattatccaaatctgttcaaacaaacaaacaaataaaaaacagctcacagatctaggaagctcagcaaaacccaaggagcataaatatcaaagaaaattatctcttggcacatcatagtaaaattggtgaaaaacagaaatacaagaaaaggtcataaatgcagcctaagaaagaagatacatcaggggaaagagtgagtgctgaaggaagccaaaagataatggaataacattaaagtgctgaaagaaaaaaacccaatcaagcaagaactctatatccactgataatgtctttaaaatatgggggtgaagtaaagacaattctagatacatcaaaactgagataatttgttgccagcagaacttcactacaagaaatgttaaagtctttaggctgaagggaaataaaaccaaatggatctataggaaaaagcatatagcactggaaatgataaatatatgaataaatataaaagataccatcaacaaagaaatcacagggaacaatgcatgtaaccaatataggatatgtattcagtatatataaataactcctcaaaatatctttaagaaaaagagattaaaaaatgcataggatatgaacaggttattcacaaaaatggaatcacaaatggccaataaacatatttttgaaacttataaaaagattatttttatactactttacactattcagattaaccaaaatttataaatctgacaatatcaattgttagccaggatgttagagaaatgtgagtcctaatgcctgctggttgtgccataaatttctatacgcacttaaaagattttggcattattgaggaaagttgagaacttgcctcccctaggtccagcagatttatataccctagagtaaatcttagacatttctctacattaaagttttaacataaaaaaaaactttaaaaaagttgagcaaagtaagcaagtggcagaaggatacagagtacagtatcatttatagaatgtttaaaaacagtcatagagatttagtataagtatagatgcacggatgggcatcataaactccaaattcagtataatggttaccagtagggaggaagaagtagaaagagatcctggagtgattcacatgcaatttcaagtatattaaaaatattttatttcttaagctgagtaggaagtatatcggggtgttgcttatattattcttttgtacttagtatgatagggaatgtacctatcacattcccaaaatagtccttgattttaaaaaaaaattcaaggaggccaacttagtttaggaattcctgtatggtagctataattttttttttaagttttgaaacagaaatcttagcttttagaaatcttagatcattttcacactttagagggactgtttagttcttttatgtgctgccaaaacagaatacaagagactgggtaatttacaattaatacacatgtacttctcatagtcctggaggctgggaagtccaagatcaaggggctagcatctgtcaagggccttcttgttacatcaactcatggcagaaggggaaagagagagtgggcaaatggggctgaacatgttcttttaaaaggagcccactccctctatacagaaccgatttctgatgtaacagcattaatcctttcatggggtcagagccctcgtggcctttcacctttcattaggctccatctcctaacactattgcattggggattaagcttccaatacatgcttttggggagaaacattcaaaccatagcaagaactgaaagtagggtaatggggagaaggagaaacacttggggacagtagtttcctagatcctttagggaagctttggtctggacttctaaatttgtactatgaatttttattacactgctaagagtttcacagtttatcttaaccaaatttatttttaaaacttttattttttagaaatagtgtcttgctctgttgtctaggctggagtacagtgacacaatcataactcactgaagtctggaactcctggcctcaggcagtcctcctgcctcagtctcctgagcagatgggacaacaggtgcacgctataacacttggctaatttttgaattttttgcagagatgcggtcttgctgtgttggccaggttggtcttgaactcctggcctcaagtgatcctcctgcctcagcctcccagaatgatgggattataggcatgagccactgtacttggccttaaccaagttttttttttttctgctattacaaaagaggagtgtaattgtgcagcccttttattatcctgatgtttacactttatgaaaattcttagttgtgggagatttagaatcagatatttgagaagcattatgcccagtataaatgctttcgtatgtgacaatgaaatgcataggtaatccaaaaaggcctggttttcaaggtgaatgaattaagataaaaaacatctcctatgaagttagaatgcattgtgtacaaggataaaatagaagtgtttttccatttgaaaacaaaataatttagaagactgagagctttcaaggtcgcataaagttcagttaaggagcagagttttttctggttttgtttttgtttcaattttctgtacttacaaattctggctcttttattttaataattcccatttagcctaggaacattaactgcctctcaaaagagctttgtgttcaaggtcttcaggtcaaattgaagatgtcaggatttttgtgatttcattttaagctatcttatttattttctattaagaacagaaaatggtgttagagctcaaagatttctagattttttttttaaattatactttaagttctgggatacatgtccagaatgtgcagttttgttacataggtatatatatatgccatggtggtttgctgcacccatcaacccgtcatctacattaggtatttcttctaatgctatgcctcccctagccccctacccaccaacaggtctcagtgtgtgatgttcccctccctgtgtccatgtgttctcattgttcaacacccacttatgagtgagaacatgcggtgtttggttttctgttcctgtgttagtttgctgagaattatggtttccagcttcatccatgtacctgcaaaggacatgaactcacccttttttatggctgcatactattccatggtgtatatgtgccacattttctttatccagtctatcattgatgggcatttgggttgggtccaagtctttgctattatgaacagtgctgcaataaacatgtgtgtgcatgggtctttatagtagaatgatttataatcctttgggtatataccaataatgggattgctgggtcaaacggtatttctggttctagatccttgaggaatcgccacactgtcttccacaatggttgaactaatttacactcccactgacagtgtaaaaagttcttatttctccacaccttctccagcatctgttgtttcttgactttttaatgatcaccgttctaactggcatgagatggtatctcattttggttttgattggcgttttgtaatgaccagtgataatgagctttttgtcatatgtttgttggccgcataaatgtcttcttttgagaagtgtctgttcatatctttcacccactttttgatgggattgttttttttctggtaaatttgtttaagttccttgtagattctggatattagccctttgtcaaatggatagatagcaaaaattttctcccattctgtaggtttcctgttcattctgatggtagtttcttttgctgtgcagaagctcttttgtttaattagatcccatttgtctattttggcttttgttgccattgcttttggtgttttagtcatgaagtctttgctcatacctatgtcctgcatggtattgcctaggttttcttctagggtttttatggtgttaggtcttacatttaagtctttaatccatcttgagttaatttttgtataaggtgtaaggaaggggtccagtttcagctttctgcatatggctagccagtttacccaacaccatttattaaatagggaattctttccccgttacttgtttttgtcaggtttgtcaaagatcagatggtcggagatgtatggtggtatttctgaggcctctgttgtgttccattggtctatgtatctgttttggtatcagtaccatgatgttttggttactgtagccttgtagtatagtttgaagtcaggtagcatgatgcctccagctttgttctttttgtttaagattgtcttggctatatgggctcttttttggttccatctgaagtttaaagtagttttttctaattctgtgaagaatgtcaatggtagcttaatggggataatattgaatctataaattactttgggcagtatggccattttcatgatattgatccttcctatccatgagcatggaatgtttttccatttgtttgtgccctctcttatttccttgagcagtggtttgtagttctccttgaagaggtccttcacatcccttgtaaattgtattcctaggtattttattctctttgtggcaattgtgaatgggagttcactcatgatttggctctctgtttgtctattattggtgaataggaatgcttgtgatttttgctcattgattttgtatcctgagactttgctgaagttgcttaccagcttaaggagattttgggctgagacgatggggttttctaaatatacaatcatgtcatctgcaaacagagacaatttgacttccgctcttcctatatgaatatcctttctttctttttcttccctgattgccctggccgtaacttccaatactatgttgaataggagtggtgagagaggccgtccttgtcttctactgcttttcaaagggaatgcttccagcttttgcccattcagtatgatattgcttgtaggtttgtcataaatacctcttattattttgagatacattccatcaatacctagtttatgagctcaaagacttctaatgggacagtcttcaggagttgatcttgcacatgacacttactgatttatttagtaatgtaagaatgccacttttactgtagaggacctatccataacctgccattattgtcattatatccatttgtcctatttaacactaaaagggagcccccactccccaatcttaaaatggatgccttttcatgctcttgcttataaagctattttggtatttcttagtgttttgtccagtttccgctgtagtgcaaacatagtcttatttctgttggccttgtccccaacctccctttctgttggagctaagaaggaaacctgccctgtcaaggtgctcacagggaggagggctgctgaggttgtcaggcatctggccagatatacccaggattatgcccctcattagtcatgggtcccaaagggatgtttcaactgacccttgtttttttcttttgagtcataatcctctgggttttcatttcttaaatgctgttgctggcataaggagtgaggtgttagggcaggtagtcagtccctcaggcttctttccatggactgaatcattttctgttgacttgaataaacagtaagccactgatcatggaaagtttaaggataagagttccaactcaatggaaagagaacccaagcagttgtgattacaatggctcatcgaactctttctgcaattctcttttttaataatattaataaatgttcctgacccacagtggagggaggaagttttactctcctgggcatattatctgattcaagtactaaatggcagcgttttagtgctacagagagtctctaatgtgatctattttccgatagctttagttgtgggttcagaatgtgaaaacagaaaatagggggaaaatggtttagattattattattattattgttttagagcaggatcttgctctgtcatccaggctcaagtgcaggggtacaatcttggctcactgcagccttgaactcctgggttcaagcaatcctcctgtctcagcctgctgagtagctgggactacaggcgcgtgccaccatgcccagctactttttgtatttttttttttgcagagacaaggtttccctatgttgcccaggctgatcctgaactcctgggctccagatccacctgcctcacctcccaaagtgctgggattacaggcgtgagccaccgcgcctggctggtttagatttttctaagtgtgctgaattacagtatattgttgcaacaaactgtgattcttgactcttatgtgagacagagagtgaatggtttgaatgaatacatcctaatttaagcattaaaaacatagttctctaacatttgatgttttgcattgtcatttccttagttatttttgttcatcccagctcttgagaatggctgaaataatgcaatttgtatttaaaaggctgtggcatttttctcatagcttttcaatataaagatttaaatcagttaaaggcagcagtggtgcccgtcacatgctagttagaggacaacttgggctgcaggagaaggagcaagatgacagcagagagggtgagaagctgggaggagagccagctttcaaggggtgagaatttgtgactaaagagctgagacttacatcctaaaaaacagccatcaagtttctgaagtggcaaacttaacccctggagatgatccaaggaagtgttagggacaaatcaccatgccttagaggaccacagaagttctcattgccagattatctccacattttcttttttaagcaaatctaaaaagaaataaccatgaaatggttatgctgaattcctatgcagtatgacttatttagaaaattttgttatatgcagtatttgctcacataggtagaaatattaataataattgagcccttaacccttagagttcacacaacgtttctgtgcatgttactaatgagggaggcttacaggaaccttgtgaagtaggcaaggctgacatttttcttcctttttttttaaaaaaaaaaattgagatagggtctcattctgtcgcccagtgcagatcacagctcgctgcagccctgaactcctgggctcaagtgatcctcccacttcagcctcccaagtagctgggaccacaggtgtatgccgccatgcctggctcattttttattttttgtagagatgggatctcgctatgtggcccaggctagtctcaaatacctggagcaaagtgatactaacaccccagcttcccaaagtgctgggattacagatgggagccaccacacctggtcacttcttcccattttgcaactgatgaaattaaaaatcaaagaactccagtgaatttcgtgttgccctgtgattaataaaatttcagatcttattttttcagatccagtgttgtttttactgtatcctaggccctccttcctgaagtttccaggaatagacatttccagaaatgtctagatttcagttttgttgaagaagtatgaactaatgggagactcacaagggatcagtgtttacacaatacttggaaacagtgtgatcttgggcaaattacccttagaatattctgttttattacttaaaaaaaattaacacttgcgtagatgagttagaatgctcttggcatattgcaagtagcagaacaccttactccaatggatttaatcataagaaagtgtatctcctaaaacatgaagttcagaagtaggactggctcaagtgcaggttgaaccagcagctgaaagacatcagtcaggtcctttttcttgctatggccatgggtggctttgaccttgggctgcccctactcgggattgcaagatggctatggccattccaagaccaacccagattagctgcaccagtgtcgaggggaactgaggcaatgttttcctgtatctttctcttaggactgagaaaacatgcttgtaaaaacttactccagactttctttatgccttcatgcttctagtatttcatcagcctcaaactacacaaatcactagcaaagaggatgggattattacaaccggtttagactaacctctttgggatgagtgctttgttgtgaggattaaatgaaacaacatatgttaaagtcctgaaatttagtaagcctttagtgttatatccttggtgttaatacatctttagtgaataattttgtatttttttctgctcccccgccattttgtatgtctttacatatttgatatatttatccatgttcaaaatggacattgactatattaaatttcccttgttctaaaatatttctaaaagtctttttttttctttctggatgtagctaaacattttagctaatgagggaaaatgtatagagtctgcataatttttacacaggccctgtctgaatttcatatatcagggctattgtggcaccatgtaggataggcagtacttgcctgaaatcacatttgattttggagaaaacggtgttctcattcttaagggaagatatgaagtcattttgagaactctgaaaggaaattaggtgcttgtactgtattagcataatcatgtctttcttgttataatgccaaaaaagatccatagccaggaaattaaaagcattaagtctgtttttagcattaatatgttcatttttccatagtaacttggggaagaacagcgagcctggccttatcaactagttttcttttacgtcagtgacagtgctattcaaacagtaatgtgtgcctaataaagatttagtttttacattattaatggggttggctctactttggaagagttatataacaaactaatcaacagacaaataaagaccaatgtcaattttccatttgccagattagccttgtttcctttgtcttggcttcgagttatgtttctcagtgttctcttcatttttaccaccctccttccccctctctccccacctccagagttttatctcactgttgttgcattaacattatttttgcttagtcctttattgtgtctattatatgagtccccaaattttggatgatttttatttttagaacacaaggcctgaaaagtttttagtaactcagcatgacaccagctcattggtgaccagatagatgtacaggattcctaagggatcgctagttccaggatgacctaggaacttgggtaaaacacacagtgtgtccatagctgctttgtaaacaagtgccctggaacattggtctcatgctttgaccttgatttaataccacattcagcagatgatggattggatgaagctgtgttatggcatgaccaagttgaggtctaagaattcataattttttttttttaaaacagagtcttgctctgttgcccaggctggagtgcaatggcacgatcttggctcactgcaagctctgcctcccaggttcacgccattctcctgcctcagcctcccaagtagctgggactacaggcgcccgccaccacacccggctaatttttgtttgtatttttagtagagacggagtttcaccatgttagccaggatggcctcgatctcctgacctcgtgatctgcccaccttggcctcccaaagtgctgggattacaggcgtttcgttttgctttgttttttgagacaaggtctcgctctgtcacctaggctggagtgcaggggtgtgatcatggctcactgcagcctcaacctcctgggttcaaactgtcctcctgcctcggcctctgaagtatccatgactactgatgtgcaccaccactcagctaatttttcaaattttttctagagatggggtctcactgtgttgcccaggatgatcttgaacacttgggctcaagtgatcctccttcctcagccttccagatttctgggattacagtcgtgaaccattgcacatggccagaataagagtatttactatgtctctgtagaggtctcctaattgactaacaaagatggagcacctaaggagagaaactaaggcttgctttatgtaattcagttattagagaaatgagtgagagaactagatatttgccaggcattatactgaaaaggaaggagaatatggaagaataggagtgatttcacttagtgaaccaaagcgattgtttgcaaatctggctgagaacatcagaattgcttagggaattttttaacaatgtgaaattgtttgccctggaagattctgctttcgtggttccatctgacagcatagattaatcataataggttaatgtgactattccccttgcatgaaatatttagattttccccatatttgctgtcactcccttcctcctaaatctttactgttcttcatagcctccaagattaaatctacacccccagccccgccccttcctcccctgcagagctcttccaagggtatctcttcccatctttccagccttctcagaatatgggtttgcattgttgtttaaagaattggggcagttattgcaagagtaagtgtacatatgaaaactattcacccttaagagtaatcaaatttgagctattcttttttgttgtaatcaattggcaaagatgagaagagatgagaataatttatttttgcatgggtacactgtaaaagtcactctcctacactgctcttgagaatgtgaattggtaaagacctttctggaaagcagtttggtattgtgcatcaagagctttgaaataattcatgttctttgatccagttctgtcactgggaaactatcctaaagaaatggtagatatggaaacaaagatctgcaatggtgttcatgacactgaactttatggtaacaaaaaattggaagaaatctaaatatccaaaaatagataagttgttaagcaaaggatcacgtttccaaaggatggaatatcatttattcaaaatttggtggtaaaatatatataacataaaatttactcttttaaccattttaagtgtacagttcagtggcattaagtacattcatattgttatgcaaccatcatcaccatccatccacagaaaattttttcatcttgcatgactaaaagtctgtatctgttagacaacagttgcccattctctccttccgccggccctgggcaccaccattactttctgtctttctataaatctctctgaatttgactactctaggtacctcatgtaagtggtattatatttgctttgggttttgtgtgtgtgtgtgtgtgtgtggctagcttattttgctaagcataaggccctcaaatcttcctctgcattgtagcatatgtctgaattttcttcctttgtaaggttgaataataattgtgttgtatgtatataccacattttgtttatccattcatctcttgatggacatttaaatcgtttccaacttttttggctattgtaaatgatgctactttaaacattggtgtataaatatctctttaaggttctacttttaattattttaagtatatacccagaagaaaattgtggttttgaaaaatgtttaatagtaacatgcgtcatgatatttcatcaattaaacagcagatcataaaaatagggtgattctctttttttggaaaaaaaatatgtgcgtggtaaaaggactggaaaaacacagttagaacttggggttcttttatttttgttcctgagttttctattataacaagatatgtacacaaataagtagtctgaattggagggttatacccccaccagcagatcacagcagcagggtgattcagcattagtttcttcacatgctgtcctgctttgtttctgagttattttatgagtgttaatttcagaaatatccctagagataaaaaaaaacatgaaattctaattaaattacctttgtgtctcatagaaagaatcacaactgttatatcacaaacaaggaaaaatagcaagaacttgacttgagctcagtgtcttctttgttggaaagtacatattccagctagaaatgatcagtccaagaatatttcctttatttttgatttctgttgaatgtctcagtgcggatgcaaaaagtgaaaagtctttttttgtgaagacttcatcactctatatcaaagacttaactgcttttaagctagtttgcaatcaggtgacaaatacagtactaatcataaggcaattctggaacaaaaacctattgctttgaaagctcaaaagagaagtttacatcttttaaatgaaataatgaattaaatagtgcaaattatttgcccccttttggctgggtgcagtggctcatgcctgtaatcgcagcacttcgggaggccgaggcatgtggatcacctgaggtcaggagtttgagatcagtctggccaacatggtgaaaccccatctctactaaaaatacaaaaattacctgggtgtggtggcacatggctgtagtcccagctactcgggaggctgaggcaggagaattgcttgaacctgggaggcggtggttacagtgagccaagatagcgccattgcactctagcctggacgacagagcgagactccatctcaagaagaaaaaaaaaattatttgccccctttcaacaaatatttagtgctaaaataaaaaaaaaatcaacaggagtggaaataacttcgtatggttactcaaagatagccactaaatttctcttaatatgtaaatgtatagttctctaagatttatttccttcttaaagtcttacccaatttagcttcatcattttatttctctatctttatagatagttttgcacttttaatcattgtttagatttctttatgtatagatttacatattgttcatatttatgtatccttttgctaaactgtgacattctcagcattataaaactcgtttggtgtgtttttatgggtgcatttcagcagtactgccatgtaagtctttttgaaatattagtcttttgttttatgagagtgatcaaatatattgtgaaaaataccatttttttcttagaatatatcagcatctgtttctgttgtatatagaatacaagttttatccttaatataaaagcaatacaagctttatccttaatataaaagcaatatttatttttcctgtttaattcaactcccttttattaaaaacaaaaataaaaaaaacccagaaaataatgaaaaagaactacaaaaattgttagtacaaaccaaagggtaggcagagccatacaaagaaaagggcctaggcttatggaatccagcagaactgggtagagttcctgcttgaccacttccacactgcataacttaatattcctgtgcttcaatttccttgttggtaaggaattccccctactttaaagagttgtcagaattagaagtattatgcctgaaatgtctcattcaatgccttgtacctggtaggtgctcagtaagcagaggcaggtactatagattcttttaccatttgatgttaatcacagctttctttgatagagaccgtcatctatgctgttgtattattgttagaactacactgtcctcatttgtaggaagattaaatattcccacccttgacaccagacttggttgtgtgtcttgattgatgtgcattctaagcagaagctttgagagcaattttgtgattgtaccacatgtactttttccttggccatttccatgagaaggctgctccttcaggctggatcccagatggaagacaatgtggagcagagctgaaccatgacacagagttcatgacacagacatgtggcatgaacaggagttgcaagccactgggatttgcaagttgtttgatactgtaacactcttaccctaaaatgtctgagatagcatcttcagttaaagtggagattgccaggtacggtggcccacgcctgtaatccctgcactttgggaggccaaggcaggcagatcacgaggtcaagagatcgagaccatcctggttaacacggtgaaaccctgtctctactaaaaatgcaaaaaattagccgggcgtggtggcgggcacctgtagtcccagctacttgggaggctgaggcaggagaatggcatgaacctgggaggcagagcttgcagtgagccgagattgcgccactacactccagcctgagcaacagagcgacactctgcctcaaaaaaaaaaaaaaaaaaaaaaatggatatcatcattattttaacatctacaaaaccaacaaaatgagccgggcacagtggctcatgcctgtaatcccagcactttgggaagctgaggcaggtggatcacaaggtcaggagttcgagaccagcctgatcaacacagtgaaaccttgtctctactaaaaatacaaaaattagctgggcgtggtggcgtgcacctgtaatcccagctactcgggaggctgaggcaggagaatcacttgaacccaggaggcggaggttgcagcaagctgagatcgcaccactgaactccagcctggatgacagagtgagactctgtctcaaaaaaaaaaaaaaaagaaaagaaaagaaaaattaacaaaatgataaaatacatatgaaagttaacacaaagaaattagagaatgtaaatatggcaataataagtatcaacatgcttgctatgactaagcttcaagccaatatgctttttagtgatagaatgaaaaaaaaaatcatataccaattcttcagaggaagttaaactctccctagcagtaaattaaaggaatttctcatgacagaccctgtgtaaataaaatctacataaacaacaatcaataaaagctatataaacaacatcagtatttttattgaagtcgtgaactccaataacattaagatgtaacacagtgaataatgtaacacagtgaaagtgatatgcaattcacttgtttaaggtggtccaaggatgtagtttctagtaatatagttttatcaagatcagagtttagatcactgaaggaagttaaaagattatttgtatcttgtatgaactgacgtatttaccagttatctcagcctggttcttggtaggaagtggatgcattctttcttcatttcacaagtatttcataatcacctgcagcgtgtcaggtattctgatgattcaagtaccggagattcattggtcagcaaggctgttaaggttcctgctcttatggagcttacattctcttggagcagatagacaacaaaaagaagaatttcagattattataaattctgttaacagatatggagcaattcagagtctccattttttccttgtgtcatgcttacatgtgattttaagaaattttttcattttacccatgttgttatatttattggcataaagttgttccaaatgtcctttgcttttaatgctctatcatctgtacggatgaccgtctttttgtttatgagggcttagcgttaatttttatttctctctctttcatgagaagtctgcctaggagtttatcaactttattaatttttgtaaagaaccacattttgacactattttctttattgcatgtttgctttttatttcactgatttcagctttctttattatacccttctactttgaagatgatatgctgttcgtttactagatgaaagcttggagcattgattttcaaccttgctccttttccaatatctacatttaaaggtataatttgttctgcatcccagacattttatctattagactttcattaccttatatataacaacatatatatattgttcagtttaaataccttctaattttcagtatgatttcttctttgacctttgggttatgaactgagttgcccaatttccaaatatatctttctttattgttctgtggtttaattatattatggtgagagaacacatttttcattatttcagtcctttgaaatttgttgagaagtactttacggcccagaatatggtacacagttgttaggtgtagtgttccaggtaagtcagttagatgaacttggctaataatgttattcaaatctatatcctcactgataatttttgtctgtttgtttgatcatcactgagaaagtgttttaagatctctacctatgattgtagatttctatatctgcttttttagttctgtgcatttttttctgtatatgttttgaagccatgctattaggtacatttgggactgttatattttcctattgaatttacctctttatcattatgaaacgttccttttttctcttataataatttttatcttaaagtcaattttgtctgatattaatatataatgataacatttatttaatatttggatggtacatctttatgcatcatttcactttcaacctacctgtgtcctaatacttaagtatcttttctatataaaatgcttgggaccagaagtgttttggattttttttatatttttgaatttgggaatatttgcattataattgccagttgagcatccctaatctgaaaattggaaatcagaaatgctccaatgagcatttcctttgagcatcatgttggcactcaaaaagttttggattttggagcattttagatttcagatttttttattagggttactcaacttgtatttacagtgtgcctttttaaaatgaatatacttgcattttttgctgttattgttcagtctaatttgaaaaatctcttattaggaatgattagatcatttacatttaatgtggcaactgatagttggggctatatcaataatattgactatttgtcttatttattttttattggtcttacatgttttttgttcttttagtcctccattcttgctttatttttattaacttagtattacattttctcctacattagcactttagtaatagttttcatattattctttgagtattccctagagattacaacctgcatcctcgacttttatagtctaccttacattttgtattttactgcttcctgaacaaggaaagaaacttggagcagtttaaataatcaatagattttaaataatttttatattttagatctagtcacatatttactctttctgatgctctttctttctgaagttcagtgcttccaaatgaaatcactttcctttagtctgaagcacttttagtatttttttatagttcagatctgctggcaactagttcccagtttttgtctgaaaatatcttttttagacttttttttttcttttattactctaaagatgtcactacgttgtattctggcttccatagtttgtacggcaaagtctactgtcaattttattgctcctttgaaagtaatgtatcttttttctctggctgattttaaaagattttccactgtgttttcggattttggtaacatgttttggcatttagactataattatcttattttatcctgcttgagttttgctgagcttcttgaatctgtgggttgatgttttcatcagttttgaaatgtttttatccattatatctcacatatttcttgtgctccatattctctttcttctctttctggggctacagtaatacataggttagaccatttaactgtgtctcctctgtttcttatgctttgttgttttatgtgtgtgtgttttcttttttttttttttctatatctctgcttcagtttagataccttctattgacatgcattttagttcaccaaaactgtttttccactttgttgaattaacttgtaagcccatacattgaattattgttttcaggtattgtatgttttggtgctagattatgtgatttctttgatgctgattcttttttgaagttgtttatatcttttatccattttatctttttctctatattctttaccgtatttgtcataattatcttaaagtccttgtctataaactccagcatccgaattatctgtaggtcagcttttgtgtgtgtttgcttttgtttattggtcacaacttgctggctctttgcatgtctcgtatcccagacattttgtattaaaaaactattgagacttggagatgattttattttcactcacagagattctccttttcctctgttagccagatagggtaagaagctgattacttcaacaaatgcagttgagtcgggttgggtctgggttttcattttcattgaccttatctgtttctgttttatctctgcttcttagctgtgaccctcttgaacttttaattgataggcaggcatatttctatcttcttatcccttaaatactgtcggagatttcttatctgtccttgagagttttgtgtttagctctttattctccaaaatttggtagattgctttttttctttttctttttcttttttttttttttttgagatagagtctttctctgttgcccagggaggagggcagtggtgtgatcttggctcactgcaacctccacctccggggttcaagtgattctcctgcctcagcctcccgagtagctgggactgcgggcacacaccaccatgcctggctaatttttatatttttagtagaaataggatttcaccatgttggccaggctgatcttgaactactgacctcaagtgatccgcctaccttgtcctcccaaagggctgggagccagtgcacccagcccaaaatgtggtaaatttcttaaagggaagacttttttcctatggttgttgtagacttctttccctagtgggacttttctcctaaacactcaggagatttcactctgtcatcccagctctactccacaccctagcctcctgtacaactcagcattcaacgaatgtcctgtgaagaaaacagcaacacatttgggactccttcgggtttcattctgtcgtgccaaaccacgcaattgtcaagaaatccactagtttctctttttcttggtaaagtttaaaatagacagagtttctctgcccatgccaagcccaagcctaatctcagggtcagaatcagcaaatgccccatgaaagacaacagcaattcagctcatcttggaaggccacttccctctttggagtttatttcagtgattttttttgttgcttccatagatctccagtgtctgcaaaaatgtgtttttgatatgtattcttatttccccctaattactgaagcagaagtaatggctcccaagtagacgactacatcttacttggaaacacaagctttccccctcacatttaatatttgtccacaatacaaatggctatgtaggttcccaacatttgtataatattttattccatgttatactttatagtattattggaaatttagggtaatttttcatcttgtaacaaatgcccttgtaatgaaacttctgattacatgtttaatgttttttcttggtataaatttgtaaatgtataattgttaagagttatacatagttttaaaaaatttctatagttggccgagtgcagtggcttacacctgtaatcccagcactttgggaggccgaggtgggcggatcacctgaggtctggagttcgagaccagcctgactcacatggcaaaaccccatctctactaaaaaaaaaaaaaaatacaaaaaaattattcgggcatggtggtgcatgcctgtaatccgagctactcgggaggctgaggcaggagaatcgcttgacccctggaggcagaggttcctgtgagctgagatcgtgtcactgcgctccagcctaggcaacaagagtgaaagtccatctcaaagaaacaaacaaacaaaaattctatagttttgatattggcaaatttctgccaagaatactgtacttctttgcttttacagtatgggagaattcccacttcctgcagtggtatactaatgatatatgccaggattttatttctttcgtaatatacctacatgctcttttaatctccagaaaacattaagactttttcctcaatacagtactcaatttagtctcatggattgaggggagctcaagaaaaatgtgaattattaattttattggtgtttatcttttcatttaaaatacaaaaatatatattgtttgtggtaacagaaaaacagatataaacccaaatattcatttaggttggttttggcacataggagatattcagccaatatttattgattcatttcgatatgtcttcatttttgcatcttccttttcatatctttaagagacatttcatgttctttggtttcagggaaaatgccataatgtatttaatgaaaaatattacgtatcttgatatgaattggtagaaagggaagtgtctacttctttcttctcctaaatccttttttgttgggacattatacttgcctctgaacaaagacaaagaactttgagacttatgttagtctaagacctgtaagttgtgacttgccttgatatagtttcgaatatctgtagtctaggtgtatatacttttttcattttagaatggaaacatgtatacttctggaaacattaaaaaatgctttttaatcacctatggtgatgcagtggtaccttttttcatattccataggtacataactatcagagccaactagttaagattcatagttatttttgcttccattcagagatgcttgttctaattaaagagcaagacatttaaaaaagagacatggtcctcaatattcagaaaaatatattttttgttttcatttgatgtttaatttattttaaattatggaaaattttgagtatatataaaagccaagaatatacatttattgtgcctacaatatacactattgtgcctatcactatgtttactattcctgtcttttatttacacagttatgacttaggtgagaatgcttttatcttggaattataatgtatttcttcccacataacctttttttttggtgtcatcaaatggtcatttgttagatatttagttcttatattttcttcagcatgatttttttaaaaataaaagtttcatttttcatgcattggcctcaggcagttcctcttagtcactagggcatttattttatttttctcgttttacatatacctaagtgaaattatattgaatatcgttgcccgtttaatgatgcatgtgaggaaacccttaaaagtatcctaggaagtattaccttgaaaataaagtaaatattcaaacactgaagtccttttaaatattgaagtattttcaaaggttgatactcggttttatgcatattcagaaaagtctttttataactctctgagccaaaattagtatgtagagacatactctacatctctgcttttcttaatttcatcctataattgacagtttatttcatttttatatcattcttatggaattgatcatttcagtgtgttacctatcctcagtgctctgtatatttttaagagtttgtaaaaactactttaaaaaatatgtgcggggttctcatttttaaatgtttattgtacacacacacacacacacacacacacacacaccctgaatgatggcttccaagtagacgactacattttacttggaaacactagttttcttctgacttttaacatgcttctacaacataaatgactacatagctttctaacatttggaatatatgttattccatatcatactgtataatattattggatatttagagtaatttttcatcttgtaacaaatgcccttgtaactaaattttcacattcacatatttctggtagatggttgaagagaggattttttttaaagactagggttactaggtaggttgagggtgagctaagcgggggaaagcaacagagctgtggacaaagataagcagtttctgaagcgttaagtcctaatagcacaccagattctggggtgaaggccagtgcaatatttttacttgctcaggcattggagttatacaaacagaagctattacacacccagggtttcatgattgagaaagttaacttgtacatttgtggttttttataggttcaaaaaggcatttgaatctgagccaacactacagtcaggaattaattatgcggtcctcctcctggcagctggacaccagtttgaatcttcctttgagctccggaaagttggtaattacaacttgatattttacatggaaatcaagaaactggacccaacttggtgcaaagaaaaagaatcatgaatagataaatcttttgctttctgtcttttcatacttcccaaagagaaaaaagaaacttattatatctccttgtttggtgtttcatactgttgtacagaatcctgatattaggacataattcagtttttaatttatcttacctgtttctaaaagtccccctggttaatattccagctcaaactaatattgaggatatgggttctgcattcaacccccaactcctaaataaggttactgttttgtgagacatcaggaatatttcctattttagattgcgcttttgtggtgcttttttttcaaaaacctctgctgtttcctttatctgtttctcaagcacacctttccctatgatttcaccggtgttgggggaagagcctcccaaagccccaggagcaacaggttaagcaaatggtggtcttggtaggaagtaggctcctcagaccatctctgaatcatagccatcgacagaatgtgcttttgtcccttttatctgtagacattatctcatctgctgcctttccctgggaatttaaagaagttagggcatcttagtgaacaaatttcaagtgattttcttggttttggctttgatcacattttttaaagattctagatactggaatcctgtctatgggaatcatattttgctccgttgggtgtctaacgacctcctttcagagaatctttccaactcttttaggaattactacagacatagaaatattcagccttgtttttcatagggaaaaaataacacgttcatcttagtgaagctatgaattgtagaagaaactttttcttcaaaataaaagaaaaatttttttggaaaccaggtttcactctgtcactcaggcaagggtgcagtggtgcgatcatagctcactgcagccttgaattcttaagctcaagtgatcctcccactttggcctcctaagaagctgggactgtaggcgtgcaccaccacagctgactaattaaaaaaaattttttttataaagacgtggccacactatgttgcccaggctggtcttgaactcctggcttcaagcagttctgccacagcctcccaaagtactggtattacaggtgtgagccaccgcaccgggcccactttggcgaatttcttgttacttttcttaaagagaaatgaatcctagactttaaaaaaaagacattattttggaagagcttgtatctttatgtaatgttctggagaatctctgaagctaaataaagtcagaatatttatttgtttatttttttaaatgcccagactaaaagaatgataaagtatttattactgtgggatagcaggggtattaaaggcataaaggtctgtttgaaataattttttttttcttctgagacagggtctcactctgctgctcagggcacaatggcacaatcacagctcactgcagcctcgacccccaagacttaggtgatcctcccacctcagcctcccgggtagctgagactacaggcatataccaccacacccggataatttttttgtattttttgtaaagatgaggttttgccatgttgcccaggctggtttagattgtgctttcttagtgcttttttcaaaaacctctgctattttatttatttatttatttttaaggttggctctcactctgtcacccaagctggagtgcactggcacgatcacggctcactgcaatctcaacctcctgagctcaggagatccttccacctgggcctcccaaggtgctaggattgcaggtgtgagccaccttgcccagcctgaaataattcttttgattggttcagtgaaatcggagaaggtacattgcaatttgtgctgttcagaaattatgattataataaaattttgtgtctaagactaaattaaaaactctatactagccaaaatccctatatcagtgttctaaaaatatttttattgctcctttgttgcttttttcattgtttttattgatatgcaatagatatatatttttcagtatatatgttctattttgatacagtcatatatttattgttctgttcttaactcaaggtgaggttttgttgaagcctctaaattgttgcaggaattgacagtgatttgcatatgtaggcaaagcaatgacaatggtttgaaaatgtacttattctaaatctcattttgaaggtaaatacttattaagatggtcagaactctgaggtttgaggaaatgtgattaatatgtaaaagaaacatgttaatttttttcaggaagaactcacttgtaatacatgttaaacaaacatttgaaaacatacaaagttagtttaaaattttagaaattgcataacatatacagacttaaaatatggcttatcagtgaatttttagctatcatgagaactgttttaggcttctaaaatactgtgatatgcattctaaattgtattgtccttcaataatgaaaacatagttaaaactcactaacttagattctattcaattgtaaattatgctaatcaacatagattgatctaaagttaatttttatatggtaagaggattaaatggattttcgaggaaagacaagttggttaaataaattaatagtttaatataataatgatgttaattgatagtatataataaaaatgagacaatatacttggcatattttaaagatacacctagtttcattctttctttaaatgctccaatcagcttttccagtaatttatacctcccattcctcctgttggcctctgcaaacatacaaattattccgaattaccgagttcttataataaccagacatttacttatgaagtcccttctttaagatgctttttgaaattttgatttatttataaagggtaaacaattaagatgagcactcaatctgaagctccctaaatgtattatcttaagatctcaaatgtaagaaatgattcttaactgtcatgctgtgttgcccaaagactcttaattctagttgtgtgtttgtttgcggttatgactaattgcttcatggatctgtgttttacttttccagtttttgaagaatcactgatgcttaggctatttagagctaggatttaaaaacacagagccatatcctacatcttcttcctgttttcacctttgcaagccttaaaaataatattcaaactttagctaaataacaagatgatgcttccatcttctgtggaattttccaattgtgagacattttatgggtgagagtcagacttagaggtttgagtctccaacagtaatgatgatacagtaaaagaacactatgtttggaacttagacaaccactatttaaatatcattttcagtgagcattaaaaaatattgaatagaaaatatatattactgtacataaaaatccatgaatcaatagagataatcaaggaaaagtcatcagaacaaaatctatcaccaaccactgaaaaactcctttgtcacctatggaagtgaccaacttttccgaaaattagaagttataaggaaagaagtaagtacttttccttcctctttcagagatactgtagttcatcccgttgatgaaatatagcacttcttaggctgggcgtggtggctcaggcctgtaatcccagcactttgggaggcggaggcgggtggattacctgaggtcaggagttcaagaccagcctgatgaacatggtgaatccctgtctctactaaaattacaaaattagcccggtgtggtggcatgcttctgtaattccagctccttgggagactgaggcaaaagaatcgcttgaacccaggagacggaagttgcaatgagccaagattgtgccactgcactccagcctgggcgacaagagcgaaactccatctcaaaaaaaaaaaaaaatacagctcttcttgagctatgctacatagtaaatgtattattcttccagagaatgtattcttcaaaagtacactattatagttaataaagtaatgataaagctgataatgagagtgatgttgaaataattgattctggcaaggatcatcaatttgaactaaaagtattaaattgaaatgcttatttaaaaaaaatttacattttaccccttttacatgataccaaagctaactcatagataacttgttagtcacaaaggaacaaatgtacctgtagaatgggaagacccagctgtcagtgatccatccttgtatcactaataatagggtggcgagacatgtgcccttaggactttattatgataactgtgaagtgtacagcagctcttctttttgattttttaacttttattttttgagatagagtctcactcttgtcacccaggtctggagtgcagtggtgcgatcttggctcactgcaacctccacctcccaggttcaagcgattctcatgctgcagccttctaagtagctgggattacaggtgcgtgccaccatgcccaactaatttttgtagttttagtagagacaggattttgccatgttggccaagctggtcttgaactcctggcctcaagtgatctgcccacctggcatgagccaccacatccggccgagtgtacagcaactcttgtgaaatattgtcaccaaaaatgtttaacttgaatcttaagatctaaagttctcttaataggaatcacaagctctagagaaataagtcaaataatcccaagaagttacatcagacagatcagaaggtgagcacactagagcagcagtccccaacctttttagcaatagggactggttttgtggaagacaatttttccatggaccaggggtggggggtggttcagggatgattcaggcacattacatttattgtgcactttatttctattgcattgtaatatataatgaaataattatacaactctccataatgtagaatcagtgggagccctgagcttgtttccctgcaactagatggtcccatctggggggatgggagacagtgacagatcatcaggcattaggttctcataaggagcgcacaacctacatcccttgcacgcgcagttcacaatagtgttcacgctcctatgagaatctaatgctgttgctgatctgacaggaggcagagctcaggcagtaataagagcaatggggaatggctgtaaatacagatgaagaagctttttgctcacttgcctgctactcacctcccgtgtgtggccccattcctaacaggtcacagaccagtaactgtccatggccctgggattgaggaccctgcaccatggcactccttgtcttttcgaaaagtcagggtcataaaaaaaatgtgtagagggattgattagattaaaagagattgaggccggacatggtggctcatgcctgtaatcccagcactttgggaggccaaggtgggcctcacttgaggtcaggagttagagatcagcctgcccaacatgatgaaaccccatctctactaaaaaaaatacaaaaattagccgggcgtggtggttcacacctgtaattccagctacttgggagactgagacaggagaatcgcttgaacctgggaggtggaggttgcagtgagcagagatcatgccactgcactccagcctgggcaatagagtgagattctttctccaaaaaaaaaaaaaaaaaaaagtgagaaatttagagacataaaaactaaatgcaattaatgttccttgattggattctggtttggaaaaaaaaactataagagacatttgggagtcaatccaagaatctgaatcaggactagatgatagataatatcagtgaattgtttttgttaggtgcaataatggaatagaatatataggaagatattttaggtatatgctgtaatatttcagagcggaatgtcatgatgtctgtaatttaatttgaaatggttcagcagaaatattcagggagatgaagcaatagcaaaatgttaacgattgttgaaaatatggtcattcattgtagttttattttgatgtatgtttgagattcttcatgatggaaaattaaaaaggatctaacctccaccacttataaggtgtatggctttagacatgttgcaatacctctctgggctttatttttccttactacaaaagggagataatctctaactcatcgtggtggtgtatggattgagagagttaacattttcagtacacacagtgctaggcatctgagtattcagtaaagtctgccattttccactaaaacagccttgaacataataacagctgcaaggtgataagactatgacaaaaagtaaatgattaaaaaatcctcagtgtaagtcaaccaattttaatgacagcattgtcagcatttaaattgcataaatatgcaactgaatcaaataaatggtgaagtggttgttaacacagcaatgacatactgctcattgcttaaaaattcaaccaaaatatttttaaatagagaaaaatattgatctggaaggacttggttaaaaaggtacaactgaacatcacgaattgtgctttattaatttttctgtatggatgaagagcctaaaaatattttagtctggaaccaagtataacagtactcctgaaattctatcctatggaaaaaatcctaaatacaaaacaaatttgatgcactaagatgtttatttctatattctgtgtgggtgtgagagagaaagagagaggaagagagagagagaaaggaagagagagagggagagaaaggaagagagagagggagagagagaaaggaagagacagagagaacggacttctaaatataaaaaattagagccatgttcttaactccatacttaaaagattaatgtcttcatgtagaaacaagtttgtgcaaagagcataaatgctcattcacaaaagaaatacaaacatgaaaagagagccaatctcagcggttaaaaaagacaatgttcctttttttcctctgtcatattggtaaagatgaatgcacgtgatagtccccctcactgggaagggtgtgggtaagaccttattgtcagatgcctccagtgaaagtataaattggtacagcattttctaagggcaatttggcaaaaatgcatcaacactaaaaatgggcatgtcttctgtccctaacaaatccacgtttagaactgtattataaagaaataattgagcaaatacacaaagctgtgtgtacaagaatgtttagagtaataaaaatggccacccatctgcatttgggtaaataaattatgatacatccatatgctaaaatactaattgacatcaaaaatatacattttatccaaatgctggctgggtgtcacaatcatgtgataaatgtatggcaaggccaaaaccaaatatcaccaccacaaaatgaacttctgaggttcaagagtgcatctgaaattttattttaaaactattattgggtcaggtatggtggttcatgcctgtaatcccagaactttgggaggccaaggcgagaggactgcttgagcccaggagttcgagatgagcctggcccacagaatgagaccgtctctacaaaaaaataaaaagtagaaactacaaagaaatttaattagccagttgtggtagcatctgttatctcagctagcaggtctaaggcaggaggatcacttgagcccaggagttcggctgggcaacatggcgaaaccttgtttttccaggaaaaaaaaacaaaatttagctaggtgtggtggctcatgcctgtactcccagctacctgggaggctgaggtggaaggatcacttgagcccagaaattcaaggctgcattgagcagtgatcgtgccactgcactccagcctgggcgacagagtgagaccttgtctcaaaaacaacaacaacaaaattatatccagatagaagaccgtggatgttgtcctatgcgtgtgtaatatttttttttcatctcgtgaaacagcagtggcaaagctgttctctctttaccctcacaaaatgtgaagaattcccaaatggacattttcctgaaatacttgtggtttgagtggaattatacgataaaaagtaacatgaaaaattttaaatgttattttgtttctttcacagataattttcaaaaagctaaaatcatgactctcatcaaatataaaatggacacatataaaatcatgaccctcagcaaatataaaatagacacatagaaaatattttatttaactcaactaatatggaaactagtaagatggaatgtccagttcaaaaaacatttctattcatagacaacaaagaaatgttaagataagatatctgagtttgattaaggaaaaaaaaaaaagctgttttgtgtccacaggccataaatcttagggatttatccattccactctacagaaatttgcatctctactggacaaaaatctgcaagttaacaagtaaacttctgtaagtctgggacctttaataagtagtacataatgagatgaactagcgtcactttcctgagatagtccttgagtggccttatcttcccatatgatattgaaatgatatatcctacctttttgccttatttctaaatctcagataattttcccaacaatttaatgtgatggatgttagtggcaccaaacaatgctacaaggatatatttttttaagcaaacaaatacttataaaatgcaaaaataatacaagacatagtagaattgaaaatatataatgaaacattaagaacatagaagtgccaaaacagtgttgaaaaagaacaaagttggagtatctacattaccggatttcaggacttttaagacagtgacataacaagacagtattatctgtcagtctagttcctttttttttctgttttttcttttttttagattttaaattttttttcatgagacagaatcttgctatgttgcccaggccagtctagtacttctgagttcaagcaatcctcccacctcggccctccgaagtgctggggttacaggtgtgagccaccgtgtcaggcatatttccttatttctttaatgttttaagtgtataatttttgtgtctaaagttattatagcattttattcttgcgaaatatatatactgtatgcatttatacttcaactgatagaatttcagcgtaaaaaaggtaagattttccttttaagttatttaagaatccatgttgtaaaaagacaaagaagaaggttacataacaatgtttgtattatgaccttttaatttatgcatatactgacatatataaaaattgtagatttatgtacattaaagtgaccatagcagttatccttgggttttcaaattaaaggttaattttcactttcttctgtgtacctttctggttagtctgacttactattgtttttttaccaaagtttttattgtgataaaatgtacgtaacaaaaatttccatttgaagtgcacgcttcagtggcattaagaacattcgcactgttacgcagccaacaccactattcacctcccgaacttttttatcttccaaattaaaactctgtacacgttaaactatcagtcctcattcccttcttcccccagtccctagtaacctctattctgctttccacgtttaggaatttgactgttacaggtacctcttgtaagtggaatcactcaacctttgtctttttgggtctggcttatttaatttagcatgttttccaagttcatctatggtatgtatcagtgttccattcctttttatgacttatttttacagtgaactgaagccaccttaataatcagaaacttaacaaagctgttttaatctgaaaagaggaatgaaagcttaattttactttttagtgaaaacctggttctacctgtgtggggtgcatttgtaacattctacttcctgtttgtattctaggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtaataattagctattatatgttgatacaattaataaacagctccatattgttcccatattatatttattgaactgacaattagatgattttatttgcttataaaataaaatgcagaatatagaggaaaattgtgatattcataaaacgtgttacacatcaattctgatgactttggacataggtgatgtcagcaggttcctgacttagcctctcctgcacattgaccaacccactggcccagattggccagtgtcacccatgtgaatcatgcagaggccatgcattttgcacctgcaaatataacttatgttcggggcctgagaccacatttccattgcagctgttagacctctactccaaacatatgccctttgtttcctctgtgatctaatctcagttttggaattctcattcttgattttgttttcttcttacttaggatttgactgatgacacatttgagtgtttcttatatttgtgtgtttttctaatttgaaattgttcttggagtgcacccaaatctcatcattatttttgtggtaattggagaggtggaaacaaaattccatctgcattcaggaccatattgaaaaacagtgttggccgggcgcacggtggctcacacctgtaatcccagcacttgggaggctgaggtggacagatcacttgaggttaggagtttgagatcagcctggacaaccgggtgaaaccccatctctactaaaactacaaaaattagctgggcatgatcgcgggtgcctgtaatcccagctacttgggaggctgaggcaggagaatcacttgaacccaggaggcggaggttgcagtgagccaagattgcgccactgcatttcaacctgggtgacagggcaagactctgtctcaaaaaaaaaaaaaaaaaaagaaagaaagaaagaaagaaaagaaaaagaaaaagaatttttattagcatcacatgtagcgattaaccattagctataaagattttaaaaggctaaccatgatatagtggaagcctgtttccagagccgctcagagcccaggccaccgactcggctgttttcatcacagaaaccgtgtgaggaagagaccaccatgttaggccctcatggctgtttaaagaattttcctcatgttcaggtctcctttagccaatcctccccagggatctttctaaagatcacagtgatctttcaaaagtgcacacctgacacttctcctgcactgaaatccttaaatcaatatagtttaattgttcctcacagcctaaggaataaagtccatcattttgtcttagcaaacaagatttgcctttagccattccagcctcggctcttgtcacactcctgggtttacactgctgtctcttcataccacactgctggtttcatgcatgagtgtctgagcacgtgctgagcatgcctctcagaatgcacacattctccgaggaacactcatccatcacaccagctcacaaagccgaccttgacctagagcccttcctcacacccaagtcccttctttagtgtttctgtcattctttagttatgcttctcttgatactgagtgtatagctttttaagttgtctctctgtttagtcatatctccatggatatttattcttggtgttataataccttttgatatttatccccacagcactgtgtgcagcagtaggcattcagcaaatgatatgaaataaaggaaccaatagatgcacgcatgatattgagtcacatttgctatttctttacagtgaccattctgatggcagtattttaggcatcctggttttttaacaagaaaacaggcactattctatgcaatggtactcgcagccacaaaacagtgccttaaggttccactaacttaatttttatggaatgttaacttccatgtttatagtccataaagcgcctgcatagccattatcacctataattatcccactcctcatttttcctaactttttcttttgaggcaccatctgtcttattaggtttgagggtatttgtataatatataagctgagttgcttcagagctaaataatgatctcttatgaagtgtctatttaggaaagcttcctcaaagaagcataattaaaaacaaatgcattaaccgcttccttgaatagaatatacacattttaaagttcaagttttaactagatgtatggccctagtccaagttaccaagccctctaagcctgtttcctcctctctaaaatagggataaaataaccaacgttattgagtttttgtgagatagaaatgagataatgtgtgaaagcacggctgggcgtggtggctcacacctgcaatcccagcacgttgggaggccgaggcaggtggatcacttgaggtcaggagttcgagaccagcctggccaacatggtgaaactccatctctactaaaattgcaaaacgtagccaggcgtggtggtgcatgcctgtgatcccagctactcaggaggctgaggcagaatggcatgaacccggcaggcggagcttgcagtgagccgagattacaccactgcactccagcctgggcgacagagcgagactctgtttcaacattaaaaaaaaaaaaagtgtgaaaacacacgatatgcaacaaataacgaataacggtgaatctgaatgcataactattaatgtcatgtataaattacatttacagaattagactgggatacatgggaacaggtggttctaaatttgtctgttacatgttttatatcttttccttctcaggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtgagtactcttcctttaaatctaagtacatttctttatttaaagaacatcttgtactgtgattgtatcagtgcttgggggctgatttttggtgccttaaaactgcagtcatctggttaatatctttatttcctgcacattggtttgctttagcttacttttaaaaataacttctcaaaatcagagaaatgagatctatttttatgtttttgccatggaatttgggtggttccttttgataagtggtggagtgtacttcctaagcaatgcaaagactgtctcttggcttagcttcatgccagcccgatgtatgcttttccttaatactgcagtcacgttgacacagtcttcagtattatctcccgtattgtggtgaaaagtatcaggcttacctgcattgttatcccatccccaccacccattacccaggtgggtcagagttagatgtaatatccccaatcactatttacaatgttttagaccatgggaaatgacttgcagtttctggtctgcagctcatttttgctggtctctagtggacttcagacatatagatttaaatgtataatacacacacacacacacacacacacacacactttaaaaaaatttattgctcttctcagatggtgccatgcccctctggatggttcttaatatcgtccagcatccaattcaagaattactggcaactccctgtatgtacaaatttctttccacatcaaagtgatgccataaatctctctgagctctctaatctctatcttccatacttagaggcggtgacagttctcaattctttttgtgaaatcttgttttctagttcttgttgataggatcatctacttcacttaattaaatccattgctgacatgagcatgctttactcttgcttccagatgaagccttgagctcagcagggtccttaagcgaaagcctttctaactgaaacacttcactttattttctagcctagataatgtgtagcctaggaaaatacttaccttagaatgagctggcagcttgcctgtagctggtgctctcagtagcagtaaatgtagtgaaagaagagaacatagaattcaggtatttaattgactattgacttgattgactagaaaactggctatgaaaggaaaccattcaaattcgtcactttgagcccgtttagattagtatcatatgaatttgtctgtcatactataaatataagtgaatataaaaaatatttgacagaatttgtctgtcataaatataaataagtgaatgtaaaaaataaaccagaaaatattgagaagttaggagaatataggtataaacaccagttgagagaggcatccttaagcaagaaaaggacttataagacctaaaggaaaatattcaccaacttgatttcactaaaaaatggatatttttgtttgattaaaaaaaaacaccatgaacatgccaaataggaactgctaggcagggagaaaatgttttataaaactgtgcaaaattgtcaatttgccaaatatgcaaaaaaatcctataaagtgataagcaaaataaaataagaagaggccaggcatgaggacttatacttgtaatcccagcactttgggagaccgaggtgggcggatcacctgaggttgggagtttgagactttcctgaccaacatggagaaaccctgtctctactaaaaatacaaaattagccaggcatggtggtgcatacctgtaatcccagctatttgggaggctgagacaggagaatcgcttgaacctgggaggcagaggttgcggtgagccgataccatgccattgcagtccagcctgggcaacaagagcaaaactccatctctaaataaataaataaataaaacaaaataaaaataaaaagaagaataaaaaatttatatgaagagataattaacttctggttagtcaagaaaatgcaaattaagtgagacactatttttttgcccattggactcaaagaattaaaacattttacaacagttgacaccattgtggagacaagagcatttttagagcctgctggtgggcataggaattgctgaatattctgggattctatctgggaaggggatgataggattgtgtaagggatcctgaggacctcaactttatttgccacatttcatttctttagaaaacatttcgaagcaaatatgacagcatgttaacacttagttatctgcgagtggtaggcacataggtgttatcttgccaacatatttttggcatatttgatttttctcagcaatccatttccttcttgaaactttgtggcttatttggggtctgtctttttgtgacaagactctaaaatgcagtgttttccccctcatctctaaatactactcctacatcagaattcataactcagctactcaaaacttcttttctatagtttgttgttacacagaggacaaaattgtacaattttgtagtccttcttgagttttcctacaacgacttcatttgtgtctagaaaatgccagtctaccaagaagctccaaatttaatggaaattgctttaggattaaccgcttgattgttttcttatatttacatgtatgataaagcgttgcagaaactgtaaagatactgctttaaaaaataatgaaagccatatagatgatttttaaatctcagtatacatgatagcatagcagaaaaacaggacaaatatttgggtaataagttgtaaccacttccggaatttgccacccgtgctctccctcatagagaaaggcagccttttagtacctgtggggcgatcttggtcgctgcaccttgtcatgtccttagcatagcatcttccgtggctcacactacaaaggttgcagtaggtgttgattaggatgataacattatccttcttttgaaatgcatctaaataaaatccaggatggcctattttagaaaatatttgattgtttttatttatctcaatactgtattcattctcatttctccaagaattaactgtgactctgggcaaaagaaaattgaaagtttatttgggaaatgatttgaatggtaccatcatttatcacttcaatttattcttttttcttacctctcctcttggtatatttcctttccttcttacattgaaaagtttggagaccatcaactcattatctaacgtcgggaaagaggaaggagagacgtatggtacttcaaagaccctgtagaaacttaaacatctggttaatatctatcctttataggccttgcagtcttcctttttgattcagatacatgaaattagcagttaattataatattaacctaaaaacaaggaactaaaagcaagaatatataaactcataagtgaggtatatctacctttaagactttgtcaaattgcctccattccctggtctgtttcccagcctttctgtgacctctgtaatgtgtgctatgcatttctcacattttgtcatttcaaggatagagcaaagagctcaacaaatattagacagtgatagttacaaccttgtttttatttcctgtctcaagttagggacacatagttcagattttatctgttagaaatactgagatgacaataaagacataatttaacaagagaggagttagtgcttttcttttcttctgttgagtataatagtgtgcccacataatttgggaatggagtatattctcacttgtcaatgaagagagttggatgatgttttgggaaacccaccttttattctctattgttttgatttcatatacattgcgatactcagatatgagagcaccatttctgcaaagtttagatgggaaaatgattttcattattcatcattaccgcttatgtctctgttgattggaattaagattttgattcactgggtgagtttgttcctgagtcagaatatgttcacttatgggctctcactgtgtgtttatttgttgcatagcccatcttattttcacagctagagactgactgagaattcttggagcccttaacgtttttaatattcaaagagtaaagaaaaattgtttttttctacctccctttctctagttccctgtaccttaagtaaatgcgctgttaaggtaagttgagagtaaaacaaatatgcccagattcttgtgcctgctttctgagagtgcatttcatgttttactgtattatgaatctgtaattccttatgggtggagccttctgaaggagttttcctccacttttatttggaaaacttgcttgattcaagattagttctaaagataattttcttgagtgttaagcagtagagtagaatgattattccagttcctctaatagttaagtattgacttttctttttttaaacattcctagtgaagtctgcctaggaaatttgggccaggaagatgcctttaagcatctatacaagtagataatgaatcatagcacctttgaaatcagggcatgtgtgttattttagtattattcactccaaatgtgagatattagtaataatataatacttcatgctgtcctttgatggagattctcaactcatttatcacataccccttatagagcttcaaaataggaacaaattttatttctctttttctcttacaaggctaaatgtatcattattgaagacgccagtttcatctggaaggcagtgcaaaaacgtgtttattatttcatatagctaagtttgtttctttggtttgtatataaaactcaggaataaccaaaaccatttctaagtttatttacatgggtatgaaaaccatactactacatctgtatgataaagtgtgatagcagaaaaactaaaataaggatgtgacattctatgtatggaccttttctgtctttctttgacacatttatatttatagaaatagcttatgtagtacatgataaaatagaagattttttaaagttatcactagtagattccctgaggatagctgaacccatgtatggacttcaaaaatttatttctaaccttattagcaatacaaggtgatgcattattgaaccttatgataattgataaataatgtaaaatgcttgaaggatttataggaataacagcaatcagaagttgaaatggtttactccaggaacagattcagaagctcatgcaataatcctctacgttggtgctggggtgttatagcagctctaagtggtttcagtcttaagtcactgatattagtttctttgccgtatcttttcaaggtattaatattagaaccaaccaaaatctatcaaccttcttatttgtctatcaacaatgaagttgaggaaaagacaatctctatttggcacgtgcttcctgatgacaaggtaaattgtgcagttattaacacaagagcattagtaacaagggactttacacccttctagcatttacatactccagcaaatgtctgtgttagttaagaagaaatagctcagctgtgtgtctgtcttggcataaatgcattccgtattataaaacttgttaaatttgaattatgaatttttatcagtattaataaaatataattgaactatttggatttttattatagatggcataaccatccaaagcatactcagaattggaatatttctcttttgtaaattcatgccgtaagttatgcaccgaagaactaatacttaaaatacgtgacataaaagatgcatatgttaattttaggaagcctgtcagaatgatgccacttttaatcttacactggtaccattatagttatcattacatctagctgttttgttatctaagtagttgccaaatctcagattagccactgactcagtgtgctgtgcacaaagtgaggtgggctgtgcgaccacctattttgagaaagatcttaaaacagtctcacttccgctcatagcagtcatgtggataagcctttccacttctatattcatcagttttaatgcatgtgcaaatcatcctactattttttacaaacagacattttcaggacctggcttcagtccacaggataaaccaacagaaatgagagaagtcttgtggaaaaatagttcatttattttctttctcgtaactgtttcccagaatgcccttataattttatttaaccatcattcatcaacttactcatttaataaatgtttattgagcacttactctggatcaggcactaccagacacggtgttagaccctagggaaacagctgtgtccaaaatgagtgaagttcctgcctccatggtgcttgctttccactcagatagggcaataaagcaataaataaatgtataggtatattcaatggtgagaagggaaaaataaagcaggaagtggaagcaggaagtaaatttgggagtatgggcttgcagttttttacatgtagacttgagtcaatagacctggattcaaatcccaccactgcccttgggcaacttggcttctccaagctatggtgtcctcatctgtagaatgagataataatatccatctcaaaaggctgttgtgaaggttaaatgaaataatttggtagagtgcatttcacagagcctggcatataatagatgttcaatatatcttaactacagtaacaacaaaaacaattataaatcactgcagtgtgcatattatgtggactaaatcctaactttgaaaccccagagtttaaccctgctttgccctttaaatggcatgggagtaatcatttgggaggttgttggtgttgaactggggcacaaacctggctctgcatcagaattatctgcaataccctggatcccaggagaccgacttagttggaatcctttatacttagagtgaagcttggacacatgcatttttatgaagatttatccatgattctgatgtgcacccatggttgataacaactttaatagggatgtaaacatagtaattactcaattgtagtagctcaagaattattacatccttgactttatggctaagctggttcctggggatgctgcttttcaagatgtggttccctggaacaccagcattagagtcacccagggagctggtttaattaaatggcagattccagctgggcacagtggctcatgcctataatcccagcactttgggaggccaaggtgggtggatcacttgaggtcaggagttcgagatcagcctggccaacatggtgaaaccccatctctactaaaaatacaaaaattagccgggcgtggtggcacttgcctgtaatccccactactcaggaggctgaggcaggagaattgctggaacccgggaggcagaggttgcagtgagccaaaattgtgccactgcactccagcctgggcgacagagcaagactctatctcaaaaaataaataaaataaaataaattgcagattcctaatctgcatgtcagacctactgaggacaattctatgaggtagactttcagacctcacgtatgtgaaccaccaccttaggaagttcaacaggaaaacaacacagcatgtccataatctagcaagaagaatgtcccgtgctttgatgtgtccaaatcagctgggacagatccttcctggatgtcaatcatggccaggccctgtgacctctaccagagtggcaagaaatcaccagtcccggtgctatagtttctaggaagggcagtatcttgtgtttaaaatgaatagatactaagcagcacccagaatgcatgttatttatattttaatttgttctatgtttagataaagttggtcacgttaagtcttgtaacttagtattttagcaggcacactaaatgttggcaacatgaaattacataataagcatggagaaaaacatccattctcatgctctcaacaccaagtccatctagtagcactgagcaataccgagcagcatctttcagaactgtggtctttctccaatcccagtttgtgaaacactgtccaagctgacacttttacaagtcagtttgggactggctacatccaaaatttagagacactctaccaataggttgtggtaacttaaggatcttcacccaacaggccccagattacacatgccaatatttgccactgtgtgcagagtcagaagcttgattctttttcattattagaagtgtcaattgtatggaaaaacacttgaaaaagttacttgtgatactaatttattcataacagaaaacttccttgccaaaggactttgaagacaggctttcagctaagacatagcttcccatgagactcacttccatgagtgcagtaaatagagggaagactttgaaagaagtcattgccccagcaaccccatcagcaacatttctaacatgtcattttaattgtgttaaaatgcatcatgctacacccgaggaaagcactgttgagatgatggtagagcaaatcaatctaccagcgttcttttgagttctgtggactttgggactgtgctggttcctgaggaggacattatgggttcttggtctgtggcgttcagtgaggaggaagatcagtgaggcatggagtccttcgagaaggcttgctaaaggaggtggaacctggactttggctgtgggtagaactagaagagataaatgaacacgggaagacaaactagattagaagaataaggcagaattccaaccaaggcaccaaagtgaaagcaagcatgggacgttcaggggccggcagagtctgactcattctacaaggggaaacgtgttgagggaggtgggagatatgattggttgggcaggatgacataaaactctagagtgctatgtaagctaggaagaagaattttaaacatgtgtcggtaggaaacaggatgtcactgacgtttctgaaaatctgagagctggcaggaaggcagaacagaatgtgaattatgaacccagggtcagcatcaaagtgcataggtgtgaaggttgatgttagctcttgcatgcttcgtggcctaggcatgcgcttcaactcctcatgctttagttgccatgtatgtaaaatgagaataacagtacctcatagaattgttgtgaagattaagtgagaggatgaatggaaatcatttagcacagtgctaagtggcttggaacaagtgctccataatggttgctagtgtagctataagactgatctggtcttgacatttgatttctgaagtctgaggctctggagggtcacagagaagactgttagaggaactagctagatatgaggcaggtagagatcctagagtggaataatacaattgtgactgcaaagggacagatgatttgatttggaaagaaaagtatacaacttaatcacaaattaggaagaaggattaaaaagagggagtaagtgtaaggtgactcaagttttgattgcattgataaaggtggtaggatttttagaaggaaaacctgagttgtagaggaatcatgaggaatttcattttggacgtgtttagttgaaactaatggcaagactccaagtggaatcatccagtggcaaaattgggaataatcaatataactgtctatatacatgttagtgatattgctttaaagtgcagtgcaatatttatattgttttgcatgtatgcaagtatacacatacatgttctcacaagctgagatacactaatcatccagtggaaactacaaaaactaagaacagttaggagacatgaacattatggagacgagagcaggactggaggaggagattttcaaaggcttgattgaaaagagcaaggttatccaaggacacttggaaacagagtgaggctagaggaattagcgattagcaaggcctagagaatgagtagagagccagaagaatttggaagacagaaaaagaacagaaagtaagccagagatttttggaaaatgagtactatttccagcaatttgttattgttttctccttcctggaggttctttgctcagtaaagtgagcctcgttttcattctcttatgttttgtgacaatcatagagacaatttttatattatgctaagaaatattaggatatatattaggatataaacaagtgcattaaatagggttacaaatttaagttatgtactgtccattttccattttcaccatcttttgatcaggaggaattttatttatgttgtccttatttcctataacttttagtgctaaaaaattctccttgttcaaaaattgaagctttcttgtatcagtttccattctgaatttatgtcaatttctttgcaaaccctgattctatccatagtgtattcattatcactaccattttctcaattttttaaaataaaagtggtaaaattggaaggaggacaagcaataaaaacaaaaaaactttattattaccatgttactttaaaacaactataaataacagagaagcaaccagtttaataggtcttatgttaaactaaaaatgggttgtttttatcacagaatgtttaaaaatttttcctaaaattagaatagagaatgtagcttttcatttatcatgtttatttctttagtcactcctctcactatttttattctaacatatggaataaatagctctgtgagctagtatatactttatactgcaactttcaaaacttgaagcacattatataccaattcccaaggactcttagagagagctactctacattcaggggtaaaattaattgaaatcccgatcttttaacagttctctatttgttgaatgaatggttgctgctgaaaagtaagttagtccttgaagaaagtctgcatgtgtacaatgaaagaaaaacttaagattgaggaagagagaagttatttgcagggcgttttaaatggttatttagaatttcccccccttttgggggttgaagtttgggcacccttggcctacctcacggattatcaagcaaaggcaggggcctagtggaggactaagtgctgactctcctccctcacttcagctccagccagtggccactcacagaaggcccaggaaatttatgagggaaacatgcttacccctgattctagattaagatgatttgatgctgtcatccaccaaggatgctttctgctacaaactccctgccaaaagcagcttaaataaagaaatggtatttcatattacaagaaattacaggccgagcatggtgactcacacctgtaatcccagcaatttgggaggccagagcaggaggattgcttgaggccaggagttcaagaccagcctgagcaatgtagcaagacccccgtctctacaaaaaaatttaaaaaaattaaccaggtttggtgatatgtgcctgtagtcccagctgcttgggaggctgaggcgggaggattgcttgagcctaggagatccaggctgtagtgagctatgattaccccactacactccagcctggatggaaaaaaataaattttgaggtggggtgattctgagggtagtttcagcatcaggattctgaattctggcttctctgcgtactcttggtgttagtctcatgttcttaagtagctagctattccaagaagcacctcacacaggcggcatcccggggaggagggccaagccctctcctttataccataagttgtatcacatgaccatgcttacacccatccccagcaaggcaaatggacttaccgtggccaatttagactaatcagtttcaccattcataaacattgccacctgaacctgggcaaaatttatttttttgtcagcagaggagaaggatggaatgacagttgctgagggagctgacagtgcctactacagtataactcctgccaccttcagtcaatacagtattaacttccagctcctattctagccctaactggggcctgggatctgaggctaacccgttcctagaaaatggtgcttgtgctgattaaattaggttgagtgttggtttgaggcctgttggggctaattatagctagcgctgcgtttggccttgctgttttccctgattcccagacagatcccaggagcctttaaactacctgttggctttacagctcatcagcgcctccttgtggtgtgtcctacaggtaggtggggagggaggcctccttccaccttccatctcagggcttgggctttatttacatcactgaaatggaacgttccctggcagcactggcaacctttcaggaaccaagcattctggaaatgctcccctcctttcctacaaaaccagtccacaatttttacttagctgttcccagaaaaggactgatagaagatgggttttaccagtgctgtcttgttagtatttgccagttgctgtgttcaggggtgggtttgcatactgcctcagctctgcacttgcctcccacctcctgctcctggacatggtcttggaaagcagctcagctgcaggctctgaggataaggctgcattgtatgcaagtagtgtacaggtaacagctgcagctcctgggtcatatatatatatatatatttagaagttcacctgaggccaacaggatttagaagcaactttccaaattaccagctgaggctgcagtctgctattttaatttcactccctctgtactctggttaagacagccaccacatacctttttatggtatcttccctcctggacttcatgcaacaaaatttgctctgcgttcattcagatcacatccccatgacctgactgacatgcactgaaactagctttttagtaaattcacatctgacttgagaggatctatttttactttaagttgcatggacctagcaaagaattatgggctgtagatataaattgtcgcttttgagttgctttagccaaaaggagggttctaggccacctcagagccacaaggctttgtcacccattttattagcccaggcaagacctcagcctcctggcagtgggtgggtaagaactccttttcatggttgttttaactttacagaattgaatgtcagtgtcagtttattgccgtactgtacttgctcaacttagacacatggataaactactttgtttctgtaaaaatatttatgctattttatactgttgacatatttttaaagggattatgatccattttgttatttattttagggacatatgaatttgataataattttatcttagctttagtgataaactcaagaaataaattcccacatttttctttaccttggctctgcaaatcacccatgtttatagtatgacaatcaaatttttgatgttcatactttattagcatatggaattttgcataaattaggtagcaataccttgtagttatgatgggcactgtacacatgtgtgttcacatacattcttgttctactagtttctaaagaaatagaaccgcctatttagttggaaatcttaactaaagataattcagaaatagttatctttaaaaccttgccgagatgttattcaaattaatgtttatctttctcggaaaagaagtatttctcaactgtaataatagaattaccttgatcattgactttttttacttaaaaattaacacacaacagttattactagatatcaagttttagaatttaatgagactaattctcctaggctcttttggaagctgttttattgaagtacaggaattattaagtagagtaatcattacccttgggacttgagaatgaattgtgctttccatccagataattctttcatgaaaaatagtgtaccaggaaaaatggctgtgtatatcactttaaaaataattaaacaaaattattgttgttatgttattttccatttggatgactcagtatattttcttgttgttgttctagaaaggtatacatgagtggaattttagtgcctcttctgtcaggggagtgaggtaagtttccttggtacattttgttaacttataagacatttttctccactattcatgggctggatagaacttctaatcatgattttaaaatacaaggaatgtcaagaatcattcaattggtggaaatgcccagccttcttcagtgtcactatctcctttaggaagagatttgcaacaaaatgttcactgctggttgaactgattctgtgctcctgacctacttaaaatgtaactgtggggtcaatgtgaactatggaccagaatcaaaatgtagattacactcagccatgtggaggtcctctttagctgagctgttggtttatgtaataggatgatttctgtccttttggtatacaaggaactcagctccctttgtgtggatacaaagcacacatgccgtctactacactgtgtcctgccactaattttattttattttattttattttattttattttattttattttattttattttattttatttttattttattttatttattttattttattttattttattttgtgagacagagttttgctgttttcgcccaggctggagtgcagtggcatgatctcagttcactgcaacctccgcctcccaggtccaaaatgttctcctgcctcagcctcccaagtagctgggattacgggcgcatgtcaccatgcccagctaatttttgtaattttagtagagacagggtttcaccgtgttggccgggctggtctgaaactcctgacctcagtgatccgcccgtgtagggcttccaaaatgctgggattacaggtgtgagccactccgcccggcccctgtcactaacactaatgacttcagatgataaggagtccattaaaaaaaaaaaaaaccttctgtaaggtcactttcctgcattgatcttgagattacagtggtgaacttcagtttggttcagttctgactgctgtcacaatgccagtagcttagaaaatgccatttcttgggatttagaaataatatatatatatttttttaagaatcaagagtcagtggttaagtctttaaataattgttctattgaagctcatgctaaatcaactcttgcagatttcaaaccaaattagatgtgctaactactgtttacccccacgtcatagcaatgagagacaacagatttttgcagcctggttatgcaatatcctgttgcttttggaataataataattggttttattagagcataaattggtagagcggtctgagtcactaataattggagttctcctggtaaagctacctgttacctcatgaatgatctgaacagaaacaagcaagatgatggactgactcattatatatctttcagtcgatactttctcaaataaaactgtactcttaatatttaatttttaaagccagtcattagcaaggcactcactatttattgctgcatttttaagcaatccacttaagaaagtatggtaaatgtaaatttcactttatcatatctgttttccaatgaataaattttctttaattaggtatggtagccctatgtaacagttgttgtgatttatgacttatacataggctgctactatctatcttactattgctggcttatatgctgagaaacttgagttgtagtctgtgacttcaaagagagctcattcttcctggcctcctcctccacaaagaagagatgacaaactatggaagaaaatccaactaggtcagcagcttgccttgcgtcacctcagaacttgcacagctcgagttagtgggcattaactgagcatgagctgtgtgtcaaatgttgagtcctgttctgccaaagatacaaaaatgactaagacatcaactcctctcttgaggaattcacagcccagcagggagaggaacagacatttaacaactcatgacaatacagtgtgagaagagcaatgaaagaagtatactcagaggacacaggtgtaagaggaagtctttctgtttagggcagaagtagggcagggagagaaggtgaggtctaagctgggccttaaatcgtgaatagagtttcttttaaaagtaaaaaacgacatgcattccaaatggaaggaccagcaggcacaaaggcacaaaataaggattgacaaactgtgccccctggactacatctggtccttcacctgtcctgtaaataaagttttattggaacacagccatgttcattcatttatgcatcctcttaggcagctgtcatgcttcagcagcagaattacatagtgtggcctgaaaaacctaaagtattttactatctggcctgttacagaaaatggttgccaatccctggcataaaacagcatggcctagtgggtcaactgaaaactgtttcatattgccgtaaagtcagccactcactgagtcctaaccgagtgcacttgcacattgcttcactcctctaaaatctctataatgaatgaggtgcttttactgcctccacaaattgactgcctagctttggaaacatttcattgttctacagattgcatagcaccagaatcaccgaggttagccagccagttggtatttatgcttttcctcccagcacacagaatagtgtagtaggcaggacacctttccctgctctgttgaaaggatgtgtagtttacgtgtgcttgcaacaccctagagcagccctgctctgcagagatgaggaggaggacacctctcggaagagtaaatcattttagtagtgtggtgcaggaagtatcactttttaaagtgctatttataacttcttgttataaacaacattgatataaatgggattgaatttaaaacatttctttttcatcataggactgtagaagaattgatagttctctgaataatgcctttttgtttgttggtttcagtatttctaaatttgaagaaagatgctgctttctttatgtgcttcacaattctgatgatttccaaatctatttctgtacagaacttcattgtaaaaagtacgtattagtcattgtgtgtgaaaaagattcttcttacctgatcattattttcaagtaatgagtgaacatgtacctcctgtgaagaatgcatggctatgtggttatataaatattttatttgggctaatattttataattatatcataaatttaacagattttgggggggggttttctttaataagtcaaactttatcttagtcataacttattttcccacagataaaacattaactaagacttattggttaattgttaaatattataactcatattttaagtgctcacttactgtatatgattaccagaattttcattctcaaattcttttaaatcgtctcagtattatctacaatagtacctctttaccttggctcatattagttagatccacctggtaggctttaaaaaaacatgcatggcccccacctcagactaattatattggacgttctggtgggggtgaagcctgagttaagagccactgatctgatctataccaataaaagagatcatccaaaaatccatggactgcattgtatgtttgtgtttttctccattgtatgtttctcttgggctaataattaaattcttcttacttctttagaacactatgattgactgtgggaaactagagaagtgagtgataatttagaagccaaagtgtaggtgaaagttagtttggactcagaattttgctggggattgttcttatttaaataattactatttgaatccattataaatgactgatatgctagctacaatatacagtcgttcatttttatcttggtgtgaaaaagaaaagtgtttgttgaatccacaattcttggctcaagctttattatcataaaacatatggtgggggaaaaaaaaacacttggaaataagaaaattcctagctcttgtatggactaattctctacttacacttaaattctcaagtctgttgacctgtttctatgataattatagctaaaatttatgaagtgtgtgccccagaactaatatttgtttcagtcttcaaagaaaccctattagatgggtagtattaatatctttattgaaaagaattaaaaaagtagtcttggagagtatagcctaaaatcatgtagtcaataagcataaaaatctggggtttgaaccaggcacaggagacttcagaatggaagcttctaaaaattacgctagtgctcccatcccactgtcgagtgttatattctgcctagagatgttcatattgaaaatttttgcatgagtggctgatgcaaatccttaacccagatcttaaatcatgtctgtaacaccagatttttttttgatctttcactttattcttcctcttggttaaactagcttttctctctcattcattgtgctatttaatagcgcaaactgttattccaatcaggcttgggaattttttttcttgtcatggacctccaagaaatgtgtgtagagacaggaagagtgaggaagttgataccacatatgaactccatcaatggggtccaaattccaagatagactttgttcatcatcatgctctcaatggccagaacagttctttatcctagtagacactcagtgagtatttgttgaatgaatggatggatgggtgggtaagaaaggttctgagttgtgttaggggaacttttcttatcacaccataacctgctcttcccttaagctggcatcgcatagcatgacctgcctgtgggatcatcagcccacgttcacagtgcttcccggctttatgtctgtgaaccatcagcctcctctctgaatggcctagtcacagcgagcaggatgccaatctgtttctcactgtaatcactttgcttgtctctgaaatggtctctagaagaaaaaaaaaaaactttacaagaagagttcctgaagaaaaatgtatttgaagtgaggcattaggttagaaatttctagaaaatcctaccaacctgcattttctttttgaaaaattgtatttttcacatgatcttgatagtgtgttattgcctggttctggagactctcttagctctcagttttggttctgaagtcactttgagatgtacttgcttatatttactattgtttgtgttatgaatgctcacgtgctaacttgtattgtaggttttttgagatggtgaacaccattaccgaagagaaggggagaagcacagaggaaggagactgtgaaagtgacttgctggaggtaatgacttaggtgtccatttacatttagagctcattttaaaacaaactatttgaagccttactgaggcaggaggcagggtgtatgaggggtaggagactgtctgtaggctttcctttagtgttaaaagcaacttccagaattcctttggtaaaaaggggctaaaaagtaaacattggagaattcttattccacagcaccaagcgttagcattttacttacctgatagcgagtaactatgctttatctatgacagtgtcaatgcatgggccacggtgtccttacacattctctattctcctctgagatatgtgcaattcagacaaagaagattcactgaagattctggttgatagcacccttgtggcaggcattaatatgctacacagagaacctgaaaccatggaagattaatggaattaagagaggagggaataacaatgacttcaaatgttgttcctctcaactggaatccttttattaatgtctaatggacacagagcactatggatacctacttttatatggtttttatttttatttttatagagacttgttctcgttatgttgcccagactggtcttgaattcctgggctcaagcaatcctcccacctcggcctcccaaagcactagaattacaggcgtgagccaccgcacccgactgctggacacctacttttagtttgtgtccattttctctgccatgtctgctgtgtgaagaagagccttcctccactgcaaggaccaatgctggagtgtgtcaacaatgctgactccagcatcttcaatgtctgaagaatgacacttctccaggcttgacacatggccaccattttctccaagcccttcccagtgtttgacttgggagagaactctgaatccaagtgacttagtccattgggctgctgtaacaaaatactgtaaacaatgtggcttgtaaacagtagacatttattttcttatacttctggaggctgggaagtccaagatcagggtgctggtagattcagtgtctggtgagggcctgttcctcatagaaggtgccctgttgctgtgtccttacatggtagaagaagctggctagctctctgtggtctctcttacaaggccactaatgttaccctgctctgccttcaagacctaatcacctcccaaaggcctcacctcctaataactgcaccttggggtatgatttcaacataggaatttggggaggatacaaatattcagtccatagcaccaagccatactgaaaattatatttttaatgttaaagtgaaaatgaagaatctatagctcaccagtctaattggcatacttatttattagatcactttgataatgtcatctcataaactaaaatttttatagaaacactgaattagtaaggtaacagttgagaaaaaaatttaatataataaattgtttgttttttgagaccggctcttgctgtgttacccgggctggaggtggagtgcagtggcacaatcacagctcattgtagcctcttgacctcctgggctcaagcaatcctcccacttcagccagagcatgccaccacacctggctaacttttttttttttttttttttttttttggtggagacgggatctcactttgttgcccaggttggtcttgaactcctgggctcaagcagttctccctcttcggcctcccaaagtgctgggattatagggataagcaccatgcctggcctataatagctagttgttaactctgcccgtagttaagttctatgattatctagcaattgtatagctttgatatttgtagttaagcctaagcctctttcattaaagatgtaaaaagatgacaggcctaatttggaaaaaaagatttcctgtgcattagcttgctgtctatagaagtaatagatactacttcttatttatgtatgttttatattttacaattttttatttcttattcaagtgattgttaggaattagctttcttgactcctacttcagggctcgtttgattataccttgttatctttgtttctgtgttaaattttgcatcacttgatacatagcaacttgccaaggtaaaacttaaagaaattgaaaatgaaacaattctatcaatcatatagaattatgaaggggatgactggaaaattcatgaagtattcttcaatgttacaaatttctggctttttttttttttttttaaaccagagatagctatcctttgtttcatgccctcctttcaggaactaactgcatcttaccaaaaatatgcatagcctagccaggctgtggtggcaggtgcctatcatctcagctactcaggaggctgaggcaggagaatcacttgaactcgggaggcagaggtttcagtgagccaagattgtgccactgcactccagcctgggtgacaagagcaaaactccgtctcaaaaaaaaaaaagagaagaaaagaaattattctgaagtcaggtgtggtggctcatgcctgtaatcccagcacattgggatgctgaggtgagtggatcacttgaggccaggagttcgaaaccagcctggccaacatggtgaaaccctgtctctactttagctgagcatggtggcgtgcacctgtagtcccagctactcaggaggctgaggcaagagaattgcttgaacctgggagttggaggttgcagtgagccgagatcgcaccactgcactccagcctgagctgcagagtgagacttggtctcaaaaaaaaaagaaaagaaaaacataagaaaaacattcttacatttctatcctttgcatttcattagaataatgtaaaatttctgacagagaatggcttctacagtattcccaatggactttagagcctgtaggaagaattcaagcagaccggcttcaagagtcttggcttagtttgccattgtgccagctagtgatattgctgatgttttttgtgggtgttcttttagcaaaacgtgaatgaatgcatgtttacagggatgctctggactggaggatggtgaaatccatcgtggttgtccctctccctgaatgtccttttgtagccagggcatctttccaatatgaattattaagccttaacttacatttttgcataacttataactctccattatatatttggttacatttcttagatgttttcaacattctttattaaagttattttatcagcatcctgcatatttgattaaaatgaattctttaatttcattaccacaaattgaactcaaacttcagcccatgaataacaagctaaaaataattcctccacttcccattctttacagtggaaacaaaaagaatgactttagagatcatctgaacacagtgattaagatttgtatgcagaataattattttctgatgtttacctcaattgaaggtagaattaacattgtttcaatacatgcgtcaattattcctgaagcctttggctaccttggcccagaacaaaataaaaatgttggaaaggccaggaaatgctacttaatgtttttaacttcacttagggtgttgtcagcagtcagcaaaacagtaactattaatgtgattctataaactacaaatgtgaaactaattcctagaatttgaaagacttcttagaagcccaaggcaataactccttttctttttgattggaacaataaggtttatttgaagcagtacaactgtgggtgggatttggcttctttcaggtcaccagccccttcttccttctgattcaagctggatctactaagaactccaggctggggtcaggagccttgggccctggttctgactttgccaacagtcagtttcataaccccagacaaagttcatactcccgctgggctaagatgacttcattccttaagttagagttgaaaagaatatatatatatatatacatatatttattttattttattttttttcagacagagtcttgctctgtcacccaggctggagtgcagtggcatgatcttggcttactgcaacctccacccccgggttcaagcagtgctcccaccgcagcctcttgagtagctgggattacagacgcccaccatcatgcccagctaatttttgtattttcagtagagacagggtttcaccatgttggccaggctggtcttgaacatctgacctcaggtgatctacccacctcggcctcccaaagtgctgggattataggcgtgagccactgcgcctggccaagagcaagaggatctttaatgtcttttcctacctctaatttttaaaataatattcaagattggtataaattgtacaaggttatttcaaatataatgcaataccacttctcagagaaggattttctgtcttttaacagaaagaaaatcaatttcttttgattcaaggctatgttttttgactcaaggatgtattttgacgtggaagggtaatgaactcatatctcaagtattttaatatgttattattataatacttttatattgaaatcatcaaacaattgatcagagttaaccagccttggtctccattgttcttcttcctgccttccatgtcttcattaaaagtaaaggcatccagcaacccaagccagattcctgagaaacccctcccaaacccgtcttaatccctcatgcccgttctttcctgcagccccttcatttcatcttcttggtcactcccctgatctcaggtcttcatcctctatcatagcctaacatgtctcatgctttgtctctgttatcatcagagaaatctctcatacagatttaatcctgcgactccccagattaaaaacctttgatgctcctttttgttttttgatacagagtctcactctgtcacccaggtgggagagcagtggcgcaatctcggctcactgcaacctccgcctcctaggttcaagcaattctcctgcctcagcctcctaagtagctgggactacaggcatgcaccaccatgcccagctaatttttatatttttagtatggagtttcaccatgttggccaggctggctttgaattcctgacctcaagtgatctgcctgccttggcctcccaaaatgctgggattacggacacgagccaccatgcccagctgatgctcctttttgtagaaggaagtatttgcaccatacaacattctcaccccctctggctgtagcttcccctttcctttccactctgtggtccagcggtgccagcctcctttccactttccaggtggccatgcttctccggcctctgggcttgacatgcagacgcccaacctcacaaacttttctcctcagtcccacttagtgaccaaagccttaatttttcagatccaggtcctgtgtccttttctctttgaatcatttctcaactccccttcttgcttttctctgttctcttagcattttggcccactcctctggcctagctcttctccatgcattgtaatctggtagcctgcactggactggactgttaatgtcccatggcaggatggtggctttttgccctttttaatcacatgagctcacatggtgccaggtgtccaagtaaaagagattcaatctgaagggtttgaagctgggcagtgacaaaatcagagttgttttaatattaggttgtagcaataatggcaaaaaccacaattacttttgcaccaacctaatatctcaaactgggaggagagagatatggatgggagaaggcctccaatccatatggacctctctgcttgagcccgagaggtcaaggctgcagtgagctaggattgcgccactgcactccagccttggtgacagagccagaccctgtctaaaaaaaaaaaagaaaaaaaaaagtgacattattttcatttgactcaaatatctgcaggaagatggaagaccttactgttttcttttctgatgattggcctcatataccttagtaattatggttcagaatttattttagtcagtttggaatcatcatgtagcaaactcttttttaacatcctatttctatttttgtgcagatatgaagctgaatacccacagttacttccctgcctgagaaaatacatcacttatagtgttgtatgatatgagtatcaatttgttattcattcattcattctgttgggaacggggaaaagcctttttcttgtaccagcttatgttcaatggtcaggggcctgcaaattaactgacaaaagacaagttgacaggagagcagacaaactttattcttttgttttgttttatttttgaaacagaatctccctctgtcccccaggctggagtgcagtggtgtgatctcggctcattgcagcctctatctcttgggctcaagcgatcctcccacctcagccttctgagtagctgggactaaggtgtgcaccaccatgcctgactaatttttgtgctttttatagagacagggtttcaccatgttgcctaagctgctgccttggcctcccaaaatgcagagattacagatgtgagccaccatgcctagccaaaatttattcatgtagtcaatgctaagtcaatgaaagagacttacacaaagaattggctccctaaacagctagagttgagtgtttatatatcatcttagtaagaaagagggttaagactttaagaaagtgtatggtgggagactaatgagaaataagtgtgaggaacagaaagttttgataaggttttgtttatgcaacatctcctctaggtgcaagtggtctatctcctctttggtcattaacctcctggagaggaaataaatggcagatgtattttaggaggcattgcttatgtccgcaaaagaaatttagataaggtttttttctgctgctgctgtttttctgatgttttcagcctaaaatcatcttcatccacatcagtgggtccaaatggatctcactaatgcactcacatatttttggacagctattgaatggtaggcaccattccatgtgctggagagatggcagagaacaaaatggagagaaattcctgctatcactgagagcttacatgctctcatctaagtcttaatcgggcccaactctgcttagcttccgagatcagaagagattggacgcattcagggtggtatagctgtagactcaggttactttctaatgagagacggacaataaacacaaataagtaaaataccatctatagtatgttagatggtgatcagggttaaggagaataataaaccagggaagggtttaggaagttacagtgtagcagggacgtgcaattttagataggaaggcctgggaagctcattaagaaggtaagatttaggccgggtgtggtggctcatgcctgtaatcccagcactttgggaggcagaggagttggattgtttgaggtcaggagtttgagaccaacctggctaaaatggcgaaaccccatctctactgaaaatacaaaaattagccgggcatggtggcaagcgcctgtaatcccagctactcgggaggctaaagcaggagaatcgcttgaacctaggcactccagcctgggcgacagagtgagactctaaataaataaataaataaataaataaataaataaataaataaatgaaggtgagatatggccgggcgccatggctcacacctgtaatctcagcactttgggagaccaaggcgggtggatcatgaggtcaggagattgagaccatcctggctaacaaggtgaaagcccatctctactaaaaatacaaaaaattagctgggtgtggtggcgggcacctgtagtcccagctgctcgggaggctgaggcaggagaatggcgtgaacctgggaggcggagcttgcagcgagctgagattgtgccactgcactccagcctgggcgacagagcgtgactccttctcaaaaaaaaaggtgagatgtgagtaaagatctaagggaggagagatccatcacactagatatttgtacctgcagtgtttttggcattctattaatgttattagtagttattaatgttttggcatttacatataaagaaggccatacagactgaacattaacagagctgccatttgggtctttgaggtgattactcacctaatgtgattaagcccccgccgaaagtgcatggttttttctaaggtggttgtttccttcgagagtgcaaggactcagtgagtcaccacttcgttgtttggccttgtcaatgttgccttcctacactgattctcttcccgctaccagttttgattgttctgagcagacagcaataaagagatgattctagaaaaattctcatgattgcctcagaatgaaattcttgtttcccttagcaacaacctgatttgctaacctattaccatagaaatagaatgcaaaatatataagcaatgtaatgttaccttttattttttaaaaccctctcttctactattcctggacattacatagatgattctctgtccttctaggctgaaccagtctcttgtttcttttcagctttctttcaaaactgccatttcaatttctatctttatctcgtaagaatagaaaggggagatagaaaaacaaagcagcaattacccacagagatggttttacttaaataacactgctctttttacaattccttttcattttactatcaccattttgtttaacaggagtcagcttctatatctaatcttctatatctaatacataatcttttaaatctgtatctaatacgtaatcttttaaaaaatagtcttctgatgccttagattcctaggggaaattaaaactttagcagcctcatcaaggtttatgtattcttcactcttctatataagcatacctgttgtagagctggacctggtggtgtgcacctgagtcccagctatttgggaggatcacttgagcccaggactttgagtccagcctgggtaacatagcaggactccatctctttaaaaaaaaaaactgctgagtatgatggctcccacctgtactcccagtggttgggaggccgaggcagcaggatcagttgaggccaggagttcaaggccagcctgggcaacatagcaagaccccatctctacaaaaaatagaaaaaattagctggacatagtgctgtacacctgaagtcccagctgttgaggaggctgaagtgggaggattgcttgaacctaggagttcaaggctgcaatgagctatgatggcaccactgcactccggcctaggcgacagagcaaaacactctttaaaaaaaaaaaaagatttaaatatatctattggaaaaatgctttcacccaagaataaaccaataatgactctaaatgttttgttttgggatctagttcttttctaaaaaagttctcatcacatttttctataacttgattaattagttaagcaaataattactgagcatctactacaagctacatgctaaaactggggatagagtaattaaggatgaagtcccaagtctcgaagagctcaagtgtccagacgaggatgacagaggtagccgtaagatcttgaagggcattgtcttggtccatccaggccgctataacaaaatgccttaggctgggtaatttatacccaatagaaatgctttgctcacagttccagaggctgagaaatccaagatcaaggcaccagcagattcagtgtctggtgagggcctacttcctctagatggtaccttctgtgggtgctcacatggctgaaggctcaaccaggctccttcaagcctctttcataaggggactaatcccattcatgagagctctagcctcatgacctaatcaccttctaaagggcctaactcttaatacattgtgattcggtttcaacatacagattttgagggcgctgaagaggggggtacgcaaacattcagaccatagcaggcatttatgctgtgctaaggagtttggatttcatccggaaagtaacaagctgccaataaaatagatgcagtggcactgacatggaaagttcatgtggaactttggactttggaaagttcactgtcaatttagtggagaataaattggggaatggagcaacaagagaggagaaaagcctctgaactttttttttgcagagaagtgcttttcttctgtgctacttctacagagattctgaggcaactccggtgagaataaggaggtaaaatggatttgtgagattttaagaagaaaaatctgagaacagttggcaataaatttgaaatacatagtaaaagaaggaaaaaaacaaaattctaagaggacagtggctaccagatgtctgctaaaaaaaagcaaatggatgttccatggatattaacaatatactgtaatatctttataacactggtatttggaaacaactaataatcaccctgtaagctcttattctatgatagggtttccctaatgcataggtagtggaaaggatacaaaatctggaatctcacaagctggtttcaaaccacaactctgatatattttcactggaaaaaaaaatttctgatcatttgtaaattgaaagtaatcagaaacctattacacatgcttatgatgataagtgaggtgggttattgaaagttggttttttttttcctttaagattataaagcattgtagtgtaaaatggtggtggtactagatggagtgtataggtttctaatcctttgagagggcacatcggcaaagttgagcttctttacctgctgctggctgggtcccactggtggaattccagcgtggcaggcacagcattgcagaagtctagactacaggaattgggtgtggagacttgggctccttcaggtggcgttgtttggattatgcttcctgtctcctcgcaggagcccagttttaactctgagttagagcatgttgctaaatgatccctgctgcctgttccttccctctgatcacctatcacctggtcactctgatcatctaccctggaccaagacagtcttcagctttatgttaggcagccagaacagggctattctctaatgtgccactggatacttggcaatgggtaagtagtcatctcccttccagagcttggcctctgtcctgagccagagaagaattcatgctaaggaggccagtgctcactccagccctagcattgtattaggcataattttccccagaagacaccacccgactgccttctataagggcctgaaaacctgttggaaacaaataacctggagctggtagggacatgctccaccccagccccatcctctcgagtcatgcgtgtgtacccaagagtttgcagagcgatctgatgagctacctttgtaggtaatttgcccttttatgatctttttgtctttcgtattttgtagtttccctatgtcatatctcagtgagtttgtttttatttttcctatttagggctgaatttctggaagttgtattcaattctctttcaagtctggccttttttagaatatcttatcttctcatttttaaatattttatatctttatgttaaatgtacatattttataactatattctatcatttctgacttaatgaagtcttgaggattgagatttgtcatatatgttttcactgatgttgaattgtttccttacatagtttatattttttggattgtgagttcaactttagtggtgcattatcagtaagaattctgcatagcaaacttcaaggggtctgccatgaaaatgtttttgctttgtttctgccaggcactccagggatatcccaggctcaagagcaattatgagtattataataagtgttaatttgaagttcaaacagcaccaggatcagctgtggttgaaagtgtttagagaagacctatttttgctcctccagagctcagtcttgagacaaaccagctttctttttgtttcacagtgtagtgggctgacttttctgatctaccctttcaccaagggcctggttttgtgtgtttctgctctttgcctggcgtaggcactaggccatacttcctatcccctcctgggcattaagacccaagccccacatgagaggtcagcaaactatagccccaggatcaaatccagctcactcttaatcttggtaaataaagccttattggaacataagcatgcccatttgtttatatatcagctgggctgctttcacatcacaatggcagaattgagtagttgctacaaagactagatggccctcaaagctaaaacattcactatctgaccttttaccaaaaaaaaagcagacaaattcccgccctagattaatgaaactgaaaatcttgccttcatccccaccctttgggctgcaggagttcttgtgattacctgctagtattcctttcctcttcatttctagcttctgcagtcacctttactctttagtaagcccagctagacatttaaaagtatgtctgttttattttacctatgtgtttttagcaggaaggttctcaggtatctggtctaccatcttgccaaatccagagcctctcttctactgtcttggtagcaatatgttattctttttctgtttccttgacttgaccattaaacttattcatgttaaatttttattttctaatggatttttttaagatcatgaaatttttcatctacctaactccatatctatggaatttgataaataatgtttttcttctcatttaaaaaattactgtgtaattcccatggtcatttcctttttaacccattggttattttaaaggaaagtaaaatatacttttggctgtcttatttttagtattctgtgctcagagatcatggtctttatgatatcagttctttggaatttgttgaaatttttctttgttgtctaatatgtaatcagttataatatatttttcatgtatgcatgaaaggaatctgtatctggatacagagctctctctgtagatgttatatcaaacttgttcattgtgccattagattctctattttaaaatctgtgtgccagatatattcctttctaaaagagttctgttaaaatctattgtggttgatatttgtgtatttttctttgaaattttatcaactctgcttttatatttcaaggctatgttgttaaagagcataaaaactcatgatcattgccctcttcatagattactcatcagtattaacgttaagtttgttgacttatacatgttataaatcatttttttttctttgagatggagtcttgctctgttgcccaggctggagtgcagtgtcgccatctcagctcactgcaacctccgtctcccaggttcaaccaattctcctgcctcagcctcttgagtaattgggattacaggcgtgcaccaccatacccagctaatttttgtattttcagtagagacagggttttgccatgttggctaggctggtctcaaactcctgacctcaggtgatgcacctgcctcagccttccaaagtgctagaattaacaggcatgagccaccacacctggccagaaataattttttttaatggccaactcagaccctgctgtgaggtgaatctaactatggactgccagttttaaactccagcaaaatgtagactatatgaaaagcttgttctaatgttctctcccaggggtctgtagttttatgctgggtttctacagggacatgccttgatcatgtgatggccctaaatcatttagttccagtccagcacaaaggatgtggctttggggtgatgcctccagatctgaggaggtctctactgaatcctttctgtagatccggttttccatatttggctgacatacttgacagtttggagtttagaactatagatatttcctttctacatcagagatcaaaattttcctctatttttcacttaaaaaaatgtttttgggtcttggggaaacggtggggagtggtgaagtaaaataatcctgactttatcattggcacctggtaagatgtcaacattttcttcttacccaaagcctttcggtggttttattctcctggcagtgtgaaatgctttaacagcatcaaaagctgaataacaaaaggaagatttattagatgtgatagacattgatagatgttgatgctagttatacactgtttcactgatctccagaatcaatgaaaaacaggactgagtgggtaaaagaatccacatggcttttggagaagcaattctatgaagttaactatgtaatccccactgtatttgtaacagtttgtgaaaacataaacacagtatctgctttatgttgggagcatttatttgttcatccttgaagctgcttcttagaacttcagcctgttaatgccatctgataagataaggaataatgctcttggaaaaaaatttgatgtttgaaatgtagaatgaactaatgttttgatcttttctccccgtttttccttttgtagtatgactatgaatatgatgaaaatggtgacagagtcgttttaggaaaaggcacttatgggatagtctacgcaggtcgggacttgagcaaccaagtcagaattgctattaaggaaatcccagagagagacagcaggtacagtaattgtagctactaaaagctgttctgtagtactttgggttgttgacagtattttagaaaatacttgatgatattctaatgaatgaaactgtgaaaacttcactctgtgaattagctccttctgaggtttcgctgctgcatcattcagtgtttgaagtgccagactggtggggaagaacggggctttcaaagactagaaaagagaatggccctgtgtgtgttaggctcaggttgtcttggataaaggtggatgtattatgtgaatagatgaggaataagcactatcagaaatcgtttaggttggaaccagttctaggttccagtcgggcatgtgaggagcttggaagttgtcattccatcttaacaagtagaaagctgaagagactgaaatcagtggctcttcttggattcgtccgtgaagttgcaagggaggcagctgcccctgaaattggagagactggaaaactgagagactcataacttactgagcagaaatccatgatctgctcacctctgtgggaaccagtgctggggtaggaaaactgaactgtaactgacaaatctctagaggcccactgtgaagtctgagttaaaaactccagtgggacccagtcactgagggctggggatgagggtcacactttcatgagttttggagctttaccaggtcctcagagagacttgaaataagagaaatcccattgtgcttctggcagcaagaaaggaaaagtcactatttcttttttttttttttttgagacggagtcttgctctgtcacccaggctggagttcagtggcacgatctcggctcactgcaagctccacctcctgggtccatgccagtctcctgcctcggcctcctgagtagctgggactacaggtgcctgccaccacgcctggctaattttttgtatttttaatagagacgcggtttcaccgtgttaaccaggacggtcttgatctcctgacctcgtgatccgcccgcctcggcctcccaaagtgctgggattacaggcgtgagccaccatgcccggcaaagtcaccatttttaaatacgctgaagcattctgttcttaacaaggtctgtccacaagagactctattttaccggagcctaaccaaactaggggaagtggagtaccaaatttagcccaactctagctgtcctgtctcacctaagggggctaaagctaaggagcacttgtaaaattcacagcccaggggcactggctcactaaaagactgagacctaatcacagacctgtcgaactcttcccctccctgactgcttcccaccacatcactaaaggcctatttactgcagcactttcacctaggatatcatgtccacctttctatagaaaactataaggcatactgaaagacaaaaaacacagtttaagcaacatagcaagtgtcagaacctgaaccagatatggcggggatattagagttatcagattgtgaatcgtattcacatgcttagggctctcatggaaaggtagagattgtgcaggagcagatggtaatgtaagctcagagatggaaatcctaggaataatttttaaaaatgctggagatcaaaaacagtaatagaagtgaagaatggctttgatggcttattagtagactgggcacagttaaagaatctctgagtttcggaatatatcagtagaaactttcaaaattaaaaaagcaaagagaaaaaagactgaaaaaaaaaactgggacaatatccaagaactgtgtgacaactacaaaatgtataatatatacatttttgccatcaaaagtaattaatggcaaaaaccgcaattacttttgcaccaacctatgcttgaagaaatgagttgaatctcacatagtgaggccttgtgaaaggtggaatcttttttaggaacaaaaatgttcaggaaactgaagcgctctggtgataggattatctgttgctcactgctcttgtgctctgccttatggtttatttctccaactaataattctgtcttctctcaacctcatgatttctgctgccttagggcttcccttacatctctctgtaaggcagtgctcctgtaattagtgcaacgcagttgtagtgtatgatacacagttgtgtgtgttgtgtattcaaagtctgaaagagagaagattggattatttaatagatggttattattatccatatttggccaggctttaatgctgggctacatcatgggctgactctggctgcccttgactccacgttctgtggccgtggtcataggccacatgaccagccttccttaggaaggacccacccctgagctccccaggttacctgtctaccccacatctccagttatagatctcaaaggcatctcaaggttaacaggaccaaaactgaacctggatttttttccttttttaacttttattttagaaccagggggtacatgcgcaggtttgttacaaaagaatattgtgtgttgcttaggtttggagtacaaaggaatccatcaaatatacctaggtagtgagtatgtaacccaatagcaaacccagattttatttttatttccttatttctttaagtcagagactcactctgtcattcaggctagagtgcagtggccccatctcagctcattgcaacctccacctcccgagttcaagcaatgctcatgcttcagcctcctgagtagctgggattacaggcctgcatcatcatgcctgcctaatttttgtgtttttaatagagacagagtttcaccatgttggccaggctggtctcgaactcctgccctcaagtgatctgcccacctcagcctcccaaagtgctgggattataggcgtgagccaccacgccaggccgtgaacccaatttttattcccaaatgtactctccctaaagtactccttgtgttatcagttactgtctccccatgtatccagctgctcaggctaacctccaggattcatttgattcctctctttctcttgcactccacatctactccatcagtaagtcgtactgtttgttgtatcagcctctgcaagatattctgaatctctctactctttctgatcaccacagctgcacctctaatctaagccttcaggcctgtcgctgggactcccttctagtctctgcaatcacctcctaactggtctctgctttcgctctttcctccactcctagtccatccttctttgaggagtcacagaggtctttctgaagttaaaatcaaatcatgtagtgataatgatgtgtcagtgaaggtccatcagttgtaacaaatggactactctggtggggaatgttgataaggggggaggttgtgcatgtgtgggaaccaggagtgtgtgggaaatctctgtacctccctctcaatttttctgtgaacttacgaactgctctaagaaataacatctatttttaaaaatcacatcacgtcactactgcctaaaacccttcagtggattcttattgcaaccagcatgaaacccagaacccttactttgaatcacaaggccataggtgatctgcttcctctgtggcctcacttccactccagccacactggtgtctctctatcgggcataccaagatcaacccagaccttggcaggattgcctcattttcatcacttaagctttaattcaaatgtcaagccctcagagaggtcttctctgactgtcccaaactgaaaaagacaccccctcccatgcaagcactgtgtccggtcccagctctttatccttagtgcgtgactttcaccctgcctccaggctccatatgtcagtccagaaggaaaaggaaaacagagcttcccagaactgcccagtatactttctcctctgttgcactcgcccaaaatgcctacccctacctacaaggaactaggaactccggctttttagccagccatttgtttctccaaacaaaatcatagaaagagggaagaatagatactaggtaagcaaacagctgttgctgcctgccgcatgtgtagtttcattcaatttcatatttgtttggtgtcgttccagagtttcctcttagttaattcatgagacatgattatggattcttatgaaacagtaatagaaattactcattaaatacctaggtaatatatataaagttgtcatcttaaaatttttcttttagtcctatgtgttcttaaggagcatatgtatagatagtgtagactttgaaacaatatgaaatttaacgaggtcatcactatcaaattgctgcagccaaattcactaacctttagccacagctcctctcttctctactcctgatggatttaggtgaacacttggaagaaactcacttttaaaatcaccctgtagtttaagtttattcaaatgctactatacacacacaaagcacaccaacaccaacaagatgtttcagctcctgttctgtaacaatgcagttggtatatgtgatttgcacatgacaagcccttagcttgaacagctggtgcagggcatcttcttattgacaatgtaaagagatcgcagacaactctattattgtgaagatacagcaaacaaagttgtttctatccatgtaacctggaggggtgtggacgttctgttgaaaaagatagcagttacagttacaaagcataattacaaaagtagtgtgatgtgaataatgcatgatacaacctgagtgtacactaaactaccatctgtaaagaaggatcagagcaatggaaacaatttctcctctgtttccttcatgttctaaaaccactttgttagagaatcaaagtggttgtaagagggaagaggtagatttagtatgctctcatcatccacccccaactagttgttaatctcaggttggctttctcttctgatattctacatatcctgaactggttatttttattttattttatttttgagatggagtttcattctgtcgcccaggctggagtgcagtggcgcgatctcggctcactgcaacctccgcctcctgggttcaagtgattctcctgcctcagcctcccaagtagctgggattacaggcacctgccactacacccagctaatttttatatttttagtagagagggggtttcaccatgtggccaggctggtcttgaactcctgacctcaagtgatctgcccaccttggcctcccaaagtgctgggattacaggagtgaaccactgcaccggccgtggactggttatttctatgtcatttttcacccagctgtatatgagagacaacaggggagcttttaaaaatactgatgctcaagctctacttctagaaatcctggggtggtcctggacaattagaagccctctaggagatgtaaatatccagtcaaggttggcaaccactggtctagatggttagcagtagggatttgactcagaggggatgtctggcgatacctatggattaatagttttgtcaaaaccaaaatatgtaagtatctctgattatctaggccatttcttctttcccttgttacaggtaattgagaagaaatatgattttcttataattctcatagataagaataatttgttgatgtgaacaaattataattccatccttgtttaatgcttggcacttacacttagtgaaaatgctgggtgtttgtaatattttttatattggagaagagtacttgtccttagctaggttggattctgactattattgcaaattttgagctatctccttagtttaagtaatgaggtaaggatattgcttctccagggtcttaagtttaagcattgatgttttgattttcagtagagaatcaggaggtgggagtcttttgattaataattaactgagggcccggtatggtggtgcatgcctgtaatctcagcactttgggaggctgaggctggcggatcacttgagctcaggagtttgagactagcctggacaacatggtaaaacaaaaaatacaaaaattagctgggcatggtggtgcatgcctgtagtcacagctactcgggaggctgaaatgggagcattgcttgagcctgggaggctgagggtgcagtgagctgtaatcgtgccactgcattccagcctgggtgacagagagagaccctgtctcaaatcatcatcatcaccatcatcatcatcatcatcatcatcatcgagttacttgattgtttcagatttttctttatctcttaactctgtagaatacagaggcacagtatttgccactaatctatatcaagagcagttataagccaggtttgttggctcacagctgtaatcccagccctttgggaggctgaggtggggagaggtgatctgtggtcaggagttcgagactagcctggccaacatggtgaaactccgtctctactaaaaatgcaaaaattagccaggcatggtggcaggcgcctgtaatcccagctacttgggaggctgaggcaggagaatcacttgaactcgggaggcagaggtttcagtgagctgagatcacgccattgcaccccagcctgggcgacaagagtgaaactccatctcaaaaaaaaaaaaaaaaaaaaagaggagcaggtatgaaccaacatcaaagtgttttaaccctcatggaagaagcaacttgtaaatacccttatagttgagagtcattacctaagtatcttattggtaacactgtatattgatatttctggtgttatctcactcaagcaattatcaaaatgttgttgctatctctaactggtatactattaaagtgctcattttaatacgtgcccttcatagttcctgaagtaattctaaagaaaaaaagaataatcgatctaaaatacaagtcttttgttattgttattgctgttggctgctttctggaaatattacacagataataaaaattaatttaaattaaatgaatttaaatgtttataaactaattgctttagctaaagcacttactctaaaaagcttattgaaaatagcattattcagcattaaccaatggatttgtcagtgtaagatctaaggatttcctacatgtaggactgaagcaagtgtgagacaccaggtttgcactaatgtgaattattagtgtatttcacacctgtagcctccattatagaagatatatatatattcaatttagattatatatagatctatatctcgaggaattgctttgagtctgtatttattgttgctgacaccctacaatatttagcttcttaagtaaaatttgaggctactgatttggactgagctcctgcactaggctccaacagaccagcctgtggaaccatgctagggttccacatcaccaaaccaaaactaagcagtttacttgtaagatctgaccttctgaaaaatcaggagagagatgatagccaaattctccaacaggccagttttcaaaaaacaaaaacaaaacagagtcacagggactgatcaaaaggcacccagccaacctgagctggcatgaaaagaagtcccctctgctttaacccctgcaagggaagtaacctgaactaacctaacgttaaccacttggtttttgctctgtgttgtttttcttcctgctcaagctaccttaggaaagaaaacccactgttttgccatgcccagcggacctcctattttgattggatactgcctggctcatgaatcatgaataaaagccaatttgatttttaaaactcaatttgctgaaattatgttctttggcaagctgtacaataattacattagggctacattaaattcagggtggttaagagtctataaagctttacagtacttccaataatcatcaaaagtgttgttctgctccagaaatataaaataacttttataatttgaatcagcaacatatatcaagtacataattttgaagtcacactttcaatgtggaggcttcatgaggattaggtaaaaatcatgatataatagaattagtggatacagtaaggtgaagattttgacgcaaggggctcaaagagatttgacatatgagtggttttatgtttgctattgaaaaattgacgggcctttcaggaagttctggaatgtacattatgcaagttttgtcttcctgggcaagagtctcctgattaatagtaaattgtaatagtaaagttttatagtcaataataaagttgtgttgatgaggccagtggaatagaaagtcatgttaatatgttaatatggagagtaaactgtggacaatttccgttctcctgggtttgaatcttagctctgtcacttaatagctttgggatcttgagcaagtcagtcatcctctctgtgaatcagtttcctcatctgtaaaatgggcataccaatactaccttctcatggaaatgaattaatgtatacaactggcttagtacctgacacatttcccctcagatcctaccacaccttcaacctcatagaatttaccttaggagaaataaaggccttaagtggttgttttggttttacatatggacatatatttggctgacattttccatttgtattgtttaaatttatacagtaaagtctggctacataattaactcattgacaattgcatgtcttttagatactctcagcccctgcatgaagaaatagcattgcataaacacctgaagcacaaaaatattgtccagtatctgggctctttcagtgagaatggtttcattaaaatcttcatggagcaggtccctggaggtaagagatatttctttctttaaaaagtgtgaatgtttagagcttcggaggggagtaaaattgaatgggatttactagcgtacaggtcttaatctgtctaaactgaaagaaaaattggacatgtgacattacctccagtttgttaggagatgtcaaccataaatgatgagatttagaaaatatcctaatgtatagagtttattccagtgcaaagcttgaggatagccacccaggaaacacagactccaaaagaatgggccagtgttccaaagtgaggaagttcatgtttcacttatataagctgaagactaacagggtggcaacatcttctacccaaagtcattacatttaagtggttacagcttgctgtattccaaggcacattattttaatgttccataaggaggggtaatggtctcgggggatcttttctttggcaccattcagtcttctccaatcatttacaggacaaaaatgcggaagagatttagcctataatcgcagaatcagaagttacaactgaatgctatatgactcaggccacaaagtcacattccttaaataataaggctcaaataatttaaagttctagaagctttacatgtgaattatgtaatttcacagagacaatacataaatatgggaaccatttcagtatctatcatcatgacttgaattaaagttggcaattgacattggccttttacttagacatatttgattacaagcatctttagagtagggatatttgcaaattcatgtttgagcccgatatccagtatagctcctgggccactgtgaagaaccaatgactgttagcttaaattactgttacattattaatacactttaaagagctcatttgaatgaggatttatttactatttatccctactttacaggaagtctttctgctctccttcgttccaaatggggtccattaaaagacaatgagcaaacaattggcttttatacaaagcaaatactggaaggattaaaatatctccatgacaatcagatagttcaccgggacataaaggtgaggtacaccagcattcattttcatgagttctttctttgctgggttattattttacttgcaaaagtcatattgtgttatgagtattaatttagaatggtgaataagtaaatcttagaaacagcagaaatataaaatatcgttcaaccctgaatcagttatttatgttcatgtcttaacgcttctgctcaaggaacacactgcttaactgcgttcagccaacaagattgtgctcccaccacacaatgtttcctaggagctctgtggtgtgggatgcagctgtcaaaagttaaacaggagatggcccctggtcctgaggagcttataggctggttaatctttgtatccttgcccatagtagctactcagtaaatacttattgaatcaatggatgaatggttagaagaaaaaaaattcctcttttctcacaagtatcacatattcattgatttaactataattataaggtatagattctctaaaataagctaaaataataactttacattctctttttaaaaagaaaattcagaactaatacattttttacaaagtctggactgttgaaaataagttaatattagtaccctaaaatcaaccaaaaagcccatttatctatcatgtccctacatattccaggaaaagaagtaaagaaacatagaaaagaaagtaaggtaactggaaagttatgaaaatcgtaatttaattatacatacatcattatatatctgtaaatagcaacaagctctaaccaattaggaatcatatttgatcttgtgatctgagtagcagattatgaagaacttataaccatccaatgagttcatgttgcccactgaccagatagagctgatttctcaagatgtaagaattgcaattgagaaagagtttaatacacatagagatggccaaacaaaatattggatcttataattattcaaatcagcttctccaaaaatttagaggctagggtttttcaaagatagtttggtgagcagggggctagggtctgggtggttggggatgtaattataggggtgtggaaaatggttcttgtgtgttgagtccacttctgggtaggggccacaggactggttgagtccagagtcacaggtctgggtgatgccatctgatagtcagaaatggagaagcctgtaaagacatctcaaaaggccagtcttcagttctacaatagtgatgtcaattataggaacaattggggaagttgcaaatcttgtgacccccagaataatgggctgataatcatttgactgtgcctacatcttagcggactttaggcccctctcatcctcctaacctggtggcctttcattagttttacaaagatagtttagttttggggaagggctattatcaactaaactataaattaaatttctccaagtgagcttggtctacaccctggaatgaccaagggcagtttggaaatttaaagcaagatggtggtggttagatcagatctcttttactgtcataattttctcactgttgtaattttcgcaaaggcggttggtttcaaactgataatatgtaaacaaaaaatagtgtcaagaatgcactattgagataaactattaatgaagaatacagaattaatgtcgttggtagctgtaaggacaccttttttttttttaaattggacttaccaagtcaacaacagacagtatctgaagaaagataacaattgtgattaaagtcctctgttctctagggtgacaatgtgttgattaatacctacagtggtgttctcaagatctctgacttcggaacatcaaagaggcttgctggcataaacccctgtactgaaacttttactggtatgtttttgcaatgatgatacagatcttatgtaattaaagaaataattgctgagtttgagcacaatgtgagagagaaattcagttggtgttctcacacacagtaatgttggtatcttttttctttcttttcttttcttttctttctttttttttttttttttttttttttttgagacagggtcttgccctgtcacctaggctggaatgcagtggtgtgatcacctatcactgcagcctcaaactcccaggctcaagcaatcctcccacctcagcctcctgagtagctgggactacaggcatgcgccaccacgcccagctaatttttttgtatttttgatggagacaaggtttcaccatgttgcccaggctggtctcaaactcctgggctcaagcgatatacctgtggcctccaaaagtgttgggattacaggcgtgagccactgcgcctggccaatgttggtatcttttgatgctcactgaaaaatgtgttacagaatttgatttggcccttttctcttcctgtatttatatgacttgcttagttagtctcctgcttaatgccactgaagatttttttttttttttaattctcaacttgttacttatttttcttttcatgtaattacttctttcctggttggcctacaataactctagcaagatttttttttttttttttttattaaacatttccttggcccaacctctctgtgatgcttactcataccctaatcacttcccatttggacgatgaattccctcttttactgtttactctctgtggttgactcccctactccacaatataaataaccctaggatttcaattcagaagaggaagtgactcaccgactcagaagaagggagggagagagctttcctgagaaagtaggcaacgcaaccactgagctgcctctggtgcaaagtactgggagggtggagaccaagtgatttccaaaaaggtaacagtagccaagaggaagctcagactcaagagattcatgactgcccaacagttatagggagggtgtgtgagacttcaaacctgatctccatttagttcttatcactccatcatgctaattctcatgaagtgttaagttcttcttatagagagaaatttagcaggaaaaaaaaaagggtaaggggaagggaagagaaaaagatcatgaataatctttggtctaatatgaagcaacatggccccatctcaattctgtgaggtaggtgggagtacctccattttgtagatgaggaaattacctgggagagaagtgacattgcagtcagaagtcacagcagtgtgtaccggatagaactcagactggttttttgtttttgtttttgttttgagactgggtcttgctatgttgcccaggctggtcttgaactcctgggtttaagcagtccacccaccccactctcctaagtatctaggatgtcatgcctggcaaaactgtttttttgtttttgttttttcttttgagatgggttctcgctctgtaacccaggctgaagtacagtggtgtaatctctgctcactgtgacctcccctaccccgggctcaagtgattctcctacctcagcctccctagtagctgggaccataggcacgcacctccatgcctggctaattttttgtatttttggtagagacagggtttcaccatgttgcccaggctggtctcaaactcctgacctcaagtgatccacctgccttggactcccaaagtgctgggattacatgtgcgaacccccacgcctagccagaactcagattttgtatctactgtttgctctttgcttttaccttctggctctagtccatctttctctctaccttcctgcaggaggagagagagacattctgtgtaagttttttccctagagcattcagtcagcaatacccctggcccagctcccacctcagggcaatggatattttagggtacagaattaaacacattttgaatatatttttttgaaaaaactaaattctgacctattaataacttcaaatgtctttacatttctttcctcttactcttaacttggcaagcagcagtttcagtgctgtcaagactcagtaatttctgagaggaaaatccctcgtttcacacactttgtgggacaggatgttaacacagtatcttctgctactaatctggggaacatcttttttgtaaaatctccaaaggaattgtaggaaagcagtcctcacagagcccttttcttggacctcttccactggtgtcacgtaagagtgacgtgtgtcactaacatgtatagatctgtccccagcaccggtcccgagggccctgcacatcataggcttcaaacgtgaacttggtggtcactaagtcccaggtgggttagtcccaggtgctcagtcaataaattggtctgcatcaccttttggtgattttgatgagggaaaaggcagcagtgatcaccatttatggagtgcttactgtgttaccttgctctgcactaagtgctttacatatgttgttttattgaaattcatacatcagccttaatcattaggtatcattatcccagtttgtggtgagaaaatgaaggttcaaagaggttgaataacttgcccaaggtcacaaagctagttggtaatagagctgagactcaagcaagacttaacaggccaaagggaattaattatcttctcccaaacctgtccccggcacactcttctgtcccagttggcagccactcccgacattgttatccagggcacttctcttttctcacactccaacccagtccgtccacgaagccttcaaaacatgtccaacattgggccggttctcaccacctctgctgctgccactctcatcgctcacctgcattttcggtggcttccccaactgtgctcctgcttcacttttgccccctactgtctactctcagcactgcagccagagtgatccctctgaaacataaaccaagtcctattgctcagagccctcagtggcttgctttttttttttgttcagagtaaacaaatgtcagaaccctcatagtgggggacaaggctctgacctgattcggagtctgttccctttcagaccccatttcctactcttcttctgttatttactcagagccagaaacgtggaccttcctgcatttcctccatgacagcaggcagggtcccatcacagggcctttgcacaggcttttcctcctgccgctaccccagctgtctgcatgggtaactttcttaccttcttccagtctcaacgcagatgtccacctctgcagtgagaccagccatgaacaccctatttaccatggcagccttcctgctgatcctcttcactcgggtctatatttttttggtcataacatgtcactttctaacatgctgtataatttacttactgtgctgataatttatcatctggcttctactgcaaaaacataagcccaggtatttctatatgttttctcctctgctgtattctaagtgcctagaacagtgcctggcccatagtaggtcctcagtgtggatctgttaaatgaatgagtgaatgaatgaaatgtgacattagagtttaattaaccactaagctgtaccacctccctgggtagttgcagcagcaaagaaattctacaatagatatttcaaagcaattttttaaaaaaactttagaatgcagatatgtgaggtatgagttttagagcaaatactctcattgattttacttaagccagtgttcaggttggctctcatcttcattatccagcttcgtaaattgctttgtttaaaatattatgtgtcatgtatttgtggagtaaaaagaggagcagataagaacacatgactcaacctgtttttctggcacttgctcagtgggggataattaaacacaattggcagatggttatctgacaaatcaaatattgcataatttgttgttgacattacttgaattgtctaatttacgatgtttaaaaattaaaaatttccaaattttgatccactataactcccacttagctattagtacaacttaaattctctcattaattctattctaggccccgagacaacaaaagggggtggtaggcttcgatgcattttcgaaaagaccatttgagcttatttaaatcatacaaaattatcacttggggaaaagctacaaatgaagagaaatcataccaattttgtagtaaaggtgggcgagcgtctttggggagcatggttgccttgtctttggccaggtgaaaggctttctgagagcagacatgtgcagttgtatgttagcgtgaactactgctatgcagtgataaggtctgcaggataaacctagaaagactgcaatacataacaaaaatgatacacttttatttttgtaaacaatagtccatttctcacctatgatagtgcttttcagaggaacagtttgcaggaattttacacaattgttttcacctaaaaccatgcatgaggcattcctaaaaggtgtcatctgtatttatcaaaatgtctgtcactttggttatgaatcagaaaatctgaagcagttcttttggcaaacacctcataatttgaagtaattcaacatggcatcttggatgagttcttgtttgctgactatattatttgtatatcagaagcagggtatgcggtgatatgtttctattcatgctcctgactcattgctagactttaggaaaccactttatggggtattcgaagttcaaatccagcctctcatttaggttaatgaggtagttgtacttaagtgtttacctggggtatactaggccagaagcagactaagggctcgtggccccctccacttaattctttctattataccacactctccacctctctgattccatgcaggcttaaagctcttccctttttcattgtattctttttgtttgtttgtttttttgagacagagtctcactctgttgcccaggctggagtgcagtggcgtgatctcggctcactgcaacctccgcctcctgggttcaactgattctcctgcctcagcctcctgagtagctgggattataggtgcccgccaccaagcccggctaatttttgtatttttagtagagacagggtttcaccatgtttgccaggctggtctcaaactcctgacctcgtgatccgtctgccttggcctcccaaagtgctgggattacaggcgtgagccaccgcacccggccttcactttattcttagtcactgtatctgattatgtgtctatatggatggctcatggcctgtctttgatctcttaaacctgttagtccatggaccacagacagcagcaggagtcatgtatatttggattacagaatagggcacaccagaaatttatttgcattaattttcacaatggctttcagaatctttatgctgtcatgattaagaaataagaatgaaaacagaagagttaaagcattcaatttaggaactgaaaaatagagatagagctaaggaaatggatgaatgaactatattctcttctggaaaagattagaagtttacataataacagtcttcatgcacttcaagaaatgtgtactgatgttattgttctcaaaagactaattgttagaagtttctaagaagcccaatgaaatgatgcctcacttatactccactgtctagggaataagagcgtacctattcataaccagataatatgggtaaagtatttttatgtcactgatgaaatccattataaaaactgctatttccacttttattaatagcagagaaaactggaactcacaaacgatattaggacttgaatcatgtttttacagttgtctcatttctgttgaaaaattctgttgaaaaactgtcattagatacccttctgttttatctttttaaaatggaaatgtgtttgaattgtttccaggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtcacacttcatttctcttaaaaacaaatggataaagctttttatagctgttggatgttctgtgtgtgtgtgtcatatttttttagataaagggtgctaagtaaacacaacttagaacacattaaaggtcaagaagattctctctcggttagaaccagcgctggtgcctcacacagtggatctctctgtgccttagttttctcagctataaagtgagattcaatgtaacttccattgaccaccttttaacaacgcagtataaataacacatgactatactgaagatgatttaagccctttgggaaacagtctgaaaattttccgtgaatgaagatagaagaactttttttataatccatttaggaattaaaccaaaattaataatttcctttacttctctaccataatagtttgaaggcttcattttttttaaaaaaaaaagagcataattaccattttaagtaaatcagtcttattctcatatacctactcctctagcttgttaatttgcccatcagtaactcctatgggaggaggaagaagccccaccttttgcagtaggaggtacctgataatagaaataggctcatgagagcacaagtgccagcattttgagatctggggactgagcatggctatgacctgcatcttgaatccctgcagtcctccgctgccagactgccaggccaacaggaagtttgaaatggaaacatgcttcccaagtagtaaaactcacacatctgctactttctaaggcagaggacttaaaaaaaaattatttatttatttatttattttttgtgctcccctgtgggatccaaggcaaaggactttttcttttctttttttttctttttttctttctttctttcttctttttttttgtggagacagagtctcgatctatcacccaggctggagtgcagtggcgcgatctcggctcactgcaacctccgtctcctgagttcaagcaattctcgtgcctcagcctcctgagtagctgggattgcaggcacacaccatgacacccagctaattttttatattttagtacagacggggtttcaccatgctgcccaggctggtctcaaactcctgagctcaggccctccgcctgccttggcctcccaaagtgttgggattaccggcatgagccacgcgtttggcctgagaggacttttgatggtaattgttattcctctccctgctgcagaccatgtttctagctcttattccatctgtgcatagcctcttgtgaggggccatgtgttgttacagaccttctgcttttgtgcaaagcttggctttatgcttgaagacaatctgataggacactgctggtataaaaatgagtagtgtgaccaaacctcagagagcaatggcaggtgccaagagaggtgcctttcttgccatgagtggatgtctttctcttcttggccagtctttcaggttttctccagtgtctaggacttatctgaaatgctgctttataattcacgaatgcaatgattattataccatgtgtttttttgtcacattaggccagtctaagctgtgcacaggaagttgctatcttagagagatgacatgacatagactgtggcaccagtttacagtgtttgaatccaggctccaacatggtcaagatatttgagactttgagcaaattatttaacctgcttgtgcctcagtttcctcatctataaaataaggataaaaatagtacctgtcagccaagcgtggtggctcacacctataatcccagcactttgggaggctgaggcgggcagatcacctgaggccaggagttcaagaccagcctggccaacatggtgaaacctcatctctactaaaaaaaaaaaaaaaaaattaggggggcacagtggcaggcacctgtaatcccagctacttgggaggctgaggcaggagaatcacttggactggggagatggaggttgcagtgagtcaagatcgcaccactgcactccaacctgggcaaaaaatgagactccatcttaaaaaaaaaaaaaaagtacctgtataataagagctttttgaggagtgtatgaggtaaaatgtaccaagcacttagaactgtgtctgacacatggtatcggctatataattcttacaaataattatatattgtttatattacaatgaatttacataagctgtataagaacaaaaggatttcctttgaaaatttgctctgtactaaaaaatgaaaataccattaattttttttagaatagcagtaataagtaaattctaattgttataaaaatattgtttaattttaaagtgcttttaaatatctcttttaatgcaggtgatttgagacagggaagatattcacaaatcatgtaatagggaaaagaacataggctttaatccgaacaattcaggttcaaatcccagatctcccttttcttagccttgttacctcatcctttctaagccttattttcctcattggtgtaacaaggaaaatatttaatccgctggattgttggaaggatttgatgagatctgtaagtggagaaaccccagcacaatgcccagcacttagctactgtgagcaacgcagtggtctcagctcggtggctgagcatggtggctcgtggctgaaatcccagcactctgggaggctgaggtgggtggattgcttgagcccaggagtttggaccagcctgtgcaacatggcaaaaccccatctctacaaaaagtacaaaaaattagccaggcgtggtggcatatgcctgtagtccgagctacctcaggaggctgaggtgaaagactcgcttgagcctgggaggtcgagactgcagtgagctgagattgcaccactctgcactccagcctgggtgacagagtgagatcctgtctcaaaaaaaagaaagaaagaaagaaaaataaagatcctttttgtgtgccaatgtaccaatatgttctaaagctttgaaggactaaattattacttcatagtgctgcctactgtcttcaactaattattctgcctgtgccattggtaaaggtaccaaggcactctgttgatcttctataacctgcagcaaacacatcttatctccctttgagaaaagccataagtttgtgttgtatgataagggatcttgttgcattggggggtcaagttatggaagctggagttcaggtgctgagatgttcactcagaaggcacattgcactttttatatttatgtcttaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcaggtatgtggttgcattgaagaggatatagtctgagtccttcaatcctaagcttttaagatggaagaattttccggaagtaaactaacctgtttacagatatcactggaaattggtataaatattagcacagtgttctcaggcatttggttgcagtatcagggagctgtattccatcaatttcacaagtgctgggacctcatacataatagtcttcaatcacatagttagtaggtagttaatatgtcaccatctatatcactctaacattgtggatactaaggttcaagtgtaagaggggttaaatttagccttttagagctgaaaccccagattaccacaaatgggcctacagagccattatagagctgttggatttccaagccctgtaggtaataggttcttttaaggcagtagaaaatacctgttgcctcttagggtatatacttctgaataattacacccaaaaaaaggcaagaaggaaaaagaaagagagaaaagattgccagctataaataaaacagtagtgtaaaaatataagtacattatatttttgcaataattgtctataactcagaaaaaaaagtaaaggttccaattgttcttggcgttttttgatgtttatattggaggagaatgggcagattgaatgtttggaaaggacattgaccccatttcaggcattcattttttgttgatttctcagtttaacaacaaacccagcacgtgcttattcatggctgtttgcttttctttccacagctctttcagctggatcaaatggtgagtttgtttttactttgcccattgagctgagacctggtgtctggtgtgataaactccagacttcccatcaagtagcctcatgctctgctcctggcttacatggggggaaaggagggtgcggtactagatactataaggatgtgtgcagctgcaagcctggctgggcttattcctttggaaatccttcatctttctctttcatgagtggggatggcttaaattttttctccctaaaagcaagatggtgactgtgtttttgacagcttcaatttgagtgaagtaaatgcttctttatctaggaaccagttgactacctaatgtatttcttgtggaaaatgtaaatgccagataccttcctctgtcatctttggggtgatacattctatttttagtggccaggagttattgtgcctttgttttctaacgttggcttttgcggatcataactaggaaggtagagaaagtagatttgctctaagaagatccattaaagcatttagaagaataataaagaaatgaacatgaggctgggcatggtggttcacgcctatagtcttagcactttgggaggccgagatggtcagattgcttgagctcaggaattcaataccagcctgggcaatatggtgagacccccatctctactaaaaatacagaaaaatagctgggtgcggtggtgcatgcctatggtcccagctactagggaggctgaggtgggaggatcgcttgagactggggtggtggaggttgtagtgagccgtgattataccactgcactccagcctgggtgacagagcgagaccctgtctcaaaaaaaaaaaaaaaaaaaaattaacagcatggtgttggattttcctaagttggatgtgtggttgatcaaacagttcagggggcttaatgttcattgtgcatgggttctgcaggccaagggcaggtttttgcaggttcctctgatgccccaaagccagtcagcccagagtagaggcctgttaattggggtttcctgggtacagcctctctactttttcttcttccatttcttccattctgagaatctggggaaactcagaagaagacaggcacacccttgtacctcttttctccacagacagcctgggctccggaaggcagccttgcattgtcacaaagtcggccctgcagtgcttggcaaccttctgaccagcctgcttctggtgtcctaaaatgggcactgacttcagaattacacagaagtgggttctgatcccattgacccactttctaaatatgggacatgcatatttcttctgtcattcggtgctggtaacattacctacttcacagatttggttctgggaataaaataaaataatatcctaaaagagccttggagctgtgcctggaagtttaatccatgattgttttatcccttccacatggcttggtttttgttcgcaggaaatagtttcccatcacacacacgcatttaacttctgtgaactcaaccatacacacttggcaagagcgtgcatatatgagagagagagagagagagagagagagatcctttaagtggacagttctatgtcttctcagtgactatgtaccttggggtgagcgtgagatggacggtgtaaacctgctgaactctagtcagtcaggttcccactgccctttcgccgttcttgcttacatatggacttgggcctagaaaaaggggcagtccccaattccctgcatgattaaactgttcagactctcagctaaaacaatatcattacatggatgatgtgcctcctccctctccttcctaggagagcaggacagatgtgctaaccaaattaggagctaaaatccacgcccccccccccttttttttttgagacggagtcctaggctggagtgcagtggcataatctcagctcactgcaacctctgcctcccaggctcaagcgatcctcccacctcaccctcctgagtagctgggactgtaggtgcccactaccacgcccagctaatttttgtatttttagtaaagacggggtttcgccatgttggccaggctggtctggaactcctggcctcaagtgatctaccacctcggcctcccaaagtgctgggattacatgtgccaccatgccttgcctaaaatcccatttgattgttcccaggtattataggaaatggcctgcctcatgtcaattgaaacaatgacctattagctcgtcttactctccttctagatgagtacaagatacaggcctcttccttccccaggtactttctataggccatatatgtgtttctgtccagagcacaggcccacctctcaaggttctctacctcccataactgcacttggcttcccctcaagaggggagtaagagggtggtgacaatgagacccccttcccctttagagagggacatgacttgtctcatcctgactgctcttccatggccacacacagacccagagatttaagtaattcatgtcagcttaaatattaattgtacagttatggtgtgcacaggaaatgtgctaggccctgaacgtataaggatgataaagacagagttcctgattttaaagagccattgaccttataggagaaaaacactggaaaaaatcatctccaccatagtatagtttagtctgtgcagaggagtcaaaagggagagacagtgactgaagtcagtctgagaatgctgtttcaaggcagactttccagtgaggtgcacctgatgagtaaggacaaatatgaacttaacaggtgaatggggagtggagatccaggtgaggcgacttctcgcatgagttaatgccaggatgtgtgaaactttactgtgtgttaagggaggcttgctggctcagcagcactggtgcttaaagtaaaaggggagggatgatgctggagtggggagcaggctcagatcccaaagggctccttatgaaatgttaaggaatcagcaaggagggttggggagccggggaaaatttttatctgaaataatattatagaccagcactggacctatgattctacagtaagagaaatgtcatttatctgccctgtccaatacattagccactagtcatatgtggctattagacactaaacatggctaccatggctgaggcactgaatttttattatttaaatgtcagtgttaataaccatatgtgggtagtagtgaccatattggacagtgaagctattgatggatcattccgatggctgtgtgaggatggtttatttagtaagatttattccataacatttttaaccctctgctatgcacttggcactagaatgtaggcacaaggcactaggaatatagctatgcctcagttggtcccagatcctgcctgcatggatctcttgcaatgcttgttaaaaattaaaatgcctggcccttctcagaatctggaggtgcaagctggaattctgtacttttaagtaaacccagatgattcttgtcatcactgcagtgtgagaaccactattctatgtttggccagttggagactggaggcaggatggccagttaggagactctgtgttgtggccagactgttcctaaactgtctaggagaaggagaaccataaagatccctagtgatcatgaatagctgttaggatctgaggccaccctcacagcaatggaagggatttagaaaatccccgttttcccaaagcaggaatgtatctaattccttaaaggtcgcactgtctcccttccatagatgggagctcccagcaatctggagtccatagggttgccagtcacccctcctgactccagcctactcctggcctcttggtaaagctatctcttaggggatatggggctcacaccccttcccatcagcccctgaaataaggcaatgagaatcatctccttagagacacacctttgacatgtcctatcctcagagaggttcattcagcctcttttagactcttcgtggtcagccccatagaggagggcttcttaatacctggcaagatatcagcagtaaggctgcctgtgactggaaatcctgccaggctcctctcttgcagcctggggtcccaatcactcacgtgtatgagcttatgttcgaggaacttgtaacctctgtgatatctggaaactgtcaccgtgctcccctggaaatagttacacttgagcttcttcccatttacagtgacacagaaaggcactacgcattctcacttgcctggaaatcgtcataacttaagaaggtagaaatctcaggcgtggatttgatcatatttccaccacaaacgtataaagcaaactgtctcagcaccacctgtcttgctctttccaccccttacaatagagaaaacatccattttcctacagaaggccaatccctcacagatgagttctggctcctgtggagcccccgtgactcctccagcttctgcctctcccagtgagttccatatacacatgctctaatgtcttttgtcctaaacccgtccttcccctgatctacaaatggcctcactggctgacaccaccacctttttttgccccacatcacagcttcccgtcttgaagtacagtgtctccagatctccacctcttccttcccacccatgtagcgtctccccttccacgcgatcactgggcctgctctggccaagatctaatgagatctctttagccaaatccaacaagtgcctttctcaacctactcaacttctcagtggctctcagcctggatgactgttctctcttactttcgccctctcctgtgtgggcttccatgacaccccattttctctgttttcctccaacctcatggctgctccttgtcattctccttggctgcctgttcatccccttcttttcctctaaatattggcattcttaagggccgggtctatgctgtctttttatctttccccaaattatgtcatcctttactttaaataccatctccagccaggtaggctgctgaggttctatctagcccagtcttctgagctccagactcatatccaattgcttttttcttttttagatggagtcttgctggcggctggagtgcagtggcatgatcttggctcactgcaacttccgcctcctgggttcaagcaattctcctgcctcagcctcctgagtagctgtcactacaggcacacaccaccatgtcaggctaatttttgtatttttagtagaagcgaggtttcaccatgttggtgtcttgaactcccaacatgagataatcctcctgcctcagcctcccaaagtgctgggattacagccgtgagccaccgcgcccagccgcccaattgccgtcttcatttttcaaactgaactgtcaaataacaccccttatccactaaaaagaactttcctttttggcctgtattatttctcatcttagaatataagtacgatatgcatccattcagtttcttaggccagaattctactttggagtcatttttgattcttccttttcacactcttcactccagtccatcagcaactcctgctggctacctgacatatagtagatgatccacaactgtatgttggatgaatgaatgcatgtgcctaatagagaaggggactcaatctagaatcaggttcactcatttaaaatcaagcaggccgggtgcggtggctcaacacctgtaatcccagaactttgggaggccgaagcaggtggattacttgatgtcaggagtttgagaccagcctggccgacatggcgaaaccctatacaaaaattagccaggggtggtggcacatgcctgtaatcccagctacttgggaggctgaggcaggaaaatcacttgaacctaggaggcggaggttgtagtgagccaagatcatgccactgcactccagcctgagcaaaatagtgtgactctgtctcaaaaataaaataaaatcaaaccgaggagggaatcagggctctgcacatagaacatgcagaatatctgtaagtccctttatttccttaacgagccatagtgacaggcactcggttccatccttaagcatatacagttttacctcattaggcctccttttaggcagtcggtagtcacagcaacgttaaaattcacaggcgtgacacaagtcctctcattactggataatcaaaccacatgatatgaccaaaaagccaaaatacaggataattcaagtccttactccttctcttctttagatacacatacatttaccacacacacacacacacacaaacacggaaacacacgataggaatccctcatcttgtactcttctagtctagtctgtactagtctctttactcccaagaaacaacaattttgtctttgaaatatgaatgatgcacacctccgtttctgagtgtggcatgcatctcataaaaatgggctggtgaagaaactcaccaagtctgaaggatcagcagtgagttccactgcagggcttgtatcccttcttgtaaagagatcagctactcagtcaagccaagagctcttcttcagctgtattcttccatcagtaacatttaactttagggacttgacatctcatagcagtgaaactctttctcccaagcagctatttttttctgttctaaagtccgttccccccaaatagcgagatgttgactctaaagtgaaacaaggcacactatagaccttgaccttccccaggaatgactcaaaagcagtttggtgtttgggccccccttcaaacctttcttctctcagacaaccttactattaccagcaaggaagaggtcacccatttcctttctgctgtagcagcactgcccaaaatatggtccgtgaaatgctaggcccatgagctgctccagaatatgtggaaacaatacatgccaggcatttcccctgccatatatcatttgcatactggtacttaattggtcaattcagcaactctttgtggcttcctcttgcttcctgccttctagtgattcagctacagaactatttaaataacagcagataagtcaaccaattcatcctggggagactttccagttactgaccagtaaggtggtttcccccgaggtcagctgttcctgaaagctgtatgtacttccgtctttctcgctacagctgaaaccaatgtcatgagtcccctatccttgagatcagggcagttgattcagttcagcccaagaggaattaagtaagaaggagattccaggcaacagtggatttccttttctataattttataccttcattctttattaaaatgcttttgtagcattaggatgtgtgtttgataaagatgtttctggcaaaaaccactttcttttttttttttttttttgcatatctgtccataggatagatcatggacagtattttattgtgattcagatacccgtttctctcattaggagtgaggctgagaagttttatatacatttgggagctttttgtgtttttctttctgtgaactgttcaggcatacatatacagagactgactagctgtcctccagacctgtttccttttccttctggggtttcccagcctcctggcaagtaactgtggctggtggactgaggcttgggcaatggatggtgggcccgagtggcaactcacccaagcatgattcataaaaacttcctatgagatcctcctactctttcttccccatctgctggaaagatgttgacacccagagcaacctatgaagctttctttaaaaccaatgtttgaggaaatataggcaactccactgtcttattctccatccaaataaagaagcagctcatgtctactagagaatcatagtatctgagaaccaggacagacctaagagatcatctagtccatctgtttccaaaatttgttttcagtgatgaatccttttttatatgaatccttaagcagaactgtgatatatgacagtcagcatattttctctggtttcaggtataacaggattggaacctgtggtctagacctacagcatcccactcactcatcccaaccaaggcagccccaagatgctaatggagacacttaagcccctgaagaacaggcttaaagattatcaatctgaccctgaatttgataaatatgaaaactgagacccataaatagaaataattagtagtcagtaaaaatgaggggatcagaccctcagtagacccactgaacttgggcttccttgactgttttggtaccccagagatatccctcccagggcctgggaggccctttcctggctaccctgctgtatgggttatgctgagcaagggaggcagtcataacacatgaccgttcccttacatagcataattatgctgctcattgcaacaagatatttgacaaagaatatggcctctttcaatgggtgtttcagtatgtgtacattttttaaagtgtcaattatcttttccctcctctcatcacaagcagaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttggggtaaagacctgacttacttggggtgagagaagtgtgttgttaagtgtgtcattttataaagggaactgtgatttatgctgcataaattttctcagcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcaggtaaatcctctcccaggtgcttcatttcccaaaggttacatattttatctgtgtcctaaccgcctgcagctgtcacagatgatgtgaaaggcaagaggaacctgtagtgatcatcatgataaacctaccccacaggaaaaaagaaggcaaaccctatggtagggaatatattaatatgaaaatagggaaatgattttttcattgcatttttgaacataagctatttttaagtcagaagcaaatttttcacattggtgacattccaaatagcccctacaagcctcttttactcttcattcatttgtttattcattccatcaataaacacacattaagccatgtgagttgctaattctgacattagcatgaggctacctgccagtcgctcctctcagcatttgggaaacatcagcaaatacaacagaacccctgagcttgtaaggttatatttaaaaggagggtgaagggcaaagggaagtaaattgtagtgagtcttcacttaatgtagttgataagtccttggaaactgtgactgaagcaaaattacatataaccaaaccagttttgccgtagactaattgacataaacaagagttaagttcctatggcatatttctggtcacaaaaacatgaccaaactcctaaataaagactaaaacacttctaatattctacattgaaataaatgtgaactctatatacatttaagaaagatgaataaaaacaagataactatctacccagttcaaggccatgggtggccagagcctattctggcagctcagtaccaggcgggcacccgccctggaaaggacactattccactgcagggtacatacacacacacacccacactgagaccacgtagacacacaaatgaacctaacgtgcacatccttgggatgcggaggaaactatatgtattagtctgttctcatgctactaataaagacatacctgagactgggtaatttataaaggaaagaagtttaactgattcacagttccacatggctggggaggcctcacaatcatggtggaaggtgaatgaggagcaaagtcacatcttacgtggcggcaggcaagagagcttgtgcaggggaattcccatttgtaaaaccatcagatctcatgagacttattcactatcatgagaacatcacaggaaagacccacccccatgattcagttacctcccacttggtccctcccatgacacatggggattatgggagctacaattcaagatgagatttgggtggggacacagccaaaccatatcaccagagtaccccaggtaaggccacacagacattgagaaaatgtgcaaatttgccaggtgtgatggctcatgcctgtaatcccagcactttgggaggctgaggcgggtggatcacgaggtcaggagatcgagaccatcctggctaacacggtgaaaccccatctctactaaaaatacaaaaaattagccaggcgtgatggcgggcgcctgtagtcccagctacgtgggagtctgaggcaggagaatggcgtgaaccctggaggcggagcttgcagtgagctgagatcgcgccactgcactccagcctgggcgacagagggagactctgtctcaaaaaaaaaaaaaagaaaaagaaaagaaaatgtgcaaactccacacagacagtggcccctaccaggaatcaattcttttttttctcatcaaggttagaaggaaacaacattgggcaaaacagtgttatttgaggatctgctgtatgtaatagtttagaaggccatatgtactctgaagaaaacaaaagcttgtcagtgaacctatcattccttggtataatagtttgctagggctgtgttttagtccattttctgttgctataatagaatacatgagactcagtaatttataaagaaaagaggtttatttgggctcatggttctggaggctaggaagtccaagatccagtggcccatctgcatctggtgagggcctcatgctgcttcaactcgtggtagaaagtagaaaggcagtggggcttgagtggaaaaaagagagagacaaggagagccaactggctttatgacatcttgctttcctgagaactaacccagtctgttgagaactacattaactgcattaatcccttcatgagcctcatgacccaaatgcctctttaaagactctgccacctctcagtatcattacattggctattaaagttcaacatgaattttgacaggacaaatcacatccaaaccagggcaagcaaccataacaaactgtcacatactgggtggcttacacaacagaaatgtattttctcacagttctggaggctgaaagtccaggatcaaggggttggcaggtttggtttctcctgaggcctatctgcttagcttgcagatggccaccttcttattatcatgtgctcatatggccttttctggtgcacttgcagccctggtgtctcttcctcttctgatacggacaccagaaacatcagttcaattggattagggccccacccttacgacctcacttagtcctaattatcccttttgaggccctgtctccaaatatatcccattgagtgttagggcttcaacatacgaatttggaggacacagaaccataatacctgggaaaatgtgttccctggaattctgtgtacaaacacaaggaagaatccccttcccaaatatgcaccaggagaaaaatggatttccctcagccccaagcttcttgtggatacaacctcccacagacacactcagtccctggtatgacacttctcatcctcttttagttcaatgggtactgggaactcatctacctgcctcccttgccgtggcctctacctgtccttcatgatcactgtggactactgcacatagcttcttccctccctgtgtcctgaggaaatagctgcaaaaaaaggttggggctagaggagtctagccaagtttttaaagtctctcagtacaacagtttacctgttctcatcttttattgagatgtaaatggagcaaagctctctcttggctcttagtaaacaatctcagcctgtctctgccttgagaaactcactgtgcttctttgctaaacattttatcgccttaggaattccctaatgtccacctctttagatctcatagaaggagctgaaaggccatatatgtgccagtagggcctcagtacaaggagagctgaaatgagtgttttctacacactctcaaaaaccttgacttgggtcctaaaggaaagctgtctcgggcagttactctgaggcccaggaagaaggtgctctagagtgaggggtagctggcctctgagtccagggaggatgagtgtcatgcatgcttcgtggcggtggagactggagtggtctcgagccatcagctttctctctggcctttcctttggctcacggtgatcattcaaagactgagaataggactgggttgacccaagaagaggaaccaagctggatggagagagcagctgggcagcccttggagttctttcatttattcattcaacaaatacttattgagcatcagtcgaaggccaggcactgtactatgtgctggggatgctgtggcgaactgaacaaaaatatctgcatccccttgaagttgacattctagcagaagaagaaaaactatacatatatataaaacatatagtaataacagctaacattttctttaggccagttactgttcttagtattccatgtgtatttgctcatttaattttcatgacagtaatactataccaatagttctattagcatcctcattttacgaatgaggaaacaggcacagaggacttgagtagtttgccgaagtcatgcagtcctaagtgatggagttaggattttgacccaggcagtttggctctgaagtttttgctttaaccaccacattgctctgcctcgctggtaggcccgatggtgacaagtgctaggaaaacataaagtggggtggggattaggcattggaggtgaagaaagaaagtaaatcaccattagccactgcagagtgaaggcctctcctgtggacctttaaaatgcttgattttaggtcaaaaacacataaaacccaggaattgcctaaatctctaattacccccaaagaatgtgcttttccagtacaggaaatgccagtttgttggggtctattctttgtctccctgctggaccatagcatcatcagggataggactgccttggtcatcacttctatgactgtgctgaaatagttaaatgtgggagtggttagtcatattcaattgtttggtgcctcctggttttaaagtgcatttgaatgtcctctgtaaaaggagaaatgaaagaaaaccttaaaagcaaccatcagagggcatgccttaggggaccagcatgaagctaccagtgagtacccgaaactgctgatcagaatcacatgctgaatccataatggccacatgatggtggggcccttctgactgctgttaaggatgttgggaatcctttcctgtgacatcaaatggtgattcagtggtagaacaggtcctgacccaggttgacagctgctattgcaggtcattggggcagtagaatagaatggttaggagcttgggcttagcttgctgtttgaggcctggttccatcacttaaaggctgtgcaatttgggcaaccgatttaacttctcagagcctgaacctcctcatctatgatagaggagtctactttataagcttgctatcaggagtaactgagattgtgagtgatttaaatcataacagaaaatattccacaattgttaactgttattgttatcattatcaagcaggctaataatagttatctaatatctttaatttttttctacaatcaatcagaagtaattattgccattgtattgtttctagatacatatttgtatctatatttaagcctacactttataacaaaaccaaatctagatattggtcaggtcctcaaacccttaaaccatgaaaagccttttaatctgtaacatccttctgaaatcctttcctggtttttgaggaagtttaaaggataaagactggagagcatctttgcagaagaccctgtgtgttagtcagggttctctagagggacagaactaatggaatacatatatatgtaaaggggagtttattaagtattaactcacataatcacaaggtcccacaataggctgtctgcaggctgaggagcatggagagccagtctgagttccaaaactgaagaacttggaatctaatatttgagggcaggaagcatctagcacaagagaaagatgtaggctgggaagctaggtcactctctcttttcacatttttctgcctgcttatattctagccacactggcagctgattaaattttgaccacccagattaagggtgggtctgcctttcccagcccacagactcaaatgttaatctcctttggcaacaccctcacagacacacccaggatcaatactttgtatccttcgatccaatcaagtagacactcagtattaaccatcacaacctggtactaggagtgcaggaaatgcataccgttaaatctatgctgatgctgagtcaggctcaccagatactagccaagatgcttgtttttgaaggcacatgagtgagttaacatggagagactggagtcagaacagaaataaatgatgacgtaagtagatgaaatagtctgaacagaaaacatttcccagagtagagcatgttcctttgcaggacagtagcacacacatcaaaaaaccagaagcaacatgtttttctgttgtaaaaacaaagttaatgtcgaaaaaaaagtttgccatttgaagtttgctattggcaaacatgttgcaactgagtttttactaagagaagcttccaatttctgcataactcacatttttcttcttgaacatgttttcatgatgttatgattttgcctgtgaatctttaccttgggtgcagtttagtttgtggtaaggaaaaaaccaacaaagtttataatggttcccattgtgattttaaagtattcgtttaatgacagctttcaagcttttcaatataatcttatctcatgaaaacataaacatgagaccaagcttccaaatgaaaatatattaagagaaagaactcgatggtgcatttcttttttattttaatagactcctagaaattataattttcacagcccagtggaggaattttaattttaatggtacagtaagaaaatgtacaatataaaataaaaatgatataatagtttcttaaagtttcttatattttcttaaagttaaatgggaacaaataacatcctactgtgcttccttaaagaagcagtgtgggctgggcatggtggctcatgcctatagtcccagcactttgggattacagcactcaggaggctgaggcaggtggatcacttgaggtcacgagttcaagaccagcctggccaacatggcgaaacctcagctctactaaaaatacaaaagttagctgggcatgacaggtgcctgtaatcccagctacttgggaagctgaggtaggagaatcacttgaagttgggaggcagaggttgttgtgagctgaaatggagccactgcactccagcctgggtgacaaagcaagactttgtcaaaaaataaataaataaataaataaataaataaataaataaataaagaaaagaaaagaaaggaagcaatatgccttgctcaaaggagaaaagttccatctgaggttggggaaagtggctcacatctataatcccagcactttgggaggcggaggtgggaggatcacttgagcccaggaatttgagaccagcctgggcaacttagcaaaacccagtctctacaaaaagttttaaaaaaaattatctgggtgtggtggcacatgcctatagtccctagctactcaggaggctgaggtgggaagagagctagaacccaggagttaggggctgcagtgagctatgattgtgccactgcactccagcctgggtgacaaagagaggccctgtctcttaaaaaaaaacaaaaaaaaaaaaacaaaaagaaaaaatcattttgagaaagagcatttgtttgaacattgtaatatattttagtgtaataaaatagtccatcggtccgttcttagaagcaattgcttcattgatgggtaaggggtagtttcaaaaatgaagtttgagatcagcccctcttggttgcaaggaactgacacaccgttaggacaactgaagtaccaaggacatgttataggtagacacgcatagcaataagggaagtagactcttaaggaattccaatcatagtgcctagccgagtctcacagacactgaaaacagaatatgagcctgaggaacttcaagtccccggagtttgcacatcttttctctggcttggttgctgttgacctgcttggtgtgcatttctgttcttgtccacttctcctctccctccctgatatggtttggctgtgtccccactcaaatctcatcttgaattgtaactcccacaattcccatgtgtcgtgggaggaacctggtgggaggtgattgaattatgggggcaggtctttcctgtgctgttcttgtgataatgaatgagtctcacaagatttgatgctttcaaaaaatgggagtttgcctgcacaagctctctctttttgcctgctgccatccaagtaagatgtgacttgctcctccttgccttctgccgtgattgtgaggcttccccagccacgtggaactgtaagtccaattaaacctctttcttttgtaaattgcccagtctcgggtatgtgttttcagcagtgtgaaaacgaactaatacactccctattgtctttctcaattccattgcttctgctatggttggacatattcatgaccctattttatagcttctctttccgggcagactttcaggttgagatcctatggcttattgctcaaatctctttttagttcccaattaaaatttctgaaagaatcttatggccttagtctttttgggcaaagctttgttatctgactatatcatggctactgaccagcgtgtggggcaggtaccttttctctctgattatttcttggtgttggtaggaggattgaagaggtgccatatagttcaaaatatggtctttcctttggagacatttggaagtccagttcttctcagaaagggctgtgggaagtatggtggctcatgcctggaatcccagcactttgggaagtagtgatgggaggctcgcttgagcccaggagttcgagaccagcctgggcaatatagtgagaccttgtctctaccaaaagaaaaaaaaatgtgggggcagggggtatggagataggattaccatggcaggtatatccagcatatgttgatgtaaggattgttgatttttattcacagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtaagtatgatattttgccagtgttttcccacacactaaaattagttagaaaaataagataaaacataagttctgttatttttcttttaaaattccagtgaactctattctttttggatgaaaaatgtgagatattcgcctctcagtgtgcttctaagtatctgatttgttgttttgtgtgtttgcattccccaaattaaaaaacacataaaaccaaatcaccatggaaaataacaaaatatttcccatggctgaacttcgttcttatgaaattatgttgggtcattgtttattttgacaactttagcaacgtaacacactttagtcatacattttctaatgctatatgagaaatgccatctagtggccattgagaaaaatttaatagtacagattgaaatggtcactgctgaataaaaccagttaatttttttccagtttttctctagttttcatatagaacatttttaacatgtttgtttcataaatacctactctgttctagccagaagtatactttcagagtacagagcatcactgattaaaaattaaagcacatgatctaatgagagattgctgagaagtcttctctccaaaattgagttgctatgcaacacaaactaaagccagtcttctgtactgcattcagaaccctctgtgttattcttgggtgagacttatctgtggaactcagtgccaaaaaagcctcaagccacctccaggagacccttaacaagatgtgggagactgaaataagagggttcttgatggtgcttgtggtataaatatggaagtataattttatttaaattccaaaattaattcagccctaatgtgtgtattgcttctttgtagaaagtgtgttgacaattttatttgcaacatcaaatgatccccaatttaaagccaaattagaatccttcaataactactagcattctctgagacactgtgtaagccacttggtctttatgctatattgtgggcagggacaagagtcctgagttgattgagggcataagaaattaaagcaactggcaaagcctatcactaatattaaatgctaaaagcatgcttatgctgcaactagggaaacccaactgcctgcaagtagagtgaaataatttagctaatttgcacttgcccacacatttggcctctagcctagaggttggaaagcaagtttgctgtagaattcagactgagagctattgggttgtactcctgggccttgggccaggtcagacacacacacacacacacacacacacacacacacacacacacacgtatacacacacgtgtacacatacacgcctgctcttgctcattcactgtccaggatgagaatgaacccaaagtatgggccctatgatgtaatttgctatgtaataaagagctgagaggagcaggttatggttataacagatccctcttccacctaataagaatgtaaatttttttttttttgagatggagtctccctctgttggctaggctggagtgcagtggcatgatctcaggtcactgcaacctctgcctcccgggttcaagcaattcttgtgcctcagcctcccgagtagctggaactacaggtgcctgccaccatgcccagctaatttttgtatttttagtagagattgggttttgccatgttggctaggctggtcttgaactcctggcctcaggtgatccgcccgcatcggactcccaaagtgctgggattacagggcgtgagccaccatgtccagccagtatgtaaattttttaaagaaatgaaggtaccaggacaaactcagcctggatggattttctagaacaagtgggaacctagcaagggttcatttcctgtgcaactagtacgatgaagtcctcaaactgactctcttccaaactaggggagtttgatgaagatggaccaaggacaggcatgagcaactggagctccagctcttgacatgggtttgtggctgggtcaccatctccccagctgcagtagggatggtgattaaatttttggaatttaaataaaattatacttccataatcatactatagatactcagaggtatctaaccagagccctgttggggaaatagcctctttttttagaggtctgtgtaagccagcaggtagtagagttaacccaaaatctaagtgagcttgtcatagtcttatgctaaaagcttgtttttacaaaggtaatgcacatgataaatacatacaatggaatataattcaagcttaaaaaggaaagaaatcctgacacatgctacaacatgaatgaagcttagagatgttatgccaagtgaaacaaaccattcacataaggccaaatactgtaattccacttatgtgaaggtacctacagtagtaaaatttatgagagacagaaattaaaatgcttgttttcagggactgtggggagggagaaatgggaacttactgtttaatgagtatagagttttagttttgcaagataaagagttctgtggatggatggcggtgatggtagtacaataatgtgaatgtacttaatgccactgaaccatacacttaaaaatggctaagatggccaggcacggtggctcatgtctgcaatgccagcactttgggaggctgaggcgggaggattgcttgagccccggaggcacaggttgcagtgagccatgatcccgccactgcactccaccctgggtgacagagcaagaccgtgtctccaaaacaaatgaaataataataataataagaagaagtaattgaaaataatgaacagtaagaacagcctttatttttatttaaagtctcttagaccctgtcttcctccttcaccccctccctccatccattctgcagacattataaaagctaaaaactgcacattctgagtcccaaagaagcaacattctcatttgaaccagactgcctttcacttaaataacttatttgcttacatggggctcactaaactttgatttgaagtagcaatttttactttgttttccaatgacataaagaattacaaagaattcaagttgaagaaactttttagttgttttgtaaatggaacttcatacaagtgcttcgatcatctaggctatttgcaattaaaaattaaagtaggctaaatgtcactctctctccaggtcaataaagttcttcggaatcataacatcaagccgcactggatgtttgccttagacagtatcattcggaaggcggtacagacagccattaccatcctggttccaggtcagagatatttaattactctgcacatatttagtgcttggatattttagattactgttcatctgttatttctgatatcaccttagtactttaaaaaccataatacccttttttaaagaaatattttcaacatcaccaaatagtacatatagtctggataatggtacaccaagcaaaatatttactaagaatgaggaagacttgcttcccctgtctttaaggaatgtgtttagatgtgaagagaaaaagtatacaggtgactcagataaatacgcatttcaaaatatagatatctggaccacaaaacacattcctacatcttttacccagtggttcccaaatcttccaatgtattgagcaatttaaggaggtattgcatagctcgttgcattgagcaatttaattgtctttaaaattacagctttcaaagccccatctgaagccaaataagaatctgccaggaataaagcccaggaatctgatttttttttaaagactagtcttttagagcagtttaagattcacagcaaaattgagtggaagatacagagattttgcacataccccttagcctaacacatgcatagcctcctccattatcaaggtcccccacagagtggtatattggttacaatcagtgaatctacattgacacgttatcatcaccaagagtccatagttcacattagggttcagtcttggtgttgtacattctctaggaattctacatatataataacatgtatccaccattatagtatcataaagaatattttcacagccctgaacatcctgcttgttccatctgtaagaacttgattttaatacagctctcaggtcatgtcgatgagtagccaagtttggaaatcactggtctagacacagccccagctatgttggcagtgagatacaaaaggggtagtgttgatgaaacaaggctttttggcataagtgaggagtgtattcatactctaaggcaaaacctccaacgtgttttgatagtctacccattaataaaaaattgtaggcaaagctcttccaccctgtgtgtgtgttggggtggtgggtggatgcatggatgcatggatgagtatgtaggtaggtagaaagaaagagcagttgaccaattgttacatggatagatacagatttatatatatttatataaacaaattagaaacatgttctattgtactaatttgtacctatattatagagcattctgaaatataaatttaaaaggataagatcaatatgaaatattttcattttagttttcttttttttttttaagtagagatgaagtctcactctgttgcccaggctagtctcaaacccctgggctcaagctgtcctcccgcctcggcctcccaaagtgctgtgattacaggcgtgagctgctgcacctggccctgaaatatttttaaattaaaattatttataaatggtactacaaacttttaagttcaggccaacccttctgagttgtggaattccctctcttctcatagaacacttgggtgtttgacatgagagcgagagcatccgtgtcaatctttatgtcaaacattggtcaagattaagttatttcttatgtaagaaagaaacagaagttctgctatccctgaacatgttacttctacctggaacacacctccaccccatgtctctcctgtcctgtggcttgcacctttgcattcttcaggccaccgagagtctggacctatccccaaatctaaagtaggcttcctctgttattctctctccttggaaatggttttcacctatttgtgatgccacaatctgaaactacttttgtttctagtttaatggctgttaccctcaccagagggtaactgtttgtggtttattttattctgagcctagcatactgtccagcacagtgtctggaaaacagcggatccctgattcatatttggttgaaacaataagtaaatgagtttcacctgattataacaaattagggtggaaattttgcatggtgtagaaacttagaaaaaaattctagagagcctttgaagcacatgattagtagttggaatgtgaacctaagaaattcatgctctaaggaagtcaaacaatatttatattcagatactttatcattaggataaggctggttgtagggaatgtgctatagagaggttagatattcaaaagatctatgggatgaagggggaatagtgtatatcactgaaagggagaggtatgggccatgagttaaacacagtagcaacctaaattaaggacacctaaatgaagaaaggaaaaagagagtatattttgaaacaacttaaatagcatataaatgatctgtttacttaattaaaaaaaaacaaacttccttttagtaatgattacctaatgtaatgtggtatccagaatagaaaacgaacattagtgaaaaactgagaatctgagtgaaatctgcagtttagttaatagtttataccaatgttaatttaatcattctgaaaaacatgccatagttatgtaagatatattaggaagagctgtgtggatggtatacaggaattctttgtactatctttgcaatgtttccatgaatctaaaattcttccagaatagaaagtttaaaaagcaaaagtaactgtaggtgaaactctgttaggtttagggagaacagcagggaggttgcagagagggagctgtccttgcacgagtgtcccagggatggacactgctgtgatcaaccatgtgcagaacaaggcacattttttattaaaagtgtttgctaaagaaaggactttgttcttccaccatgaaattggtttctttgaggccactaggagtttctgatttcaactgaagttactgtttgaaaacatttatttttgaaaagtggaatttttagaagagaattacatagacagtactttttgtatttccctcaggataagataagtccatatacactgtataccaatatacaaatgatgaattatgtggacaaaatgaagtgatgtcagtcattcaacaactccatcaaattttcagatgtcctgaaagattttgttatgccattaagatataaagaaattacatgaaaaacagacggtcttcaaatgcccctgataaaaattcctttcagatgcaagatactatagttaacctgccatttcagaagacatgcgaaagaagaccacaaattttaaaaagtataccatcgctagtacaatatgcattgcttaatgacagggctatgttctgagacatgcgtccttaggcaattttgtcattctgcaaacatcctagagtggacttacacaaacctagatggcagagcctactagatgcgcaggccttatggtatggcctgttgctcccgggctacaaatttgtatggtgtgttactaaactgaatattgtaggcaattttaacacagtggtaagtgtttgtgtgtctgaacatacaaaaggtatagtaaaatatagtattacaatcttatgggaccactgtaatatatgcgatccatccttgactgaaatgttattataccgtacatgattgtacgttcatttcctagatctgtctactgagaagacccaaatcttggtttctaaatgccattcttcaataaaaggaattgggtttccttggagaagtggttgattccgggctgggggcaggggaaataaaagataagattgtagttgggcatggtgtctcacccctgtaatcctaaggcttcgtgaggccaaggcaagaggattgcttgaggccaggagtttgagaccagcctggccaaaatatcaagaccctgtctctaaaaaaataaaaataaattaggcagacatagtggtgcatgcccatagctacttgggaggctgaggtgggaggattgcttgagcccaggagatagaggctacagtgagctatgattgcactgctgtactccagcttgagcgacagagcgagaccccatgtcataaataaataaataaatacctggaacaccttgtgatgccagaaataagaaagtgtcaaaaaggatggagatttattgaaaggacactagagccaacctgaaaatgttccaaacagtccaagccagaacaatctgaacaataaaataatgatcatattggattatagattatagaataaaataagcatccgtgagtccatattaatataaataattgaataaataaatatatggacgagaaagatcacctttttgttatagtagaattgcgactgataaataaaaatgaatgaggaaaacagaaaatcaccagtaggcaaacaccacagtaataattattgcaggcaaggaccatcaatgactgctaaagtaggcaaaagaatgaggagaaacaggatatatgtggatggttttcaaactgtctccccacaagatatttactaactacaaggagaaaacagtaattttacagtgaaggaatgtggcagacaccccctcaaccaaatgatcaaggtaagcatcactagtaagaagacacatcagcatcatgtacctcctgataggatgccctgagaaggacacagcatcacactgtggtgttcttgccaaaaatgcacaacctcaacctaatcacaagaagacgtcagtgaacctcaaataaaagacattgtacaaaaacctgaccaatactcctcaaaagggtgaaggtcgtgagaaataaagaaatactagttacatactggaagagactaaggcgacatgacaactaattataatgagggatccttgatcagaaaaaggacattggtaggaaaactggtgaaattcaaataatgtccatagattagttaatagtattgtgtcaaagtcaggtgtggtgactcacatctataataccagcactttgggaggctgaggtgggaggattgcttgagcctaggagtttgagatcaccccaggcagtgtggcaaaaccgcatctctacatgaaaaatacaaaaataagtcaggcatggcagcatgtgcctgtggtcctggctactagggaggctgaggtgagaggatcaattgagcccaggaggtcaaggccacagtgagctgagattgcaccactgcactctggcctgggggacagagtgagaccctgtctcaaaaaaaaaaaaaaaaaatagtattgtatcaatgttaatttcctggttttgataatagtgccaaaggtatataaactgttaaggcaagagcaagtggctgaaggctatacaggaactctctgcactatttttgcaacttctctgttatcctaaaattatttcaaaataaaaagttaaaaaaaaagtgtttaggccgggcgcggtggctcacgcctataatcccagcactttgggaggccgaggcgggcggatcacgaggtcaggagatcaagaccatcctggctaacacagtgaaaccccatctctactaaagatacaaaaaattagccgggcgaggtagcgggcgcctgtagtcccagctacgtgggaggctgaggcaggagaatggcatgaaccccagggggtggagcctgcagtgagccgagatcgtgccactgcactccagcctgggtgaaagagcgagactccttctcaaaaaaaaaaaaaaaaaaaaaaagtgtttaatcttttttccaaaaggagcacacagaacagagagtacagtacaagtcccttaagaatttgttttttctcagactattttctcacttgtcatcaagaatcagcctttagattattggcagcattagtcctctagtacagtctgcttgtgggtgaccagatggagtaatgctgagcacagagactatgatggccgtgctaaggtaagagtattgataatgtaagcatacttcctctatcaacaataattgttaacagctgcttcaagcacttgatattaccactagttgttaactgaatcaagcatgtgctccaagttcacattaatgtgaattgaacagcattgtgtacgtacgaggagcttcatgcaagtgttatacactgcactcacaagtattatgatcttactaagcattagaaatactctgtgttaaagaagcttggtctaggccaagcgtggtggctcatgcctataatctcagcactttgggaggccaaggcaggcagatcacatgaggccaggaatttgagaccagcctggccaacatggtgaaaccccatctctactaaaaatacaaatattagccaggtatgatggcgcatgcctataatcctaactactcaggaggccgaagcagaagaatcacttgaacctgggaggcggaggttgcagtgagccaagatcatgccactgcactccagcctgggtgacagagtgagactctgtctcaaaaaaaaaaaaaagaaagaaaagaaaaagaaacttggtctagttattttccttcctctggggaagtaaccatttgggtgggaatagttttgttgttgatcccatcttgctggtttggaaacaatgcactggctccacttttccactcatgggctttaaggcccccttgagtcccagtctttctcctgacacatggctgtctcctgacagtcccctctgctttacattgttctcagagggtcctgggccatcgtttgagcttcattctttcaaatacacttccctctttctctatcaagccaaggctcccctcccccagaactctgcataggcccttcagcctccatgaatcccttagtgagtgagtaaactaccactggattcagtcactgcaaatgtactttatttaccccttagcactcttactacatgtatgtgttagggttcttcaaagaaacagaaccaataggatacatagagatatataagagaagatttataatgggaattggctcatgtgattatggaggctgagaagttctaccatataacatcagtaaactggagaaccaagaaagctggtggtataatcagtctgactccaaaggcctgagaaccaggggagccaactgaaattgaaggtctgagaaccaagagctctgatatccaagagcgggagaaggtggatgtcccagctcaagaagagagaaagagaattcaccctttctccatctttttgttctattcaggtcctcagtggactggatgatgcctgcccacattggagagggccatcttctttattaagtgcattgattcaaatgctaatctcttctggaaacaccctcacccctcacagacacatccaaaataatgttttaccagctatctggccatccttagcccagtcaagttgacatatataattaaccatctcagtgtacatgtgaattatatatataactaggtctatacctgagataatctgagatatttgtagctgtattaatttgtgcttataatttcatgttatatttcaatgtgctctcagcgctcttctgtgtatttgccctagttctcctttagattgtcatctctttgagaaaaagaaccagatgttctgtgtcatttgcatattttacaatgtttaatctgatgacatgcactcagggaaccaccatgaaagaccaaaataacaaagcactgcatgaacttacaagtttctactttctttaaattaattcagagaattttttacgtcatatatacatacgtaaaatgataatttaaagtttacagaattaagaggatatttaaatataataggattataaattttccttccctaaaagtgagattatagtcaacaggactacaaacctttcagtttagggctgggcatggtggctcacgcctgtaatcccagcactttgggaggccgaggcgggcagatcacctgaggtcaggagtttgagaccagcctgaccaatatggagaaaccccatctctacaaaaatacaaaattagccaggcatggtggcacatgcctgtaatcccagctactcggaaggctgaggcaggagaatcacttgaacccaggaggtggaggttgcagtgagccaagatcgtgccattgcactccagcctgggcaacaagagcaaaaccccgtcttaaaaaaaaaaatcagtttagaaatcatgaaataaattgaagaataattatagaaagttgtaaaaggtctaatcttgtcctctaatttaatctagaatcacactttcttaaattatttttaagttattttattgctttctaaatacaaataaccaaataaccctagtaggaatactcttccattctgccaacagtttttgaagacctaatacgtttagcccctgcaatcagcgctgggtttacaaaagtaaaacacatgattttgacttactcctaccgtactatcaataaattaagaaatgggattttggaataagagatgagatagagtagaggtgaagtttggttagccttaagagataaagcatgaggacatggagaaattggaatccttgtacactgttgttgggaatgtaaaatggtactgctactatggaaaacagtatgatggctcctcagaaattaaagatagaagaaagcacccttgtgaaccagcaatttctcttctgggtgtatattcaaaaaaactaaaagaaggatttcaaagagacatttgcacattcatattcatagcagtactagttacaattgccaagaggtggaagcaacccaagtatctagcaacagatgaatggataaacaaaatgtggtgtatacatataatggaatattattcagccttagaaaggaaggaaattctgacccatgctacaacatggatgaactttgagggcattatgctaagtaaaataagccagtcacaaaaagacaaatagtatatgattccataattttatggttttttcactcctgtagttcagcaagtgggagggagtggcacccagtggcttattctctcccattgttcgacaagtgggagggagtgttacagctgtattactcctgccgctgacagcttggcgagcaggagtgctacatccctttcactcccacagttcagtgagttctgggttcttgtcccgtgaccaagaagaataaggtacacggacattggagagtgagtaaagcagagtagaatctaattgagtgacagaaagaaagttctcagcattgagaggggacttgaaattgggtagccatctgtgatgctgagtctggggtttttatgggcttagaataggggggtgcatgctgattggtccatgggaggtcttggaaaaagcaccatttgattggttaaaagacatcattcagaaggaaccaattgagagagagtgggtaaaatggggatagatgttctcactctggttgtggactctctccagaattggcagcttgcttctcaggctttaaactgtccttggtttgaaggtcaggtttcactggagatcaatccctgtctgcctaggaatttatctgtctcctgtaactataaacgtgaggtgtctagagtagtcaaattcatagaaacagaaagtagaacggtagtttccagaaactgagaagagggagtaatggggagttgttgatgggcagagtttgagttttgcaaaatgaaaatattctggagattggtagcataacactgttagtatacttaacactactgaactgtgtactcagaaatggttaagatggtaaattttctgttatgcactttttaaaaccactatacagaattttaaaagagggataaagaaagccaggtctatgtaaactgggccttgaaaaaggacactctggtttttgttatgatcaaaagatgatgagttctctttagattgttgactttaaggtgcctaccgaacagtaatgtccaggatgttctagatgttacaggaccgggactagaggtgtagagtttgtcatccacacatctgaaatacttaaccttcgtggagttgaatgagctcatctatggagcaaaagtagaaacataaaaaagtgaaggatagaatcccaggttccagcttaaaagtgggcagttagtagataaaaaggctctgaagaagagaaatagcagccagagatttagaggaaaatactgtccacagatcaaatagggtaaatataaaaaggtacctagaggatttggctggcaggcctttggtgaccttgccaaagtgcccatatacgaatggtgggatggggtcctccattgctcccaatggactcccctcctgtacacacgggctcttaacctgtggttcatggactcgggagaggcttcagggaatctgtgcaaatatagcaaaatctaggtaaaacgaggaaatctaggcaaaatgttgcatgtatgtgttttcttctggggagagtttttatgactttcatcagatttttagtaggttccatgatccgataaatgttctatgtgccgaagcatatggagtgaaaattcaatatttctgctaccttgatttcacttaaattatgactgtaattcctttttgtggaccaagtttaaggatttaattacaatttgtaatattttttcttatgggaagatattgttgacaaaaaatagccaaactctgtaaaatatttagaagtttattctgagccaaatatgagtgactatgacctgtgacagagcttccggaggtcctgaaaacatgtacccagggcagttggggtatagcttggttgtatacttctagggagacagaagttacaggcaaagacataaagcaatatatgtaaggtagatgttcagcccagcaaggcaggacatctggcagggattgggaggtggggaagtggttggggtcccaggtcataggtagattcaaagattggcaattggttgaaagagttaagctttgactgaagagttgaagtcagcataaagaaatgcttgagttaagataagggctattgtggaagccaaggttcttattatgtagatgaagcccctaagtaacaagctacagagagaatagatggtaaaatctcttattggaccttaaaaagtgtgagactcttagttgaatctctcatggatcaggaaaagacctggaaagggaaggggattctctacagaatgcagatttcccccacaagtgatgactttgcaggaccgttccaaaatatgtcagagaaatatattttggggcaaaatactttgacttcctttatggcctgttgtttgtcatgggatgctatactagagtcaggttggaatttgttatcttattgctacaaagagtctgttttgtcagccttatgatctttattttaatggtaatgctggtcagttgtgcctaaactccaaagggaggaggtataaccaggaatatctgacctttcttcccataatggcctgaactagttttttcaggtttttttggggatccccttggcctgggggtaggtggttcttcagtcagttggggggcttagaattttatttttggtttacaatatcatccaagttttttttttttttttttttttttgagacagactcttgctctgttgcccaggttggagtacagtggcatgatctcggctcaccacaacctctgcctcctgggttcaagtgattctcctacctcagcctcccaagtagcgtgccaccatgtccggctaatttttgtatttttagtagagatggggtttcactatgttggccaggctggtctcaaactcctgacctcatgatatgcctgccttggcctcccaaagtgctgggattacaggcgtgagccactgtgcccagccacaatatcatccaagttctaaactgacatgcaggtgatctcatgttatatagtatgtttaagttggaaaattgtaacttctatggtttaaatttcaatggttagtcaacaggttagaggagaacacacactagaaatcggcccaatagtcaaagagagatagtcttactaatgtgagtatcagcctgcgtgtggcattttcagcacctgccctgtatccccttacattttggatgttacaggcagaaagcattctgcatattcacgtgtgtttatataatctctgtatagctcactttccttatctgtaagcaagttaatagttgtcagatattatgtaatctgaaaatgaactttacttgtataaacacttttaaatattcttaaaaggtttttacatctttacctttctttcagattcctagcattttccccacatatgtgcaatgtgactatgtattgatcattcttgaattaaatcattctgtttgaattagatcattctttccttctgtttgaattagatcatatcttgtgaattttgcaagttcaatagaagaacaaatctgagtctacagaaatccatcctcacttttggaaaagcagtttggaatatatatcttattgacggtggggcaggagggtagcattcatatcttaagaaattaaggcaatgagtcatattttataaacactaccactgatattatgccaaacagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaataggtaagtcctacactgacgtgggttggtttcttttcttttacttttactaaagagcatgtgtttttggtctacagaatatgattcccttatcccattcatggaaacttgattgaatgcctttctttataaaacaagagaagtttagtttagcctcttttgtcaaataccactttctgcctctaccagtttaagcctttttcagcggcatttgattacttcttcatctccaggtgccctaagatttttccaatagcttcgttgtagcctcatagactgtctaagaaacaggctcagagcagcatgtaccttccagtagatagctgaaaagaacagaaagctcatgtttttgaaagcccagtcaagtctttataggagaggaagatcactgaggtcgagggaacaaaactaattaatggtgctaaagatttgtattttagaacctaaaaaggaagataattgaccacatttatgattctattttatttttgatatgctgtaacatatctggagtataatttgcctttgataatttgctagcatagaacccacaggatcagattattaacagcaaatgtttcctgttctttgcagatgttgttggtacagttcaaggtctgaatttttatgatttatagcttcctgtgctgcctacagttgacatgtgggaaactgactttatgactctgggtttgcattaaaaacttttttttaagcgaatcaataaaagttgttcaaatatttagaaaccttaattgaaaatgctagttattcaccagggagattaaaaatatcttatttccagtcataaagtttaggtttttaaaggcaagcttgtataccaaaatgagtacaagtggtaaaagctcatcctatattcagaaacatgaaatttggttgcattgttaagtaaatccatatagacacatcttctatgatgtgcatagagcagtcttattttaataaagggagattgcctctctgactttcatatcccaattttgtcctctgaaacccagctcttgccatctctactatttagtgggaaagaacttgggtcttttctcttctgagacttcatggaaatcttggtttccctcattcctcctcttctcaagcaagagtccaaggataacaccccatcgttatggaaggtgtccatgttagtcacttatctctaggttactctctgttgcccagtcctgagtggtggtgttttttggactcctgctgtgatctctggaggaggaaagttcactcattactgttttggttgacctcctcccacccatgccttctggttagaattacgcagatagtaaaactactttgtttaccaaagagctggtatatctgcttttctggccctgaaacctcctgtctacacacctggctgtgtcaataggacctgcctctcctaatgcagcctagacacaagtccttttccttctctccttggcctatttggttagcgttgtgctcgccaccctggcgccactgtctgtctaccatgcttgggccatctgcagtccctgagggcttccggccgctttcttcacagcttcccctttctcttctgagtgtctcttggttctagctgagggcctgcttctcacatctgcccatctctgttgaaaagactagtatttacccacatttctttattacattagtatgtcacaacaacccacacatttacgctttttcctctgcatatttacatttgagtctgtgaaatctacagataatcagcctcgtttttcctttttcagtaatatctcccacggctttccatcacccacagaaaagtgagatgagggacgatgtttgcttcatgcatgatttgaagaaaggacagctgctttagtacaaaaaccaagtaattgaaataagggaccagtcctgtccatattggtccttctaattttcagttgaatattacctgaaatataaaggcatacctaccgcaaaatgaatctagaggaaatgttagtgtgttttcaggaaaggttgtagctctcatattaaaaattgtaagcttagaatatttaggatgatcactgatgaagggaaatcaggtttatcctgcttggaggatcacctgagcccaagaggttgaggctacagtgagccatgattgcaccattgcactccagcctgggtgacagagcaagaccctatctcaaaaacaaaaacaaaaacctgtctcaagaggagctgcctgtttatttaatttccccatcctacagttctggaattacccaccaatccacctcatcacccctgcccatccaaggttaaaaattgacctcatggcagatcctgccatacttttttggaacagaaaggcagacagttgccttgatttcaaaatattgccctgctaaataaacacaaaataaaaataaaattgatgtactggattgttcttaagataaatacttctaagagctggattcggagcaaatgaggtgggctgtcaatactctgcttccagtgttgaagttctggtgtttaaggtgttaaaagaaagcttcagacaaattaaatttaatggagtttaattgaaaaagaaaaaaatagtttgtgaatcaggtggcctctagaatcacagcagattcagagagattccagggatgcctcgtggccagaacaaatttatagaaaataaaagtaaagtgacgtacagaaatcagaagtgtgcagaaagagctggatttgttatgggttggcgttcaccttatttgaacactcagcagtgtatgagtggttgaagtatggctcctgggattagccaagactcagctattgttatagacgcatactcctaagttaggttttcaatcttgtctacctgttaagttatagtttgtccacgaggactcaaatatgcaagtacggagtccttctcaggccatatttcattcactttaacaaaagataaaaagaaattacatagtctagacaaacataggttaaactctagaaaacatcactgtgttccttgagaaaacagtaagaagataccatcactgtcttatacgtataaattagcaagtaggacaaaaatacataccagatcaaaaaactgccaacttaaacattcacacagagcttcctgcccatttctttggataatatttgttttgaaagagataagaagcctccctccaagaccctgtgctccctcttctagctttcagttcatgctgcttcatccacctcattgtgcaccacacttaccctgcagctgtctttgttaacttattttcctccacccaccttctctgtctacctcttattgtgttttacttttgtcccacctctgctacctactctgctgtgatcccttctctctgaggatctcatctttatgtcctgtgggaatggggtcgagcctgggggtctgggaaggtttccttcccactgagtcctggaaaggctcttttccagggactgaggtagcaaggaacagaacatcccttattaaagaccagacactgacttggcactgtacctatgctgtctcatttaatgctcacaataatcttttctggaagctttagttttcttttttacaaatgatttgaaaactgaagcctggaggcattaggtaatttatctaaggttaacacaggaagtgcagggttgaaccaggacacaagcccagatctgtcagttgcacgatgctgccttcagattatgtcaagtgaagcagaaacaaactcttgagttaaatctatcaatactcagaaaatgaaacaaatagagtttgttaagagctgtagtttatgcaacgatttatcctgataatcttaataacgatatattttaaattattatttctgaatccaacttacattaagatacttttctaaaaaattagagcacctcttttcataacttggaatgttttctttgagaaattctattggaaatggtgagtaggttaccagttggctctcagttgcatagtgaaccttctatgggtaagaactttggtatgaatatcacagtttctccttgtttctttggagactgcatcagatgccaactaggaactgaatgtaccaggaacacagctatccttttacccacttcacccccgcccccttagaaggaagaggaataatagtaacaatcacaattgtagcaacaaccgtgaacatttactgagaatttgttatatgccagatattctaggcgacctcacctatgactgtttctcaaattttcatagtttacaaaaagtgattacttttctgatttgcattgattatgaaattatgcacatttgccaactttttttaatgggggtccatacatgtaaaatataggcctgttaatatctgtatcccatatttatatctttgacatttatggtcataacaagaaatatcaggacacatctctgaagattttggcagacaatctgtggtggaggttttgaattcttgtcggcaagcacagtcttccaaagcttagcttctggacctgagggtctgtgaacctgcaacatcagtgtcatctgggagctcattataaatacagtctcagaactcacccccggggcactggaccagtatctgtatttcaataaaattaggggtgtatgtgcttattatagctcatgtctagaaggtcatcctaggcctggcacagtggcacatgcacacacctataatcccagagctttgagaggctgaggtggaaagaccactggaggccaggagttcagagaccagcttggacaacatagcaagactctgtctctacaaaaaaaaaaaaaaaaaaaattagccaggcatggtggtgcatgtctgtattcccagctgcttggaaaactgagatgggaggatcgcttgagtccaagagtttaaggatgcagtgagctataattgggccactacactcagcctaggcaacagagagagaccttgtatctaaaaaaataaaaataaaaaaaagaaggtcaccctgtgtcacctcctgtcaaacaatatatttttcttctgcagattactggaagaattggttcggaaagagaaagaattacaagcactccttcatcgagctattgaagaaaaagaccaagaaattaaacacctgaagcttaagtcccaacccataggtgaatagcagaaagttttatagtaatactgttcagccaggctgccacaaaaagccaagaaagccaacaggaagttttatttgtggctaagtcagcatttctcacttctaccatgactgcaagcaggaattcctttaaaaaaaaaaaatccagtttttaactgtagcaaactcatttcttataagtgcagtaaaaatagattattcataatcatcttttcctgagattatgtattactgaggtaaacagggctctctgtttttagtctttatttttaaagatttcacaatgagcttactagaataaataatactattttttgtcattttgcatttatattctgtgtattctagcctttttccttataatttgaagaggcttaaatagaataaagatgtagtagtaaaaaggcatagctggggagaatgttatttagcccatttagaggaaaacagaattcatagttatttgtttagatatgtggctctttcatagtggaaaaagagattatgataattatatagttctctgctaattgtattcatctttattgcatgaaaaacacaaagtctaattttggtgcacagagtttattctaagaaaccataaaattgatatgaaagtgtaacgtaggagtgtcatttcattattgcttttgctccttatttactagtaaattcacttctctgagttttattcatattatcatctatactgccaatctcaattgtttctatgaactgttctctgatagagcaaaatcttttaaagtatcaataaatgtctgttgattgtgagggtctcagatgacctctgttaggtgaaattaagaatatcttcccaaaattctgttctagaaattcctgaattgcctgtatttcatctaaattcttctggcacaaatactgaagattctgaacttaccgactggctgagagtgaatggagctgatgaagacactataagccgggtaaagaaaactgtctgtgggacaagtattctttcacttcgtttcataatgttgggtgcctgctatgtgacaggcacaggggatacactggtgagcaaatcagacccagccctgccctcctgaggcttacagaccagggtaggcacgtgataatcagctaactccacagatacaaatgtgattctacactggtaaattctatgaagaaaaaggtatcaggtgtttattagatagggcgagagaggttggggaaggttgttggagaagggaatgaaagagctgaaggctaacagaatgtgagggtataaataggccaattgtatgtatgttcaggaggggtgtgggagggagaccagggaagaaccttgtgcagtggggctgcagtgtgtacaatccaacgaggcaggcaaaagctctgtggtcctgagccccttaggaattttatgtatttgaaatgaaaaccagaaagagtgggaaaaaaataaagacaggactaaaagaaaaaatttcttgtttctaattctttgtatgttaatttttattttattttattttattttattttattttattttattttatatttttttggagacaaggtctcgctctgttaccctggctggagggcagtgatcatagctccctgcagccttgacctgctgggctcaagtgatcctcccaccttagcctcctgaatagttgggactacagacatgaaccatcatacccagctaattaaaaaaaaaatttagagatagggtctcgctatgttgcccaggctggtcttaaactcctggccccaagcgattctctcacctcagcctctcagagtactggggctacaggcatgaaccaccacgccaggcctgtttgttaaatttttaattctttttcaacattattagattccactgggcagcagctattttattgctacttaataaaatcaatctggtcgacttatttcagaaatattttctatacaaaccatattttacctgtaataatctaattcctctctgctctgtatagactttttttgattttgttttttgagacacaatctcactctgtcgcccaggctgcaatgctgtggtgcgatctcagctcactgcaatctttgcctgccaggctcgagagattccctgcctcagcctctcaagtagctgggattacaggcatatgccactaagcctggctaatttttgtacttttagtagaaacagggtttcaccatattggccagggtggtctcgaaccctggcctcaagtgatctgcccacctcagcctcccaaagtgctgagattacaagtgtgagccactgcgcccagcccctatagacttttgtaatgagcgtgaatagcatttgtttatgttcattatatgaacacacaggcatacattaaaacattgtaatatttgatagaaagaccctcttaatacaatattgttttgttttatatttaaattttaaaaataaataagaataaagatatctcttcttttgacttgataatttattaactaagtagaatttcgggccgccttagaaatctacatttaacaagttacagctgaataaatttaaacaactccagaatatacattcctctaacttaggctcaaatcctaattaaggaatagtaattgataatctactaaataatcaccctttttatttggtttaaaagtaaaagcttgaggccaggtgcagtggctcctgcctgtaatcccaatactttgggaagcataggcagattgcttgaggccacgtgttggagattaggctggtcaatatagtgagactgtctctatatataaaaaaataaataaaatttaaaaatataaaggtgcagtttaaattaagactctgcttttatggtgaattacagtcaagtgcctttgcttaaccatgaaaaaataagttcagaaattaagcataggcagtacctttccaggaacactttttatccacttgaggaaaaacaaagctatgtagcattgaacttctaaatacaagatttgcttttgaacagcagagtgattacaagtgagtctcatctgttcattagaagaccattcagaagttctgtgtcacttgtaatctttttgcatttggaagttaatatggatgcatttcttgtttttgtttttgtttttgtttttgtttttgtttttttgagacggagtctcactctgtcgcccaggctggagtgcagtgggtcaatctcagctcactgcaacctctgcctcccgggttcaagcgattctcctgcctcagcctcccaagtagctgggattacaggcatacgccaccacgcccagctaattttttgtatttttagtagagatggggtttcaccactttggccaggctggtctcgaactcctgacctcagatgatccgcctgcctcagcctcctaaagtgctagggttacaggcgtgagccactgcgcccggcctggatgcatttctttgtatttattgagtaacagggaggcctttcccctaataatcctggaagattgtgtttttagtagatttcatttttagattcatttttaattatagtcaaggtttacattatgaatagagtttgtgctttattaaagttatataaaacatcttttgtgcatattctactttctctacagtttttggctgaagattatacactattggatgttctctactatgttacacgtgatgacttaaaatgcttgagactaaggtaccacttttctttctgttgtcactatggaaagagcaccaggcaaatatcaaaaagtctgagtatcttcccaggctgggtctctaattagctttgtagttctggacagagctctctagctcttagctgctctgagtaaactgagttagttggacaatgatatttttgagggctctaataaccaatatttctatattagtaagtgaaaatcaactggaagaatttttttgaataagatgcagactaagtccatgcagatattctgaagctgccttaaacaaatgctttaattgagttcatgatggtgttatactcaataaatatttggaggaggtgctgacttgccctccaaaaacctggtataatctgatataatttcttgttaattaaggccaagcatataactttttttttttttttcgggatggagtctcactctgtcacccaggctggagtgcagtggcgtgatctcagctcactgcaagctccgcctcccaggttcacgccgttctcctgcctcagcctcccaagtagctgggactataggcgcccaccaccacgcccagctaatttttttgtatttttagtagagacggggtttcactgtgttagccaggatggtctcgatctcctgaccacgtgatctgcctgcctcggccttctaaagtgctgggattacaggcatgcgccaccgcgcccagcccaagcataaaactattatacccaccattataaagacaaatttcaaaaatgctgaaactctaaaatgatgttttgggacatagcagtttgtgggagtgaaaagggaaggaatggagggaagatgagaaaaaatatacaaaaagaatacataataactgatcagactttgggatcttcttctgaccagagcagatgaaagctaagaagtcacttttctatttcaagggcaatgtttcaaatgaaatgttcgtttcaccatgttcttgtgtctttaaacaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacatactgttttgataaattctaaagaatttttattttgtgttgacaaactagataatctgctgtgttaaatttccagtcatttctccagctgtaacattaagtaaaatctgtcttctattcaagcagtcagacaactgacattcaggttgttcctcagaggaacagaggtttaagaaagagggtaagcctgggcaacaaagtgagaccccacctctacaaaaactcaaaaattcagctaggcatggtggtgtacacctgtggtcctagctacatgggaggctgaggcaagaggatcgcttgagcccgggaggtcgagattgcggtgagccatgattgtgccattgcactccagcttgggcaacagagtaagaccctgtctcaccaaaaaaaaagaaaaaaaaaaaaagaggatgaagaaaaaaaagaataaaggaaagtcagtatatttttctcaaggccccaagttatcttggataactatggtatatcttaaggggtctgcaaagaccatcttaatggagaatactgcttgctttttttttttttttttttgaacagagtcttgctctgttgctcaggctggagtgcagtggcgtgatctcagcttactgcattctccacctcccgggttcaagtgattctcacacctcagcctcctgagtagctgggattataggtgtgtaccaccacacccagctaatttatatttgtagtagagatggggtttcgccatgttgggcaggctggtctcgaactcctgccctcaagtgatccgtcctccttagcctcctaaagtgctgggatcacaggggtgagctactatgcctggccaagaatactgtatttttctgtctccttaattttcttatatttggataaacatttttatttattttaagctgagtagtatatttttatgagcctgcccatattgatcaaaggaagtctgatgctcctagatggataaatgaaatacattttcttaaatacagaggaacctgtttattaggcaggataaaaataacatagagctgtttgtatatcatgatttcactcataaacaacagtctttgacaaagcagaagacatctttattttgaaaacattctcactaatgttttctgattgattgatcgagacaggttctcactctgttgcctagactggaatgcagtggtacgatcacagctcattgcagccttgtccccttaggctcaagcaatcctgtcatgtcagcctacagagtagctgggactacagaggcacaccaccacaaccagctaatttttaaatttttagtagaggtgggatctcactgtgttatctaggctggtcttgaactcctggcctcaagtgatcctcctgccttggccttccaaagtgctgggcttataggtgtgaaccactgcttctggcctcttttttaacatcctaatttggaggacagagttgcctctggtatcctgtgtggatattctgaaataagtgaggtataaattcaatgatatgccatttggctcatactgaaacacagagtaagccgtttattaagccacagttcatcttctcaattctaatggtgaagtgcttcttttgactgtatataggatccagctacccaccataaaccaaatcttcaaggatacaatctttccttggtaccttcctcttaccctgtctttgtgagcagatgatcctctgtccctacagggttctaacacactcccaggccaacatcattagccatttgtgagaattttgggtctcaggcacaaaagaagacagttccattatggaagactccattatggaaaggtttgcatttgaaacgcttttaggatcaatctaggccagtgattctcaactcagcttcgcattaaaatgacttggatgctttttcaaaaatattgatgccaccaccttgggacaactgagttgttgttgttatttgttttttcttgggacagagtctctgtcacccaggctagaatgcagtggcactgtcatagctcactgcattcttgacctcctgggctcaagtagtcctcccacctcagcatcccaagtagctgggactacaggcatgcaccaccatgtctggctaatttttaaattttttgtagagacaaggtcttactatgttcagctcactctggtctcgaacttttaggctcaagtgatcatcctgcctcaacctcccaaagtgttgggattacaggcatgagccactgtgtccagccggaaaactgtttttactggtctggggttgggcccagataccctttttaaaaattagtttcacaggtgttttaacatgatcaagcttcacctccttatttcaggtaacagctagagagggaaatggagagcccctttctatagagggaatagcaagatggttaacgttcatcatttgtttagcgtagcaggaggctacacacccaggcctgaagcaaaactgtaacttgacttgtgacctggaacaactgaattagtttctccaagtctcagcttcctcatctgtgaaatggaggaaatgatgtaccttccacataggtctgctataagatgtaaataagaaaatggaggctgggcgcagtggcttgtgcctgtaatcccagcactttgggaggccgaggtgggtgaatcacttgaggccaggagttcaagatcagcctggcctacacagcaaaaccctgtctctactaaaattacaaaaactagccaggcgtggtggcgcacgcctataatcccatctactcgggcggctgaggtacgagaattgcttgaacccaggaggtgaatgttgcagtgagccgagatcacgccattgcaatccagcctgggcgacagagcaagactctgtctcaaaaaggaaaagacaatgcaggagaggtgctcagcacaatgcttagcatacagtaaacactgagatatgcttgctattgccatcacttatccttcattcaaaagtatttattaaatactgggtactacatattgtggtgcaccaacaagatacagttctttcccctgaagtttcttgtcaaggaatcaagacaaagcagaaacaacagtggtgcagtcagtgctatagttacatttactgtcagaaggggtcaaggaaagctttccagaggagtgaaggtgcagagctgagcctggaaagatggtttgaaacagaacagttaatgcaggggtggtggcagtgttataaaagaaacaaaacaggaatttgctgggagaagtagatctaatgtttccttttaactgcattttgatctctttcttctgtcattggatacttggtttcgttcatccctaggccaccacataaaaaagcttggcattgaggaattattaacccatttgaatgcccactgtgtgtgaggcacggtagcaacacaaaagatatataccatgcctaccaagttcagaatgcaggcagtgcacatgatgtcatcaagaacatctgcaactcgtgaacaaataaaataactgatagttctagactttatggacaccctgtagagaagtagaggacaaagaccctactaccaaaaatgtgcatcagattgagaaggcaaatttgcaataactcatgcctagtctattttaacagctggacaagtatcaagcccagcaagccctggccaggtccaaaggacaggcatgctgggagccagggcaggaagaacaggcttcatggaggaagtagaccttaacctgggcctcaaagggaaagtattattaaatacgtcaggatgaaggacatcacttcgggcagagcagcttcaagcacaaagactagaaagcagggatttggaaggtgttctggagaatgaacaactccatgggctagaaatatgagttacagaggtgaaaagtggaaatgggtagtagagagctcagggcccaattagggggtggtggtggtgatggtgaggaggtgaagttaatatttacttatataggaacggggaatctattaaaggtttttgagcaagggagaggtatgtgtaaagtgattgtatattgcaagattaatgtggtttggaacatattaaattaacagcagggtatcttgatagaattgtgcagggaccattcagaatgtattagtggaagtcaggagtgaggttaagggtatatattctggagttgggagtcaccaggatccgggatggaagtaatagtaaatgagggctgtgagagacagtaaagataaaaagcctgtggtttacaattaggggatggtaaaaatattggaggattagaagggaggaagaatctgagtcaacaaagacgaaaggactgctacagaggaaggagaaaaaccaagccaatggtagaccaagagcaaggtgattagaggatcaagtgctgcagaaactctaggggaatgatggatttaaaaataagtaatttgatttgtatacataagcaagaaaaactattaatatatagctttttttgaaaaataacggcaccaaaatccacatttatttttattacctttggtgaacaaaacatacgacaatagattctggagggtgggacgttaaaggaagacattttaagaatcaaagagtcttagctgtgtttattggggtagagcccttgggtgcagaaacatttagggattcgggagaaaaaagggatgatgtttgaaggaggcaggagggaagtggacggtgtcaggaggttcagctcctcccctggaatggggaaccctgaagatttgaaatggatgtgggagctccagacagatggcttccatgttccaagtaaagtacaacttgaagtacgacgtgatggtgtttgacatttaacagatgtcatctgttctctgcagagtcactcagcagcctcccctgttgcagacacctccttaggtttggaacacactgtctatacagggcctaagtgcaggattttggtgtgttccttatttcatttatttttgtttaacttgtggcagataaatacaggttatcaaaagaatgggacaatgagtaagcacacaccaaactaaacaaaacaaaacaaatagaaacatcacaagtcttgaattttttttttttttttttttttttttttttttttttttttttttggtcaaagaaagaactcattggttgatttaagtcggtggtaaatcagaaagttgaaaataaatcaccctccttctccagggttcttccggatagttcaactctaaattcagctgagagtatttctgatgctcaaagaaaagtgtcttaaactctgatgttttaatgtagttaaaaaaaacacaaaaaatctttgctgaggcccaagctgaggtcaaaaactacctctagccatctggtgctttatttttattgattagaagtctctgataagactgatttgaatgtgatttaggaatatcacattctaaatggtcagtttgcctattccattatagaaatgacactacgggaaaattcatcatcacagaccacagcagaagtgttctttagttaaagctctacctagtcatccagaaagccagtaagtaaaccaaataaaaatagttcactgggctcagagtggcaagttttgcatgcaaagatcgtgaaaattgtaaccctaacaataaatccaatactgttctcgactctcttgtgtgtccagtgctgctgcagtccttggaaggcttttaaactgttcagagcttgctggttatcttcagccaagccagagagtgggagtgcagtgcattttagtgtaaccatgcggaactggtcgctccttgattttgtgccgtatgtttccatttgtgtaggctttttcccccctcagtattttgttgcttatcctttagagcgaaattggtttttcctcggccaataatctgtttctttaaaaaaagaaaaattcgttacctattgcctttttttctggtcttcctgagcaagccagaagtcacaaggtcgtttactaaacggaaactaagaaaaagaaaagccacatcagccggcacaagcctctctaacttgtgtgccctgaggctcatcagatgcgaagtcctggcgacaagatagggtcgcccgcagtggcttcctaaagcgcagatccaggccggctcccagcgtggaatccgacccatgtacttcgcctctccacgtggcatcagatgctctgccggctgtcaccgtgaactccagccctcgcggagccgacactgacctggctacttcagagttcggagggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacaggtgaccgcacagcggggatagtgggggtcccgtcgggcaggggacggcgagcggggccggcgggctggcaccgaaatcacccggcgccggcagccccctccccgcccgcgcggccgcggcccggaacaaccggccctgcgcgccgcgcaccctgctccgagagcgccttcccccgcccttcgccgccgcggctcggccagcccggctcggccccggccggggttgcggccgccctcgggcgctccaccgcgactttcccgcaacaggtggaggcgagccgggggaggaaacggagagaccccggccgctgccctccccgccgcggcctcgggtctaattcagttgaatgggaaatcgtatcccccagaccaaaccagtggccagagagtcgtcggccaggtgcgactggcaggacgagcagtttctgggcacctcctcccgccttccctggtcgccccgggtgccgggggctcctcagcggggtcggtgtggggcaggaccgcggggtgagcggcccgccccccaatctggtgcccgcagtggcgacgaccgtcgtccgaggggaccgagctcgggagggccggggcccagtgcagcacggtgggggtttgcgagtgcgggcttgacgggatcagactttcgttgacttgtcggagttctcagagttttttgtttttagtctgtgcaggagcccaaaggaggattgttggctctgcagcccgggatttggtggtcaggcctctgtgttgaggatacccctcccccacaacctccaggggcacacttagggacaggggatcacgtccccaagaccagcagcaaggcttcccaagaccagcagcaaggcttcccaaccccgcccatctctccatagtatgaagccgatttttctccctcgtgatttttttttctccagaggctatcttgcaaatccgtccctctccactggttccctcttctattcttggccagtaagctgtttctatatcttcctacacttggggatgggggcagtgaggcagtttcttactttaaaaagaaattcaattcttagactctccaattgcaagctgttttccacttccatacggtcacaatcggaagcatttgtttcctaaatgtaagaatcactgtctccccaccatcaagtatgcttattttaacgtgaaaggtccagagagctctgaaacagtatttgcaaattatgtatctgctattgctaggaagaggttgggtacgtaaagtctaatgatttaatcccttcagccaagatacctgaggttaagactgacaaagtatcttgaacttgtttaagtcatgctccttcctgtagggagtttgtcttaatgtgttcgcaagattggtagatcattattttgttttggggtggagaagagatgcctttgtaattgctttcgggaatttgatgagctagacgctgggacggggctcccccaagtgagggccccgggagaggagcatcctcatttgtaaatatacggcatgattttcgttcctaaccctgacccagtaactgcatgtgaaacaacattgttctagcgagctaagtgttagtttgtgctcaaaaataaactttctagaatctgcacgtgaacaacttgttcagacataagtgaactgactacaaactgtaggatattcagtgcctgagcatgttaaggaataggccgtgcttccaacaattaatatacaaatcaaccatgtgcctgtcagtgtaatattttcttttattaaaaagggagttaaattggctgttatctccttcatagaaaacatttcttccacacttttgcctaaaaacttcattttccaaaggacattttttatatatggtcttgaataattatactttataatttcactgaaaacttaattctggccccgcatctctttcctatttttctaccccaagattactattaatgtttttagtgttcagaagcatttgtgtcagcaggtgccaaagaaagaaggaaggtgtaaatgtatttttttgaatctaggtggtagttattttgagagaacaagtgagattgtttgaatttcaacaacttaagttattccatatatttaaaacacatgacctatatctgaatatgagactttaatttagcacttcattctggtgaacatatttcacattatacacatccaaatactgcaagtctcatttttttaaacaatcagaagtttgtatggaattgttgggggggtgggggggggtggtggtggtgggtggccgtggacagagaaactattaccatcaagagttgaaaattgccaccttaaatggcaacatttcttgagggattaattttatttctttttagaactcattattatgaggtagagtccactcttaaataactcttagtttttgggtctctatacaaagactggtctaattttagggcactttagatgagaatatcaggttattataaaaatgatacctgtaatgtgttcagaattatatgtgtgagtgtgtgtgtgtgtatatgtgtatcaaagatgaattgacagtggtggcgtgtggcctatgaaatgagaccgttc

SEQ ID NO: 1673 - DNA, 3516 bp, Homo sapiens
atgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgcagaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttga

SEQ ID NO: 1674 - protein, 1171 aa, Homo sapiens
MCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNAEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 1675 - DNA, 27953 bp, Mus musculus
  misc_feature (1)...(27953): n = A,T,C or G
gtggggaagggcaaaggctacacatcattggctggggccagagtgctggggatacctcatttgcatgaggaggaatcccaggtgctgctggacatgaccttacaagggggaagcatagtttgacccagctaccagctacgtgacctcctctggtgaggcaagggtggagggtacagggttatgtgcactgagacttgcaggcacagggcagcgggggagtgatcctactcctgcagatctcaaggtttccttggtttggacccgaccctactcttgcttcaggcctgctcctcctagtccctcctagtcccaaggctccctggcccctcagagaatgagtagaatactacagttagtaaccttgtatagtactggggagatggctcctttggtaaagtgtctacacttgcatgctccggactggccagcaagaacgacacttgcaacagaatccttctgcacacgtttattgggagagcttgattgcagaggcgaagagaccccgagcccagaactgatgctgcttatataggcctaggaaaggcgtatctcatacccggattggttatgtactaagcctcatttgcatgttcctcatctgattggctactctctctctctctctctctctctctctctctctgtacctcacagagcctcattatcatacctcatttgcatgtctcacatctgattggttatactctcaaagcctcattatcatgcccgggccccgcagtgtctttgcaaaaaactttactgcatatgtacacattggttgtttgtccaaacttatgcgtggtggccagcagtagtcagcgccactctgcaacggcacatgtggcttcccacagtctaccatgcaagcatgaagactcaggctcatacagtggaggatgagcaaggagaggcctggagtgacagcaagtctagcccaattggggagtgccaggttcagtaagagacagtgggtggaatgggtgcgtgcgtgtatgtgagtgtgcgtgtgcatgtgtgtgttcaaagataatacctggcattgatcactggtcattatacacgcacacccctttgtaccccattccccagactccgtagttgtgagagctggcattttccaagccacagttagagcaagcatgtgggaattttgtgtcagagagccagcagaggtgtagtacatagctggcaaatgagggaaaactgagatgaaaaccagggagccagacaaacgcacctagagggatcttgatgggtggggcctacagctttacccaccacctcctctccaacctcatctaggcttttcattgtctttgcaacagtgtgctccccagtgccaggtaggtgcacaagaccttatggtgaacagggagcgctaatggatgtggctgtgtcttagggagggagggagggagggaggcaggtgtaggctggtgagtgcactgtagctcacacaggttccaggaagggagtgtcaagccttatcatgatcagctgacctcttcttgctggtgtgaaatcagaatttaggctggaggatggaccttgtaggtagatgagtattgcgggagagttgaactggtagagagagtcaggtggttgacaaagtggttagagcacaaggggagaggaccggatgtcagggaggcaggcagcaacagatagatcaccacaagttttattagctgcagacttcatcccaagggcacggggaagccatcagtgctaggagcaagggagtggcattcaagctgtgtcaagaaggcattagtgaacttgatgtatcccacagtcttataaaagatttattttatttttatttttgtgtctgtgtatatgtgcacatcagtgcagtgcctgtagaggccagtaaaaggcgtcaaatcccctagagctggaggtacaggtgagcctcccgatgtaagagctggggagcaaagtttgtcctgtgcaagagcaatctctctcagcaggcccctattctgtggtctagtgtgtaaagtgtatagaaaccatttatgtgtgaagtctctaggcaaggtagacagaaggtagactagttgtccagaggtggcatggagggacaatggggagtgacagtggaggatactgggaggtggtggatgccgagagatggaggatgctgggaggtggaggatgctgagagatggaggatgctgggaggtggaggatgccgagagatggaggatgctgggaggtggaagatgctgagaaatggaggatgctgggaggtggaggatgctgggaggtggaggatgctgggaagtggaggatgccgagagatggaggatgctgggaggtggaggatgccgagagatggaggatgctgggaggtggaggatgctgggaggtggaggatgctgggaggtggaggatgctgggaggtggaggatgccgagagatggaggatgctgggaggtggaggatgctgggaggtggaggatgctgagagatggaggatgctgggaggtggaggatgctgagagacagaggatgctgggaggtggaggatgctgagagacagaggatgctgagagacagaggatgctgggaggtggaagatgggtcctactgcagtgtgctgaatctgcttgggtggcacaggctgggtgtgagaggctgcacctttgcagtcagtttctctatgaaaatgttcagctaggtcagtatccagcagatcagaaacctcagtgcaggtagatccttgagtgtcctgtgttgtggacaacagggttcctgagctgaggtgtttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgttccctgtagaagtgaagataacctggtaggtttacctgtctctcagtaagcattcattcttagatctgtagggctcctgtctccttggagtttccaacccattgttcagacctgatgtctggtcctggtgccctttcttcagagtagctgaaatcagcagcctctcaggggacgggatagagcagagctatatctggaatcctgtgaggatgttggcatactgtatgcttactgatctacaggtgaggtgccgggagacaggatgtccctcacttagataacatgtggccttcagcctagatggcaaatcaggttcattctgagttaaccatggacacaggaatgctctcgttaggaaggtggatatgcataggccctgactgtacacagcagtcaaaactcatcaaactatagatcgaatattgacagattttatggtgtgcaaattacccttcagtaggtaacttcaggcagataacaacctaaagggagtctcctggaacatgttcagaatttaaaatttcactctcaggcatattaagagaagtgaagataatttgggtcacttaattttagatagactggcctggtctgtttttctgcctggttggtgtgtcaccactgtaaacatgtcgctgctggaagcttaagcaaaggcctgtggactttctttaccaagggccaggcagctcccagggtgttcgggaagcatggccctgctccattgacagattcctcaggagacagccacactggaactggccttagtgtatatgtgctgagcttcggtcaacaccattgttgcttttcggggaaactcatcagaagtgagcattctctgagcctcacttacaggtgagtgggtagaaggtggggttgcagagaagttcccaacagggtatgtagagccatgtttgcatggccttgggtgtgagaaggatgagtttgctcagatggacttaattaagtaatgtaattacttaattacattagtctcctcttcgtgaagaagaggagactaagcataattcctgtcgtcttctagattcctgtagaaacccaggcaagggccaagaatagctgtgacagttgagaaggcaaggccggaaggaggttgagttacctttctcttctctgtggaatacccgggatgatccgctttggaagaggaaagcattctggcttcacagttttggagttgtgctcctttgctggctggtctgtttattttaggcccttggtgtggcagttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagttggctcttgacgcatgggccatgcttgcttttccttaagcaggtaactgttgtgcacatagctactgtaagaagtagactttcagaagctggagtgtccacggggacttagcagctggtgcttccagtggacttgggcttgaaccctggcatgcatgtggtagctaacagccttctgtaacactagtcccagggaacctgataccctcttgtgacctctgaggtgaccaggtacacatgtggtgcacattacatacatacaatcaaaacatcattacatatgaagtaaaaaaaatacacgtctgacaaaaatagaaataatctgtatctacaagtagtacaaatgaatgctacactaccaggcgcatggtgtcatttagaaataagcatttctaaacccagaaaacatttatattggttactttcctgttgctgtgctaaagcctccagccaaggcagtttacagaaggaagagtttattcagccttcggtccctgagggtgagagtccattgtagcagggatacagcaggagtgaaacctggaacagaaagcccagagctcacatcttgaactacaagcaggaagcagagagagtgaactagaaatagcatgaaactttaagctctcaaagacaacctccagtgacatacttcctccaagcagaccctgcctccagccctgtcaaacagttctaccaactgggtacagacagacattcaagttcccagaactatgggggatatttatcatttaaaccattttgtgtttatatgtgtgcgtttgtatgtgtgcatatgagtgctgtgggaaccagaagacagcttgttatataatcagttcactcctgttactgttatgtcctggtgattgaagtcatatcatcagactccacagcaagtgcctctgtcaactgagccatcctgccagcccaattatgatgtttttagtagcctgcctcatattatttctgatgtaactttaagaatcttgttagggcttggtgtgacaaaaactggttgtgttaaaagtaaatagcaaacattatcatggcccagaaccagccatttggacttcagcgctctcctttctcagtatagggacactcaacgatcattgggtccctgcactttcaagcataaaagaatctgagaagccagagctgggtcacattagtaagctgaaattcttcctgatgtttttgggtcatgaaatataagtttttgcatttttaaaatttgctacgcagaaaaacctagtcttccctgcagactgggaaatagaatttaagttcctggttgataaggacctgctcttttccctgctccctctccttgtactacagaccaccttcaagaagaggctagataagctggggttgaaacttgtaacatttaaggtaaatattagggaggccagtatggaaacagatcagcagggatatcagcagagaaagaccggaagagggtctgtcacagatgccaagaaggtcacggagagaatgtggggacagcaggggaggagaccaggttgttttgggtgttttgtttgtttgtttgtttttgtgactagctttaatgcgtgactttagccaacagatggctggggatggggcctagatgtagccttttatctcttcagaggcacctgcagtcgccccttctaaaacaggcaagcagtccttcttctgtgagtcaagacttctcaagaataattagccagttattctttcgacctacaagagtccaaatttgagcacaacctctgggcatgtaggctgttaagatgttcctccccaccaggcccctagttaactttgtcttagaggggaccatctaagtgtttgacagtgtctgtgtcttggcaacgacttcacacacttagaaagttgaagactcaaataaatcatttttttcaatttaacaacatttacagagtatccattatgtgtttcagtacgtgttaagctctttataatactggcatctagttttcgttataattatgctccaaggagtgtcagtgcagagccactcacctctctggagacaagccaggatgagggagctggatccgaccgctggccggcctctgccctgtccccgcctcactttcttcacgttcccttgtgtgtttaattggatttgggcaaatggcacgtatttaactgaattttacttaatcatacatctcttctaagttcctcaaagacaggattgacagtaggtacgcttgtgagcagagcagaatggcttgcagcgggcctcaaagctgttggatcggtttactcctgcctgagcccttgctaccgtgggactgtgagctagtttaattagatgtttgcgaatgcctaattgtatttgaaacaatagggtaaatgaacagtaggcgaggcgaggcgtgctgggataatacagctctgtggccatgctgtttaagagacagctattgggtgtccacgcccccttacaggacagcatgtgagccacactagggtctgccctcagccatgcttgcactcgaccacccagcctctccaagcttcgatgacttgcgctcagactgcttatgctctcttgggaaccttaaggccatgctccctcttctgggatcttaagttgtcagtttctgacggttgcggcctgcgcactggagtgttcattaaaacccatccaggcttctctaggccccaagcgcttccctagggttctaattctgcttctgcaccccatttgctctgtggtttgtggaaattcaagcaggactctggtcttctcctcacttcttatcttactgggtgctgtttacccagtagccacggtatacagtttctccattaaaaaggtttttttaaagagaggttttaatgtattccacctggcttcaaacttatgtataactggcactaagcatctaccgtcttgctttaacacctgctgagttggggggttacaggcgtgctttaccatacatggttttaatgtggtgctagggatggaacccacaactgtgtgtgtgttagccaaacacggtagcatccaggccacactcccggtcctttgtaagtttaacaacaaagagaactggttctgtccatgccatttcacgcctcctgtcttagttagggttgtattgtaaaccagtctgttagcattgtgcctgaattttgagtaatgatctctttctggcatcgtgagcatctgtatcagccccactggtccatggggggatgaacgtcttcacccttcccaaggctgcaagcctgggactaagcctctctccgtggcttgttgatggacatctttttccctggctctgtgtatctgtgtctttatctttttgccttggaaggacaccagtcacaggggttgaaagcattccagcaacttcattggagattctctaaatatattctgaggtcctgggagttgccgtcagtataggagttttagttggatactgttcagtctcaagaaggtttaagtgtgatgtcattgtcatgaacctttatgactaatgaaacatccttttaaagtttaggagtaggctagggaaggcagcatcttggaggagaggagagtaccgggtttgctcacggcaaggcttagagatgaccacatcttatggtggtttgtctttgcttcccccattttcgttcattgagatccagaggacctacggactgttaagggtctgtggctggatggtaataacggctttgtgattagacttttatactcatttaggaaggtgcggaagaagagcttgtataatcctgtgttgcaatgcctcaagtaccggaccgggcagaacatgaaagagcaaaactcatggcccgcagaccctagactaatccaggcttctgtcttcgctctgcgctgaggagaagcaaaggcagaatcgattcccatgacatctccttcatgcatgactgtggcagcttacgggcctactaggggctttaatttcttcatctgggaagccaagacagagagctaggagactctccccccagtcttaccctttgtcacagtttcctgctacagctagatccattggtagatgacagacacttggtgggccaatggtgggatgacctttttgaccccaggtgggacatctgtcacataacctacgagtgttcttaacgtccactgtctgcctaccttatgtgccacagacagctctcgaggatgttgaagtggattggatttgcaccagtgtccccagcatccatgctgtgatctcttgtatagatgtctgctcagggaagatagaaggttttgccagtttccctttctgtatctcatgccttctgtcttagttagggttgtactgctgtgaatagatatcatgacctaggtaactcttataaggacaacatttaaggtcccgtgacctctaactgggctccgtcttctcgtatttgcatatcatatatcaaagaagatcatgattggctttgtctaagtcacgtgattgtctccaactctggcactggagcattgctgccgggctggctgtgtatcagtcacagttgcaagcaccttgattggtaggcctactgggagaggagtgctgtccccagagaagggttgcttagcaaacagatagcatgcatttaatacagatatcaacggttcaaatccttgggggttggtgtttatccctttagttgacaggaaatgcgaagtgtctgtcagaaaaccatgctgcactggatccatttgagagtttacagtgcccaccgggaaggggtccttcaggtgggacacgtgtccaacgattgctaagactgatttaagtgtgggcaatgcttggggcgctgtgacaccgtgacagtaatgggctttccacggtttattttcctagggttggatgactgcctgcagccatatgtgcacaagtttgagcgggagaagatagacggggagcagttgctgaaaatctcccaccaggatctcgaggaactgggggtcacacggatcggccaccaagagctggtgttggaggctgtggatcttctctgtgcactggttagtccggtagaaggtcagcccatcctcacgttcttaggaggatggaaagaagcataagcggaccatcagagaagacaaggagcttctagaagggaggctggcaattcataagccgtgagcttagtctggcacacttgtatgcatgcatgcgtgcatgcacgtgtttgtgtgagtgttcgtttacatgttaaatgcacatgcatgtgtgtatgtatgtgtggaggatgaaggacaatttagagctttacccatggaaacgctgtccacctttgagatagtctttcattggctccagctcaccagttagagtagattatctgactagtaagccccaggggtccttctgttcccacctctccaacccctggagttcaactctgtggccttgagcctagcttttatctgtgtgctgggcattgatcttagggctcatgtttacaaggcaagtattttaccaactgtctgagccatcttccctttcttttccatctgagtgaatgaaggaatttaaaaattagcatacaaggtattagataacatgatgtttttaaataaagcatattttagtagattctcccctttcctctctcccccacccttgtcttccgttctcacccttcttccctcaggctctttccctccttgttggcacatttatcttttttgtttactccactctccctctgcacctttctttaccctctctggtcatatttctagcctcttagcctttatccacatttacacccactcacataaacaccacacccccatttgctaataaagttttattagactcagtgtgcacagttgtggatgtatttactatccgaggctgcctttgtgctgcgaggacagaatggagtctctaacagagaccacatgcccctccaaaacccagagtgtttattgtctcatgtacagaaaagtgttgtctgttaccaaaaaacccccacgtgtctgtgttaggcttattttccatcttttataaagcacagaatgatggagacagctgttaatggggatgccattttcaaagtcaaaatgaaaaatgctatatgtccacgtctgtttctgtgactataaaaagcactgtgagtttcacagatactctgtttaaacaactggtgtttgtgcttgacatgatcaaccaaagaaatggcagctagatgggccggaatgtgaactttgctccagagtttcgctgtagagggcaggtgtgtgaactctgcccaagtcctgtatggctacacctgtgcttcctaaggaattcattcagatgtggcataaaaacacccataaaggtacttgtttacaaactggctggcatgggtgggactcaggtctcttgtcatggtgccacgcttaggaaactgttcacttaactgtcggggttggcacccctccccctccccctttccagcattcaggctggtttagtaatgctctgaagctgagccaaggggatatacaattacatcacccagaatggtgggaatgagtgtgtggggatgttgccactgctggtctgcattccatcgattatataatacttgctgcgttgcgagtattctttttcttaaaatggacagagccttgtcttctgctctgagatgtgcagctcttgtttaggagagtaatggggaaattatttgtggttgataaatgagctgtcacaagggagacacagtggacaagagatctgcgtgctggccgggaaggcaggatttttgtatcctaatcttggctctgctccaggctactccttctgcgactcctgggggaatatggtgtctgttcccctcatctgtacactaactgtcaccgtagatgtggccacgcacccgtgggtgttctgcatggctgggatatgccccggcatcctgtttattattaaactgtctgctcttcagagccaaacatgcttgagtttacttctgtcacactttccgggaaacacagccttgtagtcttttctgctggaatgccctgtgctgttgcgtctgtctttttggttgtggtatactttgaggactagaaaactgctttgagatttgtagcatgaagacgaggagaacaggtcagcttccagcagttatgtgtctcaggaggaggaggagaaatagcagaggccccgtggacagtctctctaagcttttctttttgcttcctcttaaagcgttgcactaaaatgaacaaagctggacccatgccagaacctaaagctgtgttgtatcgcctacaatttcctactaatttcctctatagaccaggctctgacctcagtctcactagggacctaccctgaacagcagtgcaccttgactgccttgccgggggatgaggggtcgcacccctactccagagtctgcaagtgaatgtttttctgagagagtctaacactttcttaaatattttcagtcttcatataatcttccataaaatactgttataacacagcattattttagtgtttatttaatctgctgccatgcagatcatggggtgtttacctgagagtgttttacattgaataattcatttgcaggtcagttactatgcagctgtagttggccctggtgctctaaagaggtttctaggtaaactagttttagtggctgttgatttttttttttttttgatggacaggaagtaagcagaagttggattaagaaaagatgtaggggtaagaaatcattggaaagttttagagcaatgataaaagtggatagaatagagaataacctaaaccagagagaaggagtctccaaactcgtcaattatagctagagggtaagaagggataccatcccaagttcaagtgcccccctcccctttcaggggcagagggtgactgacatacaccatagctgccctgttctcttgagaaggcttttgcctcatctggctgcttatgtgaggactaactaattaaataaaagttggctctccgttacgctagctttatcacaagtactcagtagctgcgggtgccagtggccaccatattggaacacaagaccgcagacagttctgttggacagcattggtgggaaacattcacgggcagtgagaaatgtcatggagacccaggctctttaccaagtgggtgaagctctggttttctgaagataaaaaggtggaagacagaggtgttgtgaacagggtcgtgccagtgttgaatgatgccatcctagatttgtaacagttcaggggaatggctgtgtggaccaccatagcatatctgcattgtgctccccctcaggccgctcattgatcatcatttacctataacacatcagtctctctctctgatggagagatggtaggcagcaggggagttttgctggtcattttatttgacttgatcttgctcgagctgataatatacagaaaacgataaatgacatagttcttgggttgccatttagtagatgtaggcagtgagtttactttgattccgtgttacctggtcacatgtattaaaatatgaccagagcctgaagcactggagagaagaagaggcaaagctatgtatggtacctttaaagtttaattgctcctttttttagtgaatactctcgatagacatcggcacctgggtaggtgacagagtgagggagtagtccctggcatgctgggcacagtccttcccttccaaacatgtgtgtcctgtagattccttagccattcatttgtgaggttttgacattaaaagcaatgatgggaacctatccttatttcttcttctccattgaatgaagatattctatttttaaactttagggaaaaagccagtgacgggggaaaaagtgaatataagatttagatagaatattgatgttactacaggaaatactttgaaatttatacaaactttcaaagctgctgagccagctcttctgcccctctaactttttaaaattaatgctttaaaactcatttccattctatgtgtttggatgttctgtctgcatatgtgcccagtgcctgcagaggcaaaagagggccttggttttcctgggaactggagtcatgatgactgtgaccagccatttgggtgcggagaacagaacatgggtctactgaagagcagccgctgaccataacctaactaccaagtcatttctccagctcctaaaagttttttttttttttttagaactagaagcattataaatttaaacctcccataaagtctttttaaagttcttttcactaaagccaaagctgtatgttgttattaaccagtcatttcttagtgaaagagaaagttctgcaaactcctgagtatgtgtatactatagatgtatagattgtgcatgtatgctatagatgtatagattgtgcttaattgttccctctttgtccccgacatcgaggtggctgagggtagctcagacgtgtcctgatgttccagagcagccaggtctcaggaatacataatgcccatgaatctttggttagtttgtactaggtctgccagttcttcctcattcttttgtttctttggtttttgagacacagcatacagccctgcttggcttcaaactgtctatgctcctacatcagcttcctagttgctgggtggagtgtgtgcacccacatacctggtctgtttgtcttactcttgtctgctgtccctcctgtgtccatcttgtgtctcggctttcccttggactgggtattgggaagtggaagtacttggtatgctgaggcagaggttggaatcccagccttatctttggtcacctgtgtagtctagtgacacaccattctcgggccagagtttcttcagcagttaagtagtaatgcaggtgaaacgtcctttgtctgatgataggagatcagtgaaacatttgaaatgtcagcacgagatgggaagtgaggattgttcaactcatcttctctaaggtcacagtcaaggcccagacaactctagcaatacaatacatgattgcctccctgtatagaaataaaaatgaattaattttacgctcataattgagtcccatacacaagatgtgtcacacgcatacagatttttcaaactgcgaaaccatccagaatttaaatgtaagataagggacactcagagtgctggttagctttgtgtcagtgtgataccagctagagtcatttggaaacagggagcctccattgagaaaatatcccttccagattgacctgtgggcaaagcctctggtgcatttccctggctgatgactcatctggacggctcagcctcctgtgggtgggaccacccctgggctggtgtcctgcatgctctgagagagcagggtgagcaagccatggggagcaagccaataagcagcatccctctaaggcttctgatcatctcctgcctccagtttctgccttgagttccagaaattgatggctcgaaagcaggcacttatgtaaactgaacataggtcagagagcagagtaagttgtgggtgagctgacagtgttgctgtttctcagtcctttctgttggaatctatctcttcatcacctgtagtctgtgtgacggccacacagagagccctggcctggcctgcggtccatatggggcacagtaggtgacaagctggagagtaaccataaggcactatactaatctcagggaacacatgcaatgacatatccagaagacattgttagttgtcacatctggggagtgagcttctgatatctgataggtgcttgtgtgtgcgcaagcgtgtgtgcatgtgtgtgtgtgtgtgtgtgtgtgtgtgtgtgcagttgctagcatcttggctgtacatgagagctttcctcagaagagtgaccctgccacctatcagttagccaaagtctgctctggactgactggtcaggagtcctggcccagcggggtcatatgcccaggcctgagagatagggatggacttgccttgccttggtctatctgaagagcagttcatgataagggactagggacaatacatccccttgagacaggacggggctgagggagtagagcgtacaggccagcatgtgggcagtttgggtggggtgggcaggattttgtgggaattgggtgactcactgcagcctctctgtctcctaagtcattctgagtttagacagtggtggtagttttgaacttttctctcttgaatttatttcctgcagaattatggccttgaaactgatactatgaaaaacttggttctgaaactgcgggcatcttcccacaacttgcagaattacatcagtagccgccggaagagtccagcctacgatgggaatacgtcccgtaagccccccaacgagttcctgacttctgtggtggaactcattggtgctgccaaggccctgctggcttggctggaccggtaagctgtgggacaatgcagcctggggcacatgagggcctagaatgctcagcagccttaagtttgcctcaggaagaaaagcccattgtccctgggtctccctctcctggaattcaggggccaggggtcagaggtagacctttttttttttttttttttaagatatttattttatgcatatgagtacactgtcgtcttcagacaccagaagagggcatcagctcccattacagatggttgaagggcaccatgtggttgctgggaattgaacttagtacctcttggaagagcagtcagtgctcttgaccgctgagccatctctccagccccagaggtagatcttagaatgcctttgaatgttactttgagggtcagcaacaggaacaaataaccccgaggttagaggcagtgacaccgtgctaaaggttgttgtgctgacatgaagcatgcgcactggactctgaatggcacggaggaagcagctggcgggcctggcctggctcgttccaggtctgggtcttgtcttcttccgttcaccctcctggtttgtttgtttgtttgttttaatacagtgcttttattaattctttgagtctttcatacaaaagacttgttcatatccactcccactcctccccacagctcctcctggatccaccttcccctccataccatctcaccttgtgtcctcttccacagttttcctgaaccttggcaggctgagggtattgcgttgtaaatgtttttttttgggggggggcaggtaccccaaggcaagttgttctctgtagttgttttttcctgtaatctcagtctactgtaaaggaaacatatttgatgagggcctgagagagacacgtatctgtgactttaaggacacaagatttagaacgcagttagacattacactggctttggaaattgcagatatgggttctcctctggattctgtggcctcaccagccacaggaagttggctaaatttacaggtgccaaatcattcctcttgagcaggctttaagtgcagttagacagctgtcagttactgcgggatctttcagaatagcttaccatgatggttattgttgtggttcgtaggtgacacaactggatattactattggtggttcttggcaatttgcatggccccttgggatgctgtacgagctggtcctcggggtcagatttctggtgttcagaggaagtagcatgatgggagataacctaaggcagcctgcagtgtagccatgcatgccagtgttggggtgggactctcaggggttctcacctccatccactcattaaagagagttcttgttccttcccagggctccattcacggggatcacagatctctctgtgacaaagaacaaaatcatccaactgtgcctggacctgaccacagcagtccagaaggtcggtaatgcgtcatcattggcttccagaactttttcctcatgtttctcttttttccaaggggttcccatatgggtacaaagtattcaatcctccccttccatcaaaatttggtgcttctgcaaggagcgaccagcagcctcaggctcagaaacgacttggtcttctaatcactagtgcttccgtatctctttgagcagaaacggggattgtggacttgcatatagccaagtctcactgccttcttgttctgagtgctttgctgtgctttgctgattctgacttcatttgacctttgttgtcggggtcaaaggtcaggatgggacagtgtatgaggctgtaacaaatacccccagaccttagcagtttgtaaatggatcccactgggaaatgagcttcggttcttctcacagcaatcagtcagcatcttgcgtagcctgtccctctgtcccactgcagagtgtgtcttagtggttcttgcgctctgggttgaactgacgtctcagatcccctcatgccttccagttagacatggatctgtaaacctgtaacgttttatgttagcctgtggtttgtttagcttctatgatattaactaaaaagatagataatgagtgctaggaccagctgctgccctgttacttggcatatagcagattcttttttttttttttttttttttttgtaatcatatgattttaattacaccaaccttcattttctgatctggctgtttattgccatatccatacaattaattatcaaactgtttttaaatgacaaacatattcatttgtatctttttttttccttttttatttaattaggtattttcttcatttacatttcaaatgctatcccagaagtctcccagacccctccattcccatttcttggccctggcattcccctatactgaggcatataaagtttgcaagaccaagggtcctctcttcccactgatggctgactaggccatcttctgctacatctgcagctagagacacgagctccggggggtactggttagttcatattgttgttccacctatagggttgcagacccctttagctccttgggtactttctctagctcttccattgggggccctgtgttccatccaatagctgactgtgagcatccacttctgtgttttccaggcaccagcatagcctcacaagagacagctatatcagggtcctttcagcaaaatcttgctggcgtatgcaatggtgtcagcgtttggatgctgattatgggatggatccccgggtgtggcagtctctagatggtccatccttttgtctcagctccaaactttgtctctgtaactccttccatgggtgttttgttcccatttctaagaagggacaaagtgcccacactttggtcttcgttcttcttgagttttatgtgttttgcaaattgtatcttgtatcttgggtattctaagtttctgggctaatatccacttatcagtgagtatatatcatgtgagttcttttatgattgggttacctcattcaggatgataccctccaggtccatccatttgcctaggaatttcataaattcattctttttaatagctgagtagtactccattgtgtaaatgtaccacattttctgtatccattcctctgttgaggggcatctgggttctttccagcttctggctattataaataaggctgctatgaacatagtggagcatgtgcccttcttaccagttggaacatcttctggatatatgcccaggagaggtattgcgagatcctctgatagtactatgtccaatattctgaggaaccgccagactgatatccagagggttgtacaagcttgcaatcccacatatagaagattcttaaaaaattgtttttgaactgaatttcttatgaataaaaggagtggattttctcctttctatctatttggttttagagattttattttttttttattttactaaggggggtgtgtgtcccctgtgtatgtgtatacctctatgaatgtgtgtgtgtctgtgcacacgagtgcgcatgtctgagtctagaaggcagcggatcccttgaagctggcgatacaggtgcttctgcagctcccattttgatcctggggatggaacttgggtcctctgtgatattagctcctcactactgagccaccctcagtctctccatgcggctttaaacgtggagatgtgctggtggttgtttttaggcatggcctgattaaaaaaaagtccttcccccttattcctgactgtgcagtaaccgaggcaggggtgtgtgtatgtgtatgtatgtggccctctgtaacacagaataaagtgtggctgtgtttgtgccagttatttgagatctagtcctgagcagccactgtgtttgaagcacatctgctctgctagaagtgcccagaggcactgaagggatctggttttgctcatttttatgacgtatgaggtaattttgatggaaagaatctgacatcagctgtgatacatgagggccatggagtctaagtccaggcgttgatggcggaaagtatttcccaacacttgctaccatgagggcactcttccctgttctattcccttactgttcttcccttactattctgattgcttgttttgatttataactgagtttatctgtagtccactacatccaagtgtaagaggcaaacagtgaaattagcaaatgggcctcaatttgtgtgtcctgggatgggtccgagatggtgagcctgatgtggaccttagctgtggagcatggggaacggagggaagctgtgagggcagggcagatgcagatgcagatgcaggtgaggaggcagatgcagaggaggcagatgcagagcaggtgggaaggctggcgcagatgcattgctctttgtttttacaggagagtagctttgcctgagcatgttaatcttggctttgtaggcatttggacagtcccttcaataaacatttacttgccatctgtgcttgccactcttctaggcaccagggtgccagagtgaacaaacagatgtctgtacctcagtgaacttagcgtggggcctaagaaagaagaaaggaagtcaataagcaaagcgccaatgtgcgaggctccacacagtacacacagtacacacaatgtgtgaggcacacacagtacacacaatgtgtgaggtacacacagtacacacaatgtgtgaggcacacacagtacacacaatgtgtgaggtatacacagtacacacaatgtatgaggtacacacagtacacacaatgtatgaggtacacacagtacacacaatgtgtgaggcacacacagtacacacaatgtatgaggtacacacagtacacacaatgtatgaggtacacacagtacacacaatgtgtgaggttacacacagtacacacaatgtgtgaggttacacacagtacacacaatgtgtgaggttgcacacagtacacacaatgtgtgaggcacacacagtacacacaaagtgtgaggttacacacagtacacacaatgtgtgaggttacacagtacacacaatgtatgaggtacacatagtacacacaatgtgtgaggttacacacagtacacacaatgtgtgaggttacacacagtacacacaatgtgtgaggttgcacacagtacacacaatgtgtgaggcacacacagtacacacaaagtgtgaggttacacacagtacacacaatgtgtgaggttacacagtacacacaatgtatgaggtacacatagtacacacaatgtgtgaggttacacacagtacacacaatgtatgaggcacacacagtacacacaatgtatgaggtacacacaatactcacaatgtatgaggcacacacagtacacacaatgtatgaggtacacacaatactcacagtgtatgaggctatacacagtacacacaatgtgtgaggttacacacagtatacacaatatgtgaggttacacacagtacacacaatgtgtgaggctacacacagtacacacaatgtatgaggcacacacagtacacacaatgtgtgaggttacacacagtacacacaatgtgtgaggctacacacagtacacacaatgtatgaggcacacacagttagccagctgaggagggagggagaagatggatggcatgtgtggctgcaggaagcttcctgagaagatggcactggcatggctgatctgtgaagctgtactcccctggcagggtgggactgtcgcaggacctcagtttggagcatttccttgtagtagagagttattgatcactatccaccgatgatcggaaatgtagccagccccctttcacctgggaggcccaggcccagtgtggctgtgtcttctgcagagtgccctccttaccggggcctggtggcacatggtgcatgatgaagagtgacttataaagtgcatttcagtggggagataggcagctgtcaccacaggtcagccccgggccctggagatgtcttttaagagtcacgggccttcactttcttatctgtgaaatgagaacactagctttcaccttatcagatggctgggtagaatttctagagttcccctcccccgtcccacttttgagtaagaagaaaggcagtataaaaacaagccatgaaatggcaggtgtggtgatgtagcctttaatcccagtatgtggaaggcagaggcaggcagagttttgtgaattaaggtcagcttaatctacattgtatgtgtcaaggcagccaaggctacataggaggctttttttaagatgtgaagaaaaatggcaattaaaaatttcaaatgatcttatatacctgtgtacatatgtatgtacacacacacacactcacacacacacaagcacacacacacacacacatccacgcacgcacacacacacacacacacacacacacacacacactaagatgtccataaacctatctgtaaaggaagaagtaaatcatatttatcttggcagggaaagaaatagacacagaatgggggagggggctaagcaaaagagagagaaagggtaggaaggaggacaggaggggagggggaaagcaaggaggcagggctgtgggaggaaggctttatttacaaagtcatacatataaccacacttacacgtgtaaaaattggatataatatgaacggccgtggtttcttttgtgtttgtgtgtggtgctgagactagaaagtagggcttctttgtgcacacaaggcgtgtgcttacctacatggcaagtttactgagccacactcaagcaaaatacgaggagttttaaaactttgaggagtgtctacctcaaagactgctttgaagatgatgtgttatagcataaaaagtgtaacactgactcagaatgcactcaattgggaatctaaatatcttgctttttagatattttgggaaatattgttttccagagtcagactagatgagtgaaagaaaaataaggaaattaaagaaatatatatgctagcctcattttctgaacttaattctaattttaacagatttttataactttgagtttgacatttgacagttcatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatttttaagggtgatgactgaatatatgtaaatatacttggggaatgatactttctgcactttagaaaagatctatcatcggctcttgatcagaatttgttttcttctttttttttttatttaaagagttatttatttattttatgtatgtgagtacactgtcactctcttcagacacaccagaagagggcatccgatcccattacagatggttgtgagccaccatgttgttgctgggatttgaactcaggacctctgaaagaacagtcagtgctgttaaccactgagccatctcaccagccctagaatttgttttctatagtaattgaaatcactatttctttgctgagtgtccgtgtacatgggcatgtgtgcaagcatacacacacacacacacacacacgcatgcatgcaccagagcaaccagcttggtgaatgcgttcagtgtcatttcccgtgccgtgtgatggccactacaagatgaactgtctcagaaactgcaccctttcttatatttgatctttgtcctttcctggggacatgaaggactgggagtcatcttcctcttcagtgacaggcgcctgtttcaccagagccttcctctcaggcccctgcttccgagagacacatctgcttttcccctcctctttccatctgcgtgtcagcctcacctttgtgctttttcttagcatgtgccctgcatcccttcctgcagtagtgaagaggggtgccctctgctgcgtttctccccctgcaatggttctgtgtgttcctgtgcacttccaaggctgcttctgtagtcaacaccaagcactgagcgcaagggtcagtcttcaggtccagtcttgagggtttaagatgagaagaaggaaacaaaggcaggaaggggttgtgacctacatttcccattggattcacctctataatggcatgatgacttcaagtgtaatggtacaagaacaaagaggcactgacagggccgagttcctgtctgagaggaaatagaaaggggcagtatttgagggagaaggggaacagcgggatggagccaagggagacaccatcactaactgggaattgcatgtcaggtgttgagctcccaacggtttctaggatgctgactgtgccatcttatttactggcaggaaagagaggcagagggttgagcaggcaggctataaaggctgcaccattcctgaggtggcaggctgaggatagggcagtggagacctgcctggggcaagctgctagttgccttggtggccctgactgctgatccaggtgacccagggctgacatgaagctctgtttcagtgtgtgattcatgagggggtggcgacttgttcaggaaagttttcttcctttccgtcattaccacaccacataatgtgaggtcatgcctgcagctgtttcctttcggggtggggaggaatgggtgtgggaagccatcttgctcttggtagaaagttgtgagtgagtcctcgtacactctggcctgacagtttgcggttctcacttgagccagttggtcttcatggcaggcagcccagttggactgatgaattccaaagaatcaagttgtcagaaccaataggtcatacctcagccttgactccagtggcctgtgactgggtgatagtctccaggaaagcctggacagcgttgttcatctgtaatttataaagaccatagacataggttgttggctctacttgccatcgtatggccttgtgaaagtatggtttctgggggtgggtgggtaagggggacttttggtatagcattggaaatgtaaatgagctaaatacctaaaaaaaaaaaaaaaaaaaaaaaaaaaaaaaaaaaaaaaaagaaagtatggtttcagagttgctgcgtatgtaccggctctctggcgatagcggatgacctgttgtggaaatggatgctttgcttcctgtgcatgaaagcccaggtagaagcacaccaccaagatgcaggtgctcatggtgacaacgctgctcatggaccttgggtttccctcagagtcacccttgtgtggagatttatttctaaagttcttaaaaatttttttttctccctagactgctcttttcttgagagcaagcatcagtagaatagctgttattgtatcttctacttttatctggtaaaaggaaaactaaaattttaaggagacaaggaaattgtgattctgaaatcatataggattaaaaaccagttagctgcccttgatatttatagttggggaaaacgacctaaacctgacatttctacctaaatgaaaaacatcatctgatgaattcaggactgatttgtattttttcatacacctggaattctcaagattgactcagttcggtgttatactcagtggtgcagataagccctaaggaaagccgttctcttccagagagactgtttagctgttaagggcacctgtgtgattcctagcatcatcttggctcacaggcatccacgactctagttccaagggatttagcgtccccttctgctctctaagggcaccagggcacctgggggacacaggcatctgtacatgcaatgcactcatgtgtataataaaacgagtaaatctgattttaaaaattaaccaaaaaaaaaaaaaagtaaccaagaagaaactggcttctcagatctcctttcgtgcaccctgcggttcgtgttgagagactccagtgcagatggttctagaaggctacctgtggaagtttcctgttggcagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtctctggttttgtgtggtgacaagcactagtaccccgggcctcgccttgtgcacaccaggcaagcacttcacccctgaggtgcatgttcctagagtcagtgtgtagtgtttggtttataagtaggtgttcacattagagaatcagttcgatggatcctggggtgagctccatcagttagaagacaccagagccttaggagaagagaaatgtcggctccactttcactctgagcccacgtctatattcacgcctgccaggactgctcaggctcagtacttggtgtggcaagagatgtcaggaaccttgtgatttctagaaagatcggacccaatttttcttctttctcaaaagattttatttttgtttcttagcattttatactctgctactatatttacatcattttatcctcccatctgcccaatacaagcctgcccatatctcccctactatgcctcaaattaatgatctttccttcacacacacacatacacacacacacacacacacacacacacccatctatatatatatatacacacacatacacacacacccatctatctatacacaaatacacacacattcatttgtacacacatccatctacatacatacacacacatataaacatatacacttatacacacccacacacaccccactgaacccctctagtctggcatgtaagtatctgctttcatgactgaccttccctggaagaaacaggtcttctctctctctctctctctctctctctctctctctctctctttctccctcagcagccactgattgcctgtagctcttctccttggggagttggggagggtgacgtttgtcctgtctgtgttgacttgtcagttagtgtgccg

SEQ ID NO: 1676 - DNA, 460 bp, Mus musculus
tagggttggatgactgcctgcagccatatgtgcacaagtttgagcgggagaagatagacggggagcagttgctgaaaatctcccaccaggatctcgaggaactgggggtcacacggatcggccaccaagagctggtgttggaggctgtggatcttctctgtgcactgaattatggccttgaaactgatactatgaaaaacttggttctgaaactgcgggcatcttcccacaacttgcagaattacatcagtagccgccggaagagtccagcctacgatgggaatacgtcccgtaagccccccaacgagttcctgacttctgtggtggaactcattggtgctgccaaggccctgctggcttggctggaccgggctccattcacggggatcacagatctctctgtgacaaagaacaaaatcatccaactgtgcctggacctgaccacagcagtccagaaggt

SEQ ID NO: 1677 - protein, 153 aa, Mus musculus
  VARIANT (1)...(153): Xaa = Any Amino Acid
GLDDCLQPYVHKFEREKIDGEQLLKISHQDLEELGVTRIGHQELVLEAVDLLCALNYGLETDTMKNLVLKLRASSHNLQNYISSRRKSPAYDGNTSRKPPNEFLTSVVELIGAAKALLAWLDRAPFTGITDLSVTKNKIIQLCLDLTTAVQKX

SEQ ID NO: 1678 - DNA, 125534 bp, Homo sapiens
  misc_feature (1)...(125534): n = A,T,C or G
ttagcccaaaaacctggtgggggattgtgcatggttgttccgaggatatcaataacatctaaagaaatgtgagtcaaggagtaattttttggctacttggctataatatttacatacttaaccggaacagataagaggttctccttttgtggcccatatgtgatgacagttacaaggcttatctctaagtgactgaaatgctgaatgtggaattcatcaagctcgacttttctccatgactggacttcttctttgagcagtcttccatgagacgccttcagggagtctttaaaagtatggcagctctactggagattgacaatgatttagcctttggaccttttaggataaaggacttttgtgaactacataaggctcccttttcccagaagggaatgcttttaagtttcttagtggattaattagtaactgaagaaaacaccattccttgaattgttgccacttttccaacaaataaaacagcagaaaaaaatgctatcagaagaaatttttaaaaccatataaaagataatcagtcaaatttcagaccttgtcagttatgtagaggtttaattcgtactagatcccacattcaatagaagaagctgctgatggagccagatgttaaagagagaaggaggagtagggaaagcattggtgagcgagttagcaccctagttttatagtgatatagattgaagaggatggaagctctttgtcttagaaacatctaatattttacacaaagagccctaaataaacaaaagccaagtgctgattaaagcaatacttacatttgagaattcttttgagtgagaggatgcatacctaagatgtatttatgttgatgttaagcagcattgcaatggttaaatttatgatgacagggctgaggaagacattgtagatgatttaatcacagatgaaatgatttggtggatcattacttgatgaagagatgtgggagggctactagaaccttccagtacactattctggaaaaaaacaaaaaacaaaaacaaaaaaaactccactggttttggattttcagtctttgtaaaataacaacttaattagaggtcattttatagttgtgttttcatatgaggaaaaaagaaatgagaaccacagaactaaacagaatacaaactgtaaaaatccagagaaatgaaagctcaaacaatatttgcctgtaaggtttgtggggaagacagagcaaagggggctggaaggcagataatgttttggtcctaagtgaaattggagcccctttgtttacaccaggtgtatcagggttcttcagagaaaaaaacccaacatatatatatatatatatgtatgtatgtatgtgtgtgcgcgcgtgcgcaggcatgtgtatatatgtatgtgtgtatatatgtgtgtgtgtatatgtatgtgtgtgtatatatatgtgtgtgtatatatatatatatatatgaacactttgtaaaatattaggtgtttctgagacaaagagcttccaacatcttcagtgtgtgtcactgtaaaactagagatgtctcaaatatgcaagatgctaactcccccatatatatacacacatatacctacatatacatacatatatatacacacatatacatacatatacacacatatacatacacgtacacacacagacatatataagtatatatcaatatacttcattttttaatttgttatgggaattggctcacgcgattatgaagggtgagaagtcccaccatctgttctctgcaagttggaaaagcaggaagaccaatggtgtaattcagtccgaaggcctgagaacctgtgggggggtggggtggggggcggggggttnnnnnnnnnnnnnnnnnnnngtataagtactggagtctgaatgccagagaaccaggaacgctgatgtctgaggacaagagatgacaggtgctctggctcaaggagacagagacaaaatccacactttctccgcctttggttttatttgggccctcagtggttggatgatggtcgcccacagtagtacgggtgatctttactcagcctactgattcaaatgctaatttcatccagaaacactctcacagacacacccagaaataacaataacgtgttaccagctctctgggcatcccttagcccagtcaaactggtacctaaaattaaccatcacaccagatggtgtctctttcttggggagtcagaccctcaaggggagcctgagttggcatctgatgaccaataatggcaacaagtatttctctgtggatgtaatatctttattttaatactgacagaaatgcctcagtttgacatgcaaagtatgatttgctatcattgcattattgatagcttctgataaattgtgtatcttcattctatattaaaatatataaacaatatacggaaccctgaatctcctttctatcccattgtcaccaggccctccctccctccctcccttccctccttcctctctctctctttttttggagtctcactctgtcacccaggctgtggcgcaatctcagctcactgtaagctccgcctcccgggttcaagtgattctcttgtctcagtctcccaaatagctgggactacaggcacttgccaccatgtccagctaattcttttttttttcttagtagagacgggggtttcactatgttggccaggctggtctcgaactcctgaccttgtgatccgcccgccttggccttccaaagtgctgggattacgggcgtgagccaccatgcccggcttgcctctctccctcccgtcctctcctctcccctccccttccttcctttctttctgtctttttccctccctccctccctcccttccttccttccctcttcttttcttttctctttctttttggagacaaggtctcactctgtcacctaggctggagtgcagtggcacaatcatggctcaccacagcctcgacctcctgggctcaagtgagcctcctgcctcagcctcctgagtagctgggaccaaggcacgcaccaccacatctggctcattatatttatttatttatttattttgtagagacagggtttcaccctgttgccccagctggtctcgaactcctgggctcaagtgatccacccacctcagcctcccaaattgctaggattacaagcatgagccactatgcctggccatttccaattttcaaacctaatgtttccaaaaccaattcagcaagtgagtttacacaaccacagtaagccatgtgaactcacggcagacaggaaggaattcatttgttctctcattcaaaaatggcttcttggtcaggcagtgtggctcacacctcccagcactttgggaggccgaggcaggagtattgcttgagtttaggagtttgagaccagcctgggcaacatagtaagactctgtctctacaaaaacaaaacaaaacaaaaaatcttagccaggcatggtagcacgtgcctaaaatcccagctactcaggaggctgaggttggaggattgctcgagcccaggagtttgaggctgcagtaagccatgatcatgccactgcactccagcctgggtgacagagccctctcaaaataaataaacaaataaataaataaataaataaaatccccttccttagctgccctcaacaactgatatctcaatattagaaaagagaatgttacagctagaaggatccttaatgttcctttccacccaaagaagctgacttgctcaaggttacagggccagttataaactgggtaagagattgggataataaagttagttgggatcgcgaagtgttcctcttggaaacatgaattttccaagaaaagggaaatcttaggccagcactttagtggaaatgaagttatctcacaagaagacatggacgcaaaggcagaggaggtgactctggaaaaggagtgacacagttggcacacttggccccttcgatggcactgcgtggtcctcccaggtgagaccagcattgcatttgtattcctgtccttcttaaaccttaagaaggtgctttatgaagtgggccctatgtctcttgtcctttcgtgctaggagaaatattaaatagatagaaaccccatactccatctggctggccgctgagcggtacacccaggggatgtaacttggagcaggacagaagtgaagtctgtggccttaatttcccagtgttattcaggttctcccttgggttctctccactagcagcagagatttccttggactcaggtaacactggtttaaccacccaagggctttctgtggctccctaaactgaggctcctccagcttctgaaatccctcttgccacctgcctgttactccagctgtttctctgggactaggcccaggagaatgggaaaaaaagtggaaaagaaacggatagaagcccattcctttgtaaccaaaagcaaaagttatacagaactcgaacggaaaaagagatttgatctgggagttttcccagaatggaatgcgcatgtattaaaacaattactgtaaaacaatgactgtcgctatcatttgtgagctggttgtggatttcaacaatcactttgctgactttttggcagtaagtgtgagttttcctgttctatgagacctttgggagtgttctcaaaatcctatgaaatcatctgactgcctacaggaaaccctgattggtattaattttcatcctttcccttttgatgttgaagtagactgaaacacttcctgcttttctacgttctttttctttccaccgctctcccatcccaaatggttatagtatttccaaatgcaaggagctagttgtggaaaattaaggaatagtctcctgttacaggctcaaatgtctaaggatcccaaaggggaaacatatatgtgcctttagtaaaaatctggatgtgttgattagcaatggctgcagaatttaaatacctttggtaggttgaaactagaagaaagtctcctcctctgtatggaatggtagctaagtaatggaagagcagacaacttttagactgagctcaaagttaattaaagctccttagttatagtctggggcatttgggtatatatttctattttatttgaaacaggattattaaatatttgttatgccaaactgaagttagaaaaatataaaacaatacatatttttaaattgttattatttatttttactagaagtgtcttgaatacataaaacaatatataaactatttttatgttcttgttaacattgtagagattttaaaaaattttagcttagtgcgtttaggatactcaaacctgctctttctttctttctctctttctttctttctctctctctcttctttctttctttcttcctttctctttctttctttttttttttttgagacagagtttcactcttgtcacccaggctggagtgcagtggcatgatcttgactcattgcaacttctgcctcccgagttcaagggattctcctgcctcccgagttcaagggattctcctgcctcagcttcctgggtagctgggaatataggcacccaccaccacacccagctaatttttgtatttttaataagagatggggtttcaccatgttggtcgggctggtctcaaacacctggcctcaagtgatccacccgccttggcttcccaaagtgctgggattacaagcatgagccaccaaccccggccaaatctgcgttttatttccaaatgttatatttttacattgcctaacttaattattgttttatttttaggtttagagtgatgttcattaatcttttttcaccctgagactttgtccttatcagcatagaatttatgattgaagcaaaaatcaccgagtctgaaactcttggtattatattgacttgttctgagattatgagtcccataaagttaaattggaactgtaagaacagctggtgtaaatggcattctgttctttttggataatctgcaactcgatagggggtacaaaaagtaataaaaatccacaggaaaaaatgcaggcttgattgttccctctttgtctgtggcaccctccttcgttagtagcttctgcacttcagggcaaggacatccagttcttttgtgggtactgcctcatctatcaactcttccaaggtacaacgataaggccttgaaaatagaatttagcaacatcaatgtttctctttttattagaaaagattaatcaacttttccaagtatgatttaaagtaggtgaggtttttgaatatttatctaattgacattgatctttgagttagagatagggctcagtaaaagaaagccaaataccagctttccaactgtagaatgacttaacgttcctgaatgatcagaagaatttgaataagtgaggcagcacttgaaaaataaaatataataaagtttgaagtctttactacctgaattatctgatagggaacctggcatgttcagggagataactacattaccgtggtgtgaagaattcagaccaaatggaattaaatgaaagacaagaacatgagcagtctggataatttagttaaccagtgatgactttgcactgatgtaatgtcatagataagaatgcttagctctaactgtaggatattttccaggcagaaaactgcagacgtttttggtatctctcaagataaaagataacttaagaacatacacgagacaattatatgtgaaaaaattaaataattttgaattttctgaaaatagttaaaaagaaatgtgagggaaagaaaataagagaagaacctcagattgcgaaataaagttgaatatttagagcaacttgctttctttctttcttttattctggaaaacattacattgtttttaactggggaaggagactggctttttgcagattaataatttgcttaaaagtttgcttaatttgctcctctgtgtttatcaaattataggtataaccaccaatccaaaatactccatcccttgctctcacataaagaagtaataaattttgaacaagcttaaaacgttaatatcacattggtcctcgaactcccttgtttgtgtttatttaccaggtcactttccttggatgaaagactacagaagaaatccacctttagaaagtcacatggtgtttttgatctaaaaggctactcatcatttctgaatcctcctagtgcttagtttagtgagtacctaatacgtatttcatcaactgaataaatgacttaaacatgcaagaagggtcaaagtcagaaaaacggaagagctggaaagaaatctagaagatctgggttctagtatctgttctacatattaattcaattttaaaaaggcttattgaactccttgtatgtgcgaggaattgtagtaaacattaagacacaaatgaagagttctgatctggaagatggcatagctgcagtttggtaatgtgcgtgaacatatggtgtaatagctacagattttagctagcagagaagaaaagttagcaaatttacaaattatccttttatatatacttaatttttaaagccatttacttaagattctgcctttattagctttgtatgccattaatagctttgtatgtcctcaagtttgcatttcagctaggaaggcaggcctccctaaaactttcacgtgctaacagctgtaattaaggtagaaggctttatttaaatagtaattagcttccagaagttgaagtgtaaacagaatgctaattcatttagatagttaattggtcttccgggttagagatcttagcgtggccttcctctttagctatgctgtatttatgtaccaagtatagatagtgtgttggctccgtgggatgttttgcaaactcttgcttgactcgcagaattttagtgttttagctcttctggtaaagactactgccaatgaatctgaagacgtgaaaacatcaagtaaaattccacggcaaaatcattaatatttgacctttcttttataattgtggggaccgtatggcccagtttattcatgttattccaatgtaattcttgatagttgcttctttcatgctcaagaatattttgatttggaggtaagttatgtggtcaccctaatcataatcagaaatcacacaacaggcagtgattgctgaaacaaaaggtgtgcatcaggttggttaccctttccagtgaaccagtgtcaaggtccttctctctgctgactgctgtaaagatggttaatgctggatgtcattaagtttaaaggtctttttttttttttaaggacaactactatatcaggaattttgtcattgcctttgccaacttgtgtggtctgccagtcactttcgctagatgaagaaaaagaatcactatatttgatagttgtgtgtctctgtgttgcccagtcctctaggggagttgaatgggaggtgggtctgatgttttgctttttaaaaatgtttcttttgcttggatgctccagctcatcagatgctaggctggctgctagctatttttccacatgtgcgtccaaacagacctgtgtaagtagcacatatcacacgaattcaacaaatactgaatgaatacagtggctggcacataggaagcattcccggatatttactgaatgaataaataccaaccttgcctttggtcccgtgctgggtgctacaagttaggtggtaggaagaaagggaggagagaaaactctatatgagatcaagtaggttctgccctcaaggggttaatagtctccaagaggaagatgtaaataaataaccgtaattgaaagtaagaatcattcagtgccaaaaagagtgggaggaagaggttgctgggcggggcggggcgtgggtggggggttggggggnnnnnnnnnnnnnnnnnnnntatgttaatagattcattatcaatcctatcccgttagaatgttaactgcaggggtggtggcgagggtggcaggggttggggggcggttagggatgcagggagaacttgaaggagaggcaggcattcaaattagattttcccccagtttagcattaactctggccccagttgcagtccatgaatgtggaagggccctcccctgccaggcgctgaaattgtgcacgagctattttttttttcttggctaacagctttcctctcacggttaatgactaatcccaaggagcattagctcactctgtaaatatgaaattataatatagcaaaatataacgctaaaagccatcaatctaattttagtcgcaaagttgaaatttcatagcaatagcattaaaagagttacattgttacgatttcagtcaacatataaatgaaataaaattgttctggcctggcgcggtggctcaggcctgtaatcctagcacttcgggaggccgaggctggcggatcacctgagttcaggatttcgagaccagtctggccaacatggtgaaaccctgtctctactaaaaatacaaaaattagccgggcgtagtggcagacgcctgtaatcccagctactccggaggctgaggcgggagaatcgctggaacctgggaggcagaggctgcagtgagctgagatcgcgccactgcactccagcctgggcgacagagcgaggctccatctaaaaaaaaaaattgttctactttaagaaacctaaaatgacggcttaatggcagagtagtattacgatataaagcatttaaaatgaacagaacatgcagatcttacttttttttttcttttcttttttttttagtgtattgttgctcacagcgagacagagtgttctgctacccacagggccagggcctcacacaaaccagcgggctctccagggtgcgcgcgcgatctacaacccgccccttgaaaaggaaagcggggcccgggacgctgcgggtgtgagccggaccggcttagagagggaaagtaacccgagtccgccgcttcgggcggacccgccccctcccacgagtttccctagaccctcggccccgccctctcttttattcggtttgcagcaaccggagctgaaactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagaggtgcgcgggccttgggggggtccggagtcctccagcctcggggatggggcggacgaggagctggggaagagggtacttggcccttcctcccggcgagaagcggtgagggcacagcccggtgacaatgcaaacttctgccgagtggcctgtgcgctcctatctctcgtacctgctccgagctcttcctttccagggtgcggattgtggcaagccgaggggagccctatctttaaaccagggagtaggggtggcctttctgtggcggttgagggctggggatgccgatctcgggactcggcactcgggccggggggcgctctccctgcctggccccggtgcggtgcccggcgacccgggggcccgagtgcagaggcacaaggtgcctttgtgtgggtgactcccgcgggacctcgtccatgccgcctgcccagagccgtccgcaggcgtgacagggctgtcggacaggtagagggagactccggcgggtccgccgagcctgtctgtttttgttggagaaggcgagagggccgcgcaaaagccaacaccaacaccaaccgcgcaaaagcaacatttgcgccagggagaaacctcgagccaggactccccgggaggcagtgacttttgctccgggaggcgccagtatccccggtggcgctgcattttcaggccacatgtaagcactgggaaggagaaatataattgtttggaaccactgtcttgattcatacaatatttgggatgaggaaggcagtggggctggggcggtgggggggtggtggggggaatgaagccaaggtagaagcttgtcctcctagctggctcgcttacttttcaatgtctcctacgatttcgagggaaaggtactagagtttactcaacccttttctgtactttcaagagaacaaagtccaccaagaacaatctgtattttcatggtttccccccacccccaacgacatctctgtttcaagttactatttgtttttctatctgctcttccaggtgaggaatggtgttctttctcagtaataactagaattgtgtagcgctttacagtttgctaagagctctctctgttattgtccttggtcatcacagtaagcctgtgaggtaggtaatactggtaagaccaggtcgtctttcaaaccgtcccacccatggctgcagcataatgaaaactgatcaccgctacatctcatttctcacgcctgtgacttacacatagaccacgtggaataggatgtccgaggtgtgtggggtgtgtcagtgggtatgtctgaccatttcctgctcctctgggagaactccttgagaacgggtttgtcaagtgagcagaatttcctggactcctatataaaatgaagctaaaaacaacacatgtttctgccttggtgactaggtttcccttggtaaagagtaagtggcattgccagtacttggtaggaagcatgagcttaaaagccatccatgcccacgctagcttgaaatgaggtgtgttcctccattcaagatgctgccaaattccctaggctggcagcttcctgaaactgagttgatatgtattttatctgtatgtccctcatagagccaacttgagacactgcaaatttcagctactgttgacttctagagccgctctgtccaacttagtaaccagtaccacttgtggctctgcagcccttgaaatgtggctggttagaattgcaatgtgctgtaagtctaaaatacacatggcatttgaagacttggtatgaaaaaaaagaacatgaaatatcttaatactttttattacatgtggaaatgatagtattttgatacgttaggttaaataaaatatattactaaaataagcttcacctgtttatttttaccttcttacatatgtctcctagaaaatctaaaataacacagggctcacatttgtggcttccattatatttctattggacagttctgctgtagcagaaagaaagggttacatcttatcaccctggcttttctgagcctctgccagcttagttgataatgtacaatcagaaaaatggtaacaggcgcacaggaagattatggagtgagatcttcacaccctcaagatttgtgtctggttttgttgttgttgttgttgttgtttttgtccctcttgggattggaaaaggagaagcgtaaaatcacatcctgttatgtttgttgagtatttaaaagggaaagtagattaaaacgtttttgttagccagttgccttgacgttatcagttagttgagttactttcatctaggaaaagttttctcctgacctgaaagaacatctatggctggctcaatacctacgatacttactaggttacatacctgtggttggcacttgactacgttatacaaaatgcctgtgcccttttggaccctgaaatacagcttagtagaaagacctggatacgttctgtgttcgaatctaaaaaagatggctaagatgataagaggctgcaatcttccaagttgcgtgacccattacttgaatatttctcataataatgatgctcaagtattgactttttaatgaactatcgacttacaaaagctcgtctgcttataggactatttttagtgctctttgctaatctctttacccaacctttattttataaatacatgctactgataagcagctcttcatgtagactttgctactcttggtattgcatgaatctgggtagggcgattatgagaaccatagaaggccttagatttaaaactgtctaaacctggccacagtcgacagctggatctcacctccttgttatttgacagatgtgtgccttaggaaagaagttcttgtctacagaatgaattaacctgtctggcttttattattaatgtttagctacactgtcaccaattttaccgtaatgttagtggatcctcagtaattattaagcagtgtgtcaggcacatgtctaagcattgtacaaatatcagctcatttaataggcaccaccacctttgaggtaggaacagttatttccattttgcagttgaggaaaccgagtcacacacagattgaccgatgtcacccagcagagcaggtggtttggcttcactccactccattttctcaggagtttcttcccaaggccacatctagaccacaccgacaatctttacatttatgaatagaacttcaggattcggtctgaatagcatatggtagcggaggagtctcatccagtatatgtctgtgttattctctatctttagttcatgtcagaaagttatttgtaagtcaaattaattcctagttcatggcgccttgccagtcagttcagtaaaggcctttgcaaagcaaatgatcttttacaacgtgtagggttagccgcacataacagaaaacccagtgggttaaccaaattggggttccatggcgctgccatcttgttcagccattcgtagcacatggcgtagggtatggcctggcacatggtgttcattttcatacttaatgcttcagtgcaaggtggcggctcctgcatgattgtcttcctattccaggcagaagggagtctcatggaagacagaagacaggtagcagccaagtcttcccctttaaagagttctttgaaaaactgtcaagtgacctggtttacatctcaggtgccagaaatgtcacatggccacctcatgcagcagggaaggctggttgctgtaatttctttctttttccttcttttgtttcttttcttctttctctttcctccctccctcactacctccttcctcccctttcctctcttttcctttcttttccttttcatttcttcttccttttttgctttttcccttcctttctttttttttaagtttggtacattgtggccctgaaaaaaacttggagtttggtcagaaaggaaaaaggggagaatagatattggtaggcaggcaacagggatttacatgcactgattttcatagctcagttctcagagtacacatgtgccacattccctacttatatccagccctgttttagaaaaagcattatatcttcattcctgtccaaccttcttaggtcaaaatctgaacttatatgaggtccttttctctaagcttgatttaaatatgagaaatttcattgtcaaatgcagctaccacaagtcgtttttctgctttaaaaaggccactggggagtgccttcgacgaggaagacgtgggactggttgtcccagcagaactgtcctagccttggctgttgatcagcctcgagtgggtaggctctcaacaattgtgtagttggccaggcgcggtggctcacgcctgtaatcccagcactttgggaggccgaggtgggcggatcacaaggtcaggagatcgagaccatcctgaccaacatggtgaaaccccatctctactaaaaaatacaaaaaaaattagccgggtgtggtggtgggcgcctgtagtcccagctactcgggaggctgaggcaggagaatggcatgaacccgggaggcggaggctgcagtgagccgagatcgtgccactgcactccagcctaggcgacagagtgagactctgtctcaaaaaaaaaaaaaataaaataataataataataaaattgtgtagttgagtcagcacatctctaaaacccacctttggtcccaggacagaagtctctctggccagcttctggtgctgctagtgttggtagcagtccccatcaccaaccaagagaaaagggggctttcttgctcaaggtctaagccacgggacttgctctttccctgtcgtgtctatttgtttatgacacatagcagtcttaaggtgcttgactatttggccatggaaagtctggaatttccaagttaactacagagatctgatacatcacaggtcaactgcaatgtactaccttgcactgttaggcccttcctgccaccgtccagacagaggcagttctttctgttaccttgattccagtttaggttataccttctcttttagtctctgtggtccctgggaaagggaggcctttttgttttagcagccgtaggtctaccatttggccatagttcagaaaagctcttcattccaccctctccttggttccattcactctcctgcactccagtgataaaattctcttaataacagaaaaacattgattgatgcacttattatcttggcagacgctgttctaagtgtttatttaggctctctcattataaaacttctttacttattattttttaatacagagatggggtctcactctgttgcccaggctgatcttgtcctgagctcaagtgatcctcccacctcggcctcccagagtgctgggattacaaatgtgagacattgcacctgtccagcctctttgatttcatccttagaaaacccagtgaggtgtttgaataatttccagcccatattaaagaaactgaagcagagagagaatttgctcagggtcccctaattagtagttgtggtctccttggggctctcctgtactccatcactttgtcactttgattacttgtaccagggggtggagctgaatggttcagagcatgggctctggagccggactcagtttgtatcccagttctgcttttgactgtgtgatcttatgtaagctctccatacatttctactccttgtttttattgctttctctcttcctttttcctatagctccaggacacaaactgttttctctgagcagtgaagtctttcataaggtgtattcttatcatccaggggcacctgtcagtgtcaaagagatttctctgccgtttaccagctggtcagaggatccggggcagaacttgcagctgatcaggaaggttcttgattagcggagtgataaatgcctcttgcaaatttcgtgagctttccttgggtaaattagtttgagccatatttcctcacttttaaaaaatagtacctgggcttgcagtgagcatggcataggatggtttttgctgtcaactgttggcccctgtctggtacctggtctgtgaccagcaacttcagcatcacctgggagcttgttagagatgcagaagcttgggcctgccgaatcagaatctgcattttaataagatcccctggcgattcgtgcacccatcacaattagagaagcactgttctagcacgtagctgcaaatgtgttttcaaactttgctagagtcctgctattgtagtattgggctatctggtctggtatgtactccagctgttttatttacattctggaatgatgacacttaatttgagaaggcttgtctttgccactaattaaagtaaaaaaccagtcttacggtgtgtgcttatatttataagcaccacctagcaacagcatcaggcaattcttagcaaaataagtgagacatttcccttgagatttcttccttattccttgaagagttcttataacagccttttttttttttttaaataagaggcagggtcttgctctcttgcccaggttagaaagcagtggtacgatcatagctcattttagcctcaaactccagggcttgaggcttgagtgatcatcctgtgtcatcctcccaagtagctgggaccacaggcacatgccactacacctggctaattaaaaaaaaaatctttgtagagatgggtcttgtggtattgcccaggctggtctggaactcctggtctgcagtgatcctcccggctcggtctcccaaagtgttggaattacagatgggagccaccatgctcaggaccaacccctgcccccctttaaaaaaaaatctttaacacaagtagtaagaagggagttgtggggtggtcagtggtcactgtggttgaagtttgttctcaggatcctcagtaggacctaggaggatgagatgggcttttggctagtcacactatcctatagttggtgaccacacggggtttaccacacttaactgacttttggtggagattttattgttgatgggaaatgacaccaaatgtcatttcaggaataaataaccatggcagttctaaaaacttggcacaaatatatgagttgcgctgagactggggtagctccatcctttatccatggagattggcaagtgacaactcctgctccggctccttcgtgcattccccttattgtgaggaagcgagaggggccctcccgtctgtgtccccatgcctgtgtcactgcctctcttttcacccagcgtgttgtcttctagctcccggacctgagcgttcttgccttgctttctctctttcctctcatttatgctatttctggcgtgtcatcactggcttacccattatgtaagctttaagtgaaaaaatcagatgttattttcatgagctctgagggcacttctgcatttgttctcatttgactcttctgaagcctggagatgcacaggaaggcagtttccactgcagatgagcagcatggaggaggcttttggaagtgaaatgaattgtccaaggtccagaggtgaggagctgggaccaggcctcacaggcttctgttctgtggtcctgtcccgtccctggtttctgctctatccaggtggtgccttctagttccttcctaaccaacaagtgtgggaggctgggtgtggtggctcacgcctgtaatcccagcactttgggaggccgaggtgggtggatcacctgaggtcaggagtttgagaccagcctggccaacatggtgaaaccccgtctctactaaaaaaaaaaaaaaaaaattagctgggcatggtggtgggcacctgtaatcccagctactcaggagactgaggcaggagaatctcttgaacccgggaggcagaggttgcagtgagctgagatcgtgccactgcactccaacctgggcgacaagagcaaaactccatctcaaaaaaaaaaaaagaagaaatatagggaaagccctttgcataacgtatggcatatgtgtggaattaaaagaggaaatacagggaaagccccttgcataacgtatggcgtatgtgtttacccacttattattcatgatcaataataactcaagttaactggtggtgtaattgggatatttttatttaaatgtttaatattgttgtggctgattgtcacccttcatgtgcttattaataatttatgacaattccattcacccttttgttgttatacaggaggtaagttaaatcaagtccgtcttcggtcttctcattgtttccttggacgctttccccctgttcttaggggaatcttctcggttttaggtattgttctaagtgctgggaatccatagtcccggctttagtgtggtagatgtgtgggtgacaaacgccaccaccaaccacaaaacagatgataagaaaatttctactgataagcataaatcagaaaataaagcagagaggtgaaggagagggactgggtgggggactcctttggatgacgtcatcagaaagcctttcagaggtgacatttaggcatgaatggtaggaaggaaccagccatcagaaaattagggagaagggcattgtaggagagggaataactcatgcaaaggccctgaggtgcgaaccggcttggagagtttgagaaaaggaagttgtggtggggtcatgagagcgagggtgggggtgatgggtgaagagcaggtgagagagacacacagaggccagatcatgtaggttcttacaagtcgtggtcagggaggtgcaattttttatttttattttttaatagttacggtggaaagcagagagtgacagtatttgatctgtgtgttgaaagatcagtcagggtttttgagcagaaatgaattcaggaaatccagctggaaggcattgcagtattctggaggcgatggtgtcttggattcaggtgttggcagtttcagcctttgtgaagccaagttctagttacagttgggtcattgacagcttccaatctcagtaatgtaaacattatatttgaagttgggatgtctgctcattctttcccctcctgccagggctaaggtagatgctctcctctgcccctggctcctctctggccaagtatgatggtcatttagaatagagagcgccctctgtctttctgccttgttcacatcattgttattttctggcactttttgctgcggctagtttctgaagctgtttattcatctatgaatagagtttttgtgaaattggacttagcctactttgttttctttgacatcaaatggctgattgaacatttttaaacctgggatcagaagggcaaatatggttgtttattaaagcaaagcagttccttagaatgcgaatcaataagatgtagaaattagaaagctttctatgtgaaaacttttaaagtatttgagtaaagaaactggtgtatctgacttaaaatattttgccctactgaaagactatcctaatgtttgctttagaaactatagctcccatacttttggtggaatagatggcattttgagaaattttcaacaagagctgggcagttttaaacacataatatatcacttctccatagaggggagggagtgggagagggaacttaaggagggaggctgataataaaataacctggaagccttaaccccttgctcacacccagctgtgagtcccccaaaaggagacagtctgtcagctccatcagaggaaaacccctacgtgctttctatcagaaaaggcggcgattatgataatctgaatcatgctttcctgaggataaccttttagtgaaaggaagcattctatttcctattttcagagatttgtggaaaggggaaattcagtgctttgggattgggagtggatgtgtgtgtgtgtgtgtgtgtgtgtgtgtgtttctaattttacttacatatgcattaattgaacaattttgcatgttctcacagtaattttatattacattgtcttcaggagaatcaagtcaaaatactagttggaatatgatctttgaaatagaggaaaactagcttaatatgtagggtggatcagacttcatgtaacacctgttaaagttgtcagcaccatcttaacagagataccaactggagtcttaaactaaccatgagcagatgacacaactgtgggtggcatttaggaaacgactctgtacactaaagccttaaattgttactaataagtatttaaaaaaacataaatactctttgctattaagatgcctggagacacatggtttgaagtggtttgattctaagcaccccaggccaatttgaagaattttacataaagctgattaaagaaaaacccttcctggagctggagaaattcttcattcttacttggatcaaatcagagatggacaggccgggcatagtggctcacgcctatgatcccagcacttcgggaggctgagacaggaggatggcttgagcccaggagttcgagatcaacttgggcaacatagtgagaccctgtgtctaccaaaagaaccccccacattaaaaaaacccggtagagattggcaccgtggaatagagaaacttaatgagtgtttaaaccaagcttttcaagagaccgtttcccaggcacatacatgcggggcgtctcaacatcctgtcaccattgttcttgaactcacttcttcaacaccagcctcacctgggaacatagacatgtaaattcctgggcctcaccccagacctgcagaatcagaaactctgggggtgggatccaggaagctaacagactcctcagggaattctggtacaggataaaatgggagaatcaggggtctacaccactcatgtggactctatggaaataggtgacataagccagactcttcctcataatgcctgtccacagttttttgctaatacataataactgattaagaaagacaatgtttccagtaaggacagtggtgacatatttaagtagatgagtaatgaaccttggcttgtaagtgtcctttctgcagaatagggagggaagagttaaagctggtatcccctcgggctcttagccacctgttaaaccccaggcccagggcatccttccgtcctgtccctgtgagtgctcagcccaggaacacacagaaggggcatgtttcatgggtccgaaaggacctgtttagctttcatgtggaatttccagacctgactcgaataggggagcagaatgtaaccccctcccctccattgcgagaaaatagttgagcttcctcacttagcactcaggttttggctttgaacaaagcatggagatgagaagtgagggaaagaaaaatcagaaaagagcaatactgagtcacaaacatgttgcatttcaaagcaaaaagctcttttgtcttagtaggtgggcgttgtgaacgttgaatcagtgtagatggaatttgaacctgtacttttggcaaaacccatgagagtccagaataaaaaagacactgcagaagtgaacaccaaagaccaggaatggccctgagacttgtaacaggaatcacactgagacttgtaacaggaattgcaaacacggttgcctataggggccaggaggcaatgtcagaagttgcagtgtgggggcgtgacagtagggagtggtggagactgtggcaaacccaaagccatgtgttgtctggtttctgctgattgtggatgtgaagtttccagagcttctgatttttgtcatttttttgttcttgtcaaatgaagctgtaaatctgggtttctatgtgacatttcccagtgttcacaaaattgtctatagcttttttttttttgacgtagaccaaacaaaacatatctatggaccagtttgcaatttcctctgtggacagccatggtcaggtgttaattgtccagtgagaagcgcacctgtaagatgtgaataaaattggctgcatagtaattaatcagctattcagtaaacttttttaatgtataatttgtttttcctatttacctaattccgttattcctaaaattgcaacatgtaattccatgcaggtattatttagccagaaacactcatgccctgatgtattcagcaaaccactgaatagttactcttcagggtaaaaacaggaattcggcttctcttggttgagtttacctccccatagtggctatataatattggcctctgatgggagctgtttgtgtttgcacagaaagttttcacatatcacctaaaatagggagtgtgcccccatctctgtgctggttagtggggtcctacgtaaattagtaagttatctgttgactcaaggttctttccatcttcaaggtgctctgcatcgggaaatgaagcaaacaagaaacacaccagcttcagttcttaatccagaatggcactcaccccaaaacacaattcacaaaacttcttaaacacaggagaatattgtagtctttcagtttgcgttgtaagtatacaggctatagagatacataagtgtatatacacacatatacagataaacataccatacatatttattgtgaatgacattttgataaaccttcattagatttttatttcaaccattagctccctttctaaaagctaaaaccaaaaaagtacaaatttccttttttgtaccaattactctgctttatgctagggacagccaggtgagttaggtgtaaatgaaatccgtgtccggaagctggcaatttagtagggaggcagcagtgagcagctgacatgtatagcatttctctctctctctctctttctctcgtttttgagacagggtcttcctctgtcacccaggctggagtgcagtggcatattcagggctcactgcagctttgacctccggggctcaagagatcctcctgcctcagcctcctaagtagcaggaaccacaggcatgcatcaccacacctggctaattttttttttttgaactttagtagaaacgaggtctcattatgtttccgtttcccaggctggtttcaaattcctgagctcaaaacgatcctcctgcctcagcctcccaaagtgccgggattgcaggagtgagccaccgcgcctggcctttatcacgattctttaagggccaggctcttgctaaggcttcccatgcattatctcatttcgccttcacaatgcttatttgatatcgggtgcttttatcatcttcatcttagagttaaggaaaccaaaccctgatgtgtctgagcttgcgtagatagcaaatagggtttgaatcaagaggcattagagcctgacgtctcccctagaggcacttaggtgggtaagtttggcctgataaaaggttttgaggatgagggaaaaacatttacatcattagcattatgaatcgcattgatctacttaattttaacctgtaatcttaccactcaaaattctagagaatagtgtatctacttcttttctctttttaatatatgattgggctcttgtaaatgggacaaggtggattttaaaatatatttaatggggactatttgacctttgggtagtcccttcatgtttttaggttctaatgctctcatacattaaaattctgagatgatatgactgtatatttaaaaaagacaagaaggaaatacatcaaaatgcccacattggttatctatagaggatagaatgaaagatggctttattctcttgtttgctcttattaaagcaatcagatggtgcttctcctgtactcagagccctggctgcttcctgcctggcctctcctgcgggctgctgtggaaccagaaaagccttaaacggaaatgtgggagagaaggttggattcactttcatgtctttccagggttgtgacccctcaagtcctggttgcctttgctgttctctattaccttcaaacagccagctcgtctttatttcttttttagttttgtcggggttggcttgatagatgttagtccatcatagccagatgtgtctagccttgtcttttgaatgcaagatttaggatgtgggtacttagctgttagtggacatcagagtcactagtcaggatgaaagagttcttggctttaactcccagaaattctggtaacgtcatgtatagtgacggccgcatgtctaacaggtggccaggtaagtcttttggggtggtctgtgaatcacagtttgggagacattgacttttagggagtttgttctgaattcactagataatagagatataatacagagctttgaaagctggtgtcttgatgacagagccgtggcaatggggagggttgaggaggtggctgttgggcctgtctcctggtgagagttgaaagggcctgaactcaagcagaggcctcagaaccgaaaggtggtggaaggatgcagcaagaggcgccacacaggagtactctgcgccctggcagggtctgaatacacgtgggagtggtgagagggagaactttaagtccaggttttgtgcctcagtgacttagtgtggccatatcattagaaatgtgttgaggccgggcacagtggctcatgtctgtaatcccagcactttgagaggctgaggcaggaggatggcttgaggccaggagtttaaaaccagcctggacaacatagtgagagcctgtctctacaaaaaaaaaaaaatgttaaaatgagtgggtgtggttgtgcacacctatagtcccagttacttgagaggttgaggcaggaggattgtttgagcctaggagttcgaggctacagtgagctatgatcacaccactgcattacagtttgggtgacagaaaagcccaaaagctatctctctcttaaaaaaaaaaaaaaaaaaaagtgttgaattctgggaaggagctgctatgtgggtttaagagtgagcacaatttacagataccaatctcaaaagctgttctagtttgtagatgatacatcttccttgataccaacaaagatacttccatgattcaaacatttaagaaaatgcagtgccctctcttattacagcattctaattgtgtcatgttgtaatgaggtgcaaatatcatgcagcctggcacgcgaaatgtgttagaatagggcagtgttagttaaaattcaggtcctcaagcttgagtgtgaaatgatgcaatgtacatgaatatgacacccggaattatttctgtacaatgcagcctaagtcatcgactacaaaataaaatcagaggattagagacctacaggacagcatgtcaatggagatctaaaatcagtgctgatcaatgcaaaatgcatcttggcataatccctgaagtcttggccagtgcttggagagataagcagttctggctaacataactggctgcagttggtgtttgggtgggtgagccacttccctgggacttgtgcctccttagggttgccaaggcaagagggtgaatagaatactgacaggggaggaacgggggtgtgtagggctcttcaaggtttggtgctgaaggaagagggtggcagagggtggaagggtggcctgttttcttattcatcattggcccaataagcccttagaagtagaggtgatttcttctatgccttctctcaggttaggttaataaatcctttacttaataggattagctataaaatggtagattgtttttcttataaattatttttcttatatttacctttctccgtgttctgtttccttgacagttctattaaaacttgctaatttctcatgtctgattttaaaattaaaacaaaccccattgatacagtttggctgtgtccccaaccaaatctcatcttgagttgtagttcccataatccccacgtgtcatgggagggccctggtgagaggttattgaatcatggggacagtttcccctatgctattctcatgatagtgagtgagttctcataagatctgatggttttataaggggcgtcccccttcacttgcctcttattcttcttcttgacctaatatgaagaaggatgtgtttgcttcctcttccaccacgattgtaagtttcctgaggcctccccagccatgtggaactgcgaatcaattaaacctctttcctttataaattgcccagtctcaggtatgttgtcatagcagtgtgagaacagactgatatattaatttacctggtattctgaaatgatgccacttatctttcttattaatcctagctagctctggaagtgaagctttcagtggagttcagtgtcactggaacacattagggggtgtgatgtggtttggctctgtgtccccactcaaatctcatctcgagctgtgatccttaatgttggaggagggacctggtgggaggtgactggatcatgggggcagatgtcccccaggtgttctcgtgatagtgagtgagttctcaagagatctgattgatttgacagtgtatcactttcctcttggtgctctctcctcgctgctgccatgtgtgcctgcctccccttcgccttccgacatgattgtcagtttcctgaggcctcccagccatgcctcctgtaaagcctgcagaactatgagtcaactaaacttttctctgtaaattacccagtctcaggtagttttttataacaatatgagaatggataaatacaggctaactccaactcccctcacccattgcctgttaactaaagtgcccagttaattggcacttccactaaggctggagaaggttgctattcactgtgcattcattaaacacatctattgagtgccttctgtgtgccatgcactgttctgagagctgaggatgtggcaatgaatgaaagagacagcagttcctatcttctcggagctgatattctggtagggtagaaagatgattgtaaaattcatagcacgtgaatgtgatagaggtcattaggaagggccacaggtggatttggaggagtggggatgcaattttaactaggatgaccagggaacgatttcacagagcaatgtggctaatgggggaagaatgttcttgacaaagggaagagcgagtgcatgtgtcctgagacggtcagtgttcctgaggcatcctgaccaaggggaagctgagggtgtagagccctagagacctgatcagtactttggcttacagtcagtgttttggggagctattggggggctttgagctaagaagtattatcagatttacatttaaaaatgataatggtggctttgcaagggtgggatcagggaactagttcggatgccatggcaatagtcacatgaaagagattgagaggtggccaggttccgggtattctgaaaggccagtaggatttactgagagattgaatttgagtgtgagaggatacccttgaagtgtttggtccaaggaattggaaggatagagttgtcatctcctgagaggtgggagaagcaggttaaggaaagatctgtgttgtttttttttttgttttttgtttttttttttttgagacagagtcccactctgtcacccaggctggagtgcagtggcacaatctctgctcactgcagtctccgtctcctgggttcaagagattctcctgcctcagccaccctagtagctgggattacaggtatgcatcatcacgccaggctaatttttgtatttttaggagagatggggtttcaccatgttggccaggctggtcccaaactcctgacctcatcaagtgatccgcccatctcagccttgcaaagtgctgggaagatctggcttttaattttgcagtgcccatttgcccaccaagtgagggagatggtgggatatatgtgttgggattaatcagaaaggttgatactggagacaaatttgctggccattggggtgcagatggtattaaatctttgagactggatgacctcaccaagtgagtgagagtagggagacaaggaaaggaatctagggcatcgcagcctttagaaatctgggagctgagcaaccagcaaggattgcagtgaagttgctgccagtatgtaggaagaggaataggagagggtgatggccagaggcaagcgaaggaggtgttcccagaacaaggtagtgatcaactggggcaaatactgctgtgaggtcagtgagaggatgactgagaattgactattgtatctagttagctgtgtgcaggttggtgaacttgacagggtggttttggtgggttggtgggacacacagctgatgagtaaattcaagaacaaacaggaggagaggaatcgatgtcctaagaaaccacctgctcgtgaagcacctccctcaatgcacacagctctttgtattctcaggatgctgaatgcgttttattttaattcctttaaaatctgtaatcagctgtttggtaactagatatctgataaatggggacatgttatgccctccctgaactgggtaacaggacactgtagattatgcaatcccttattttaatactaacaatgccattcatttagtgaatgactatgtactggtggcttctacagagaagagttattcagcagaaattatctcttcatttttttttttcacattgttttggaaatgaagatcaggaaatgagtaaatagctctctctctgagtttggtgttattctataattacccatgtaagtagaaaagatttgtaatggacagatccaaaaccttggaagaattccttgttattaaggatttacctttatatcttttaagatttatctgaaacattcagaatgccatgaaatcatatgtatgtcatgtctggtacagaccctaggtggaaggcatttgttagcaggaaaactggtgcaactggagagaaaccaatcaacttgaaatagaattcaccagctgtttattgagtacctaccgtttgtcaagttcttttctaggtgcagtgaataagacaggggctgtctttgtttggtgacttcagttaagtggaatacagacaaatcaacaggcatttagactacagggcatcatagaagtgcagagggaggagtatctcatgcagttatgaatgggcgccacaagagaaggcttcctggaggaagagacatttaaattgagacctgggccgggcgcggtggctcacgcctgtaatcccagcactttgggaggccgaggtgggcggatcacctgatgtcgggagttcaagaccagcctgaccaacatggagaaacctcatctctactaaaaatacaaaattagccgggcatggtggcgggcgcttgtaatcccagctactcaggaggctgagtcaggagaatcacttgaacccgggaggcagagggttgcagtgagccaagatcatgccattgcactccagcctgggcaacaagagcaaaactccatctcaaaaaaaaaaaatttaaataaaataaatagagacttgtaggatgagcaggaggtagctctgtctagggcaggagaatgttcttggcagaaaactgggaggcaagagacagcatggcattttgacattgtcagccactgaaagaagccgatgtggtggctctgttgtgaggtgaatggaaatagatgaggctggagagtcgggagtgggatgttagatcaccaagcccctctgtaagtctccaagcaggtgggatccaaggaaagaatgaagatcttttcgtggccttcctttgtggaggaactgtgtgtgtatttgtatctatgtattgtgtgtgcacacatataatagatacattatacatattagatatattgtatacgtatatacacacacaatacacggatacatatgcatattatatatcatatatacatgcataatacatatgatatatatacttagatacatacatataaatatgcatacatgtgtatttattttttagggctcattatttgattcagaattctatcaggcaggcactgtcctctctttaatgggatgtagcactaactgggttttagacctgcagtggcccagtcaccctactgtaggggaagctcctggatctccaggggaaatgtcactgaaaggctctgtgcaaaaaggaacttgacttactgggtatttatttcctttgatctgtgaaatgtaaaactgagctgactttaagcataagaaaacattaaaaactcttcattaaagaaagaagaaactactaacacattgacctgagctaaaaaaaagagatgggagtttgggctgacagggagtgggagaggaaaggggagccatgatgaatggagaggagggagactggggtgggggaaggcggaggagcccagacggcggaagtttggaggggagtgttccccggaggtcacaccttgaggtgtgggtgttttctgtgttatcacctgtgatctgctgccccttgctgatgaacgattaggaattgtttctagcttagtatgtaatttagtctttatatgttcagagacttcactctggtgggataagccaaagcatagcattggttggaattttttctctggaagtggttagaaatatcaatcatctgagggttaggattccctaaccccacgcccccaaagaagggtacatgtaagataaacaatataatccagtatttccaacagaacactcctcatcccccgatttcagtgtacctagtatttattagtatttatacccatacgctaatatacaatagagtgactttgtttgtttgtttgtttgtttgttttgagatggactctcacttggtcacccaggctggagtgcggtggtgggatctcggcttactgcaacctccacctcccgggttcaagcgattcttgtgcctcagcctcccaagtagctgggactacaggcgtgcgccaccacaccaggctaatttttgtatttttagtcgagatgtggtttcaccgtgttaccaagactagtcttgaactcctgacctcaagtgatctgcccaccttggcctcccaaagtgctggaattacaggcgtgagtcatcgtgcccagcagcaatagggtgactttacaccgaaatcttgaaaatacatacagtgagcatctcagacacaggcccaggggaatcatatatttgttgtaccagatccagaagcagccatgtgggtatttatttctgagttcctgaaccctgtaagaacacacaggttatacttgaaatgaatgggaattgattaggcagaatgaaaaaaaactcaaaacccacaaaaccccacctctgaagggtgtggccgctcgccctcccctttgtgtcattttccagattgttcatgtggttgaggttgtcgcatcattcctggggttaaacgtacactcagttctgggaaagcttccattttcaacagtccaaagttagaattcagtggaatgtgatttgaaagtaatttaacaaggtacattttaagtttttaatagttacctttttaaaaaagtcccaatttttctgctcctgtcacccctgaccccagtcatgatttctgagtatatgatctcttggaggacatggatagctgttattttaactttgaatttagcatcctcatctgtatattttagcaatttgaaattgtgttttgtaactttttttggtatcaattgttttcacatcctgagggtgttcttatttcttttcttttatcttttaaaaagatccatccctagaatgaatattgaaaaaatatttccttaagatagcatgtggattagtatctttttcgtattttcagattttaagatgaactttaacttgatatgtaatgttccagtcatgctgtagaaattccatctcctaaagtcatgctctcatgaattaaggagaaaaggaacatttcctaagagtagtaactaataacaaagaaataaaaaagtacaaatgtccataagcaaccttaggaattcaggaagaaatctaagaagaatctgccttgttaaatgaaactgtggtagacttcctgggagtggtaaatgatgtgaaatcaatctgttataatgacttaattgtcatcaaaagatctcacaccaattttgtgggttaaggttggtaattatcatctttggtggtaattatgtaactataacattataaaaacattataagactaccttacttttcttataaaagcagattgcatagtttagatcttatcgttgttattgctagttttgtttgcgctttacagatctaaagttatagtgagagtgacatactgttgataagatgtaaagattagagttgtttggtttgttttttgtttcatgtagttaacattcttttttctcttttaaaaataattattttcatctcaaagtcaagtgatagtagtgttaacatttgtccttgagatggtcaaggatggcatctgtttgttcaaattagggccctggcaataaaggtctttggtaaatatttgacagggaagaaggtaaaaccctaaagtctctttgtccaacaaagttggaatcagcctataaaaaccatggctctggcttcagcgcgtctgttttgggtaaaggtgggagcacatgcctgtagttaattgcctgcaatagagaataattgttttacttttagggattttgcctggagagaaaatgtattcatgtgtccattcattcacagtctcttcctgtctctgttggggctggataaatcagtgtgtttgtgggtgggccgttcctcattctgaaacattgtggctgctgcagggtgacacagtactggagaaccagggctgttcaggagctgcccaagtttggatcctttactcctctcatggttgcctgacgttggccaatttatgtacattgtttagtcaactagctcatctttaaacttggaatcatgctgttactaaactttcaggatttgttttcagggctaaatgagataatgtgagtgaagcatttatcataatatcagccatattttaagtgcttaataaagcctaggtgctacttttgttgcatagaactcaggcatatcctggaaaaaaaattcacatcttccaacggggtagtttcaatctcaaatcaaacaaggatactctgccttttataaatagtaaactgcccattggtgagaggaatggtaaagagaaaactggatcccacatcctttatgcagtgtgttaatatgaaatggtgttgaaactaaaaatacaaaaattagctgggtgtggtggcacgtgcctgtagtcccagctactcaggaggctgaggcaggagaatcacttgaaccccctcaccacctgcccccgcaaaaaaagaggagaaggctgggcacagtggctcatgcctgtaatcccaacactttgggaggctgaggcgagaggactgcttgagcccatgagttcgagaccagcctgggcaacaaagtgggatccctgtctctattttaacttaaaaaagtaaaaatttttaattaaaaaatattttaaaaaaagaaaagatggccaggtgtagtggcttacgcctgtaatcttagcactttgggaggccgaggcaagcggatcacctgaggtcaggagttcgagaccagtctggccaacatagtgaaaccccgtctctactaaaaatacaaaagattagctgggtgtggtggtgtgtgcctgtaatcccagctacttgggaggctgaggcaggagaattgctggaacccaggagggggaggttgtagtgagccaagatcgtgccattgcaccccagcctaggtgacagtgcaagactccatctcaaaaaataagataaaataaaataaaataaaataaaataaaataaaaattagctgggcgtggtggcccgtgcctgtaatcccagctacccaggaggccgaggcaggagaaatcactggaagccaggaggcggaggctgccatgagccgagatcgcacgactgcactctggcctgggagacagagtgagactccgtctaaaaaaaaaaaaaaagaaaaagagagagagagaaaagagaagacagttgtacctttttaaatgtcatgctgtcgaggggtgatggtaagtgagttcttaaatgtctttcctcagttcttccactagcataaagagacctgagggctggcgatattgacgtgtagagtaggcattacacggccgaggggaagcatccacaaaggcacacccttgaaggccatatctcttgttttaccatagttaatacccaacacttactacatttcctgctttactgctgcttttgataactggtgggtgtggcagtaatacatgggtgtgtccacgatgtagtgggtatgccagtgagttattgtcctggcagaacagccccagatggaaggtgtcccgtcgcgccaagcccaattaaggaaaccagcccggttcttcttgggagccaagaagttatttggaaagatctgctcctataagcactgttgggagtaacttatagaagcagatcttacagaagcaaccaccagaagggtgattacccctgttccttagtcaccagagttgcttcttcagtttccaaatcacagaaagtctcaaacttctcaagggacttttagattgcctgtgcagcgaggagaaagaatgatgcccaccgtgtcaaagaggcgccttgcagggagtaacctggagtgacgtgaatcacgctgttcgtattaagaacagatttggtcttatggtgagcaggactcatacctgatgcgttttgggaaatgcaggtgttaaataaaaaacttaaaagttgacctgatttgccttttatagatgaaggagactttttgtaaggcatctttgagccaggggaaaaaactgtttctatattttattcagtgtgtgcctgtttctggaacagagctttagtaagtgattaatgtagaaaagttcttttaaaactggaaaattctgtatgcgccaaagaagcccctttccaaccctttagaaacacatataatttcttctagatcagtttccaagttaatatttgtctaatttttgtgtgttgagtagtacttttcaaaagatatttgtaagatacctagaccaatcctctcctcccaaacattataggtttggaactctgtgtagggagatgtgattcataattaatgattcatgtacatcatattttagatgctgtcagttttcaaacttgtactttgaacttaaaagttgaaaaaatccaccaaaaattcccataaagagaagttaaaatccaagctaattggcagctctgccttcagtggaattggcagtcttggtgtctgagaaagcagtgatgatgaatgaagctaaaaaccacctctccaaaggcctgagacagggaggtcagtagcagctaccagacctgtgtggctattcaagctttcaagccttaagacccagcgtgggccatcagtgttcccgtgctggttaaactctcaaagaagcttcgcctccatccagatggtaacaattgatttttattttcaagtatttattcattttctttgggggagggggaaggggataatcatatttaggtttgagatgatagagacaaggagtatcttttttttttttttttttttgagtcttgctctgttgcccaggctggagtgcaatgatgcgatcttagctcactgcaacctccacctcctgggttccggcgattcttctgcctcagcctcctgagtagctgggattacaggcatgcaccaccatgcccggctaatttttgtatttagtagagatggggtttcaccatgttggtcaggctggtctcgaactcctgaccttgtgatctgcccgccttggcctgccaaagcgttgggattacaggcgtgagccactgtgcccggccaggagtatccttatagtgaacaaatactgggtatgaggcagtgctcagatgcaaatcctgttcacgttggtgaactggatgacagcctgcgtattaggtatattaagatgtttcttgacttctgttggttatataacaagagcaggcatttttcctaggactgtggtttcagcactatggattccatgttttttcttccatcgttaagtctaattttgagggttgataatgaccttcgatcattcagtccaaatattttattcttttgtgtgaataagttattttgtcgttaatgacattgtggcccagagatttaagtggcaggacctagactagaaccaaattctctagactcccagttcagaaggtttgtgattatactatttttccatcttgctctgattggccccctttccccagatcccataaaacctatggctttgtaggtcccatccaccagcaataatgtggcacatcctagcatttttcctgttctgtagtacagtcccaatcaagaagccttattaaccttctgtgtgagggactagactcagtgttgggtttggaggatccactggtgaggagcattcagtctagcaggagaaatgtcagcattatttattacacaacaagatctgatgcattcagatgtacttacaggtctaggaactgttcagaggagcacaaatgaatgagagagagagggagagagggagattgagtgagttagagagttgttggtgctccacaaggagcagtaaagtattttaaaaataaaaaataataaggctgactctgtgtcctgcctaggggttggccatgctccacaaaaagcagtaaagtgttttttgttttgtttcgttttttttttaaagacagttgcttgaggatggttttcgaggataagcgccagccagatgaggggtgagggtaggggacttctaggtgaagtgatttagaaaactaagaggattctgcccattggtagtgctgggcagtgaagttggttgtgcgtggcatactgtcaagttgtagcaatcactaggtgtactcgcactgttcctcttctccagcctgattcagaatggaaagaggctgccgagagtgcatcagtgatcttctgttttcttacaggttaaagaacgttaaatgtctgcatatgatggctggcgtgatgatgaacaggctgtgactagtgtggattattggatacctagaggctcagtggcctaggtgtgatcaggaggaagggttagggagaatgctttggttagactcaaatagaaagacagcaggctctgtttgagacttcctgtccttcgtccaagatgccactggggtaaaggtgtggatgcagctttgcatgtttagcttctggaaccagacagaactgcctttcagttttcctggccttggaggaaacagataatgaatgctaggaaacagctgcttctaacgtggcaggcagaaatgcatcctcatggagcaaatcggtcatcacaggaatattagtggaaaatcatctctgattaaacattcaagagctatggaatgtgatttactttcatatattcacccttccccccattatctttccgttgcctgtagatttcatttttatttgtcaaataatacagaaatactttcttgtaaaagaatatttaaacaacagaactctagataggttggaaaagatagtcccctttatgctatacccttctcctttcccagagttgggggtcagcaccttctggaacccttcctagacatttgcatacatgtttattcttatttgcacataatcattgtctttttgtaaatggatttctgcacagtttgaatctgttcctttttacattgaatactgtcttaacgatttctctgcatcactatatttagataaacctcaaatttttagaagtagggcttatgcaatcaaacttaattaactttattaatctaaaaaataatctaaaaatctaagtgcctcttaggaacagaaaggtgtcatggcccacccactttgggactggatggtggatttaggatgttttgtggcaggctggcttgcacctggcaaaatatcttgggtcagtctaacaagggagaactgatctcctgccctgaaagtttattactgtggcaccagttctgcttaaaacaaacatttagtcttcttttaaggccaggcttatattaaagtgcgaggtggcctgataaacaatctctgagatcccttaggcatagggagaatgtgggacttgtatctttctccgaagtttgtttcataattttacaaagcctatttgagagaagttggtaaggttgacccaaagggcaaggtaacttctttgaattttagtgccgagaagtaggacacagaattaataagggggaactctttggaaggggtcacggggcagataattgttctgttacattcatgggctgatgatgtcattggaaggcacttgatgacagattggtagaactgtactgtgcattagagcttgccaccccagcaaacccactgatgggacttggtgttttggttactccctgaagtacagtggcagttgtcccgggagtagaagatgttcttggaatgctgtcattattaccttggctcacgttatttagaaaaagaggaagatgccttcttggcctgataatgtgacagccacctgctgtcactcatttttttcagtgctctgaagatgaccagaacctggtcatcaggtctcctttaaaaagaacaaaacacagacatgcataaaatcatacagcataaaaggatgatgtcattctcagggagacagggcagcatgtgcctgtgttcctcatctactcttgaaggcatcaggtctcttctatttcacactgccagttgctacctaaaagagggaacttctcgaggagagatggactttcatgctcagtgacttagaaactgtgttagagctgactgctatcaaataagcataagactgctataaataaaatagataaatatcaaacaagcacaaataaataagcaaatacataagcaaaataaataaatatcaaataagcataagactgctatcaaataaaataaatatcaaataagcataaataagtaaataaatatcaaataagcataagactgctatcaaataaatatcaaataagcataaataaataagccaaataaatatcaaatatgcgtaagactgctatcaaataaattagaactgactgctatcaaataagcataagactgctataaataaaatagataaatatcaaacaagcacaaataaataagcaaatacataagcaaaataaataaatatcgaataagcataagactgctatcaaataaaataaatatcaaataagcataaataagtaaatatcaaataagcataagactgctatcaaataaatatcaaataagcataaataaataagccaaataaatatcaaatatgcataagactgctatcaaataaattagaactgactgctatcaaataagcataagactgctatcaaataaataagcataagactgctatcaaataaatttcttaaagatatgggatcatgcctggctttaaaagaaatagtaattgcgagatatggtggcacatgctcagtgaactgttttaatctggctttcaaggaaactgggctttatgggattataaggaggtcaagaacgtggtatatcttctgttggatgtaaaattgatgtttatagttcagtagtgtcacttctttgatagtgggcaaccagggacacgctcacatgatggttaataaaggctcttcagacactagatttaaattctgcattcatccatgtagtaagcattgactaatttaatcgcatggagaatgagccagggagacagctttgttttcctgtatccatcctgctcatgagactccgccgctctcaaaggctttacctgcctgcctgcggaagtcacacacaccagaacaggtgccccacctgctgtagggggaaagcagagccagtctggggcaaagtaaaataacccgtgttgaatcctcactctagcactcaatggtagtatgaccttgagcatttagcccttcggagcttgctttcacatctgcaaagtgggcataataatacatcacatggctgttatgagcattaatgaaacagcaggagagagtgcccagcttatgttgtggaatacagaagggctcaggaaatggtacttgttatttagacatttaaaagaaaacattccttttcatgaaatgagacggccccagcaccagacatctggtgcctggttctcaacactgtacaccatagataactttccgttcctgacagccaacaacgagaaagtttacttcccccaaaattgttcttctggaattacagccattctgtgatttatttgcctctgttcctgccccacaagggccactgcagtgcagttaaacccccagtctgttcaggggcagaactaatcttaaccaccgtgtgagggagtctgggggctgggagaaactcacagtgtacagttacagtaagttgcaagaataaaatctcacgtgactctgggacaagttttaaattttaaagtctcttccaggtgctttctctggaacaacaacaacaaaaaagttaaaagctcacgtaaaaggacactttattttttttaaaagagccatcttgaaatatgtaagcacaaacatttcccaatagagacgtccataattttcgttctgtgttgcacattctcgtcttgaattgtagtggggggcctcgatgtgtgcagtaattattgtcagtccttggttgactcatgcattcctagctgtcgcagtgagatctgtgtttatgtgaaatatggaaacgatttttacccccgctttcttttgtgcttgagtttggatggagcagctgaatgctctttctttgttatttttagggggtcttcagttttggagctctagtttaggcttgaggagggccagctgtcagcgtggcttgggctggtctttatgagatctggcctgtgtttctgcagttagaacctgattctgaatccaactcccttccaccgacatgggaggctctcacttctacaattttatttgcctcacattgaaaacagaatggaaactcaagtaacagtagtggaatctgcactgaaagaatattttttttttttttctctgaatccatctcctttattgggagccatttgtcttgagtcctggccacttttttcctttttacttccaaatgactttctgtttgggtgttctaaggatgggggggtataggctgtgtttttaaagctcagagtttaactacagaaaaacaaaaccagaaaagaatatgttcctccccctttttaaacaatttgtcctccttggaaagaaagttttactatgtagaatttaggaaatgtttgtgaaaatgatcacaggctgtaaaggagtgtccaagctgctttcattgtggccagcatggcattctcatgatatctgtagcaagcctttaagtgtcttggcagatagagtttcttccttcacagcataatgtttttccaactgcagtgttgtagctgcttcatgtgccgtgatacatggctaggtgtcaagatagttttacagggggaagaacccaaaaggacttttaaaagatgcaggtttcaggaaaaaaggagagtgatttttacaaagggagttttaaataaaaaggcatttgtttgtgctttcttcatgggcagaccttttcaaagatggcattgtaaaaagaggatgtgcatttcattcctttattaacagaggccctagaggcacggctgtcttgaaggacctggggctgctgctatggagatgagtgtcacagctccgggactttaaggaactccactttgctcaggcgtcagacacatgaataaacacggtgcagtccagaggggcagaagggagaagtgatgaatcttgctggtgaggaagctggtgcgtggttggtgtccagagaaggcctcaaaaaggaggagaagcttctggggagccttggaggatcaggaggagttggccagaccagataggtgtgtgggtgatgctgtaggcagaagaagagcaaatgcaaatgcatggagtgtggaagcagcgaggtgtgttaggagaaggaatcccagctcccgaggctggagtgcaggttgcaagaggaggacgggcggaggaggagcttggccagcaggcctcgggccagctttgggaggcctttgcttgtcatatggtcatgtcattcaggctgtactcacctttcttgagaggacttcttggataagtgccattctgcagccccggtgcctgccttagccttcttccaagcacttaccgcctgccctgttctgggtttgtgtgttcgctgcctctcttccgtcataaggacggaagccccagcagagcaggacgttcttctgtgatggctcccctggtgcctggcggtgagtgatgttaggggatttggactcatctttgtagtgaatgatgggaggatcactgaaggtctaaatcaggggagtcacatgagtgcatttgggtgtttgaagagcagtgtggatggcaggagagctgatgacaagtatttagggagagcctccatgcacattgattgggagtccattagcagtcctgctcttcaggctaccttgggtgggcccaagctttgctggcctagttaattaccaatagctagtatcaatgtcattccatcagtgacattttgaaactactagaaattacagagaagcagccagacaccgtggctcacttctgtaatcccagcactttgggaggctgaggcaggtggatcatctgaggtcaggagttcgagaccagcctgaccaatatggtgaaaccccatctctactaaaaatacagaaaaaaaaaaaaaattgctgggctttgtggtgtgctcctgtagtcctagctactcaggaggctgagacaggagaattgcttgaaagtgggaggcagaggttgcagtgagccgagattgtaccactgctctccagcctgggtcactctgctcaaaaataaataaataaataataaaaataaaaattacaaagaagctcagaatttttttttttcactctgcaaagctgatagctgcccaggtattccaataaaagccatgatgttataatgttacaatcatttttgatagttcagtgattgaaaaatctgaaggaattgtctttttttgaaatgctttgaaataaagttggttctttatgtaaaaataggtttttttaggtccttaaattggcttcaggacatcctgacctcacagccatgtgcatttcatagttgggctatttgcaaagttaaaagaagataagaaagtagacattctgcagttcttctgagagaattgatatgatgtctcattctgtttgctgggcccatgagggaatgaactgtttcatatatagggattttcctgataaccgaaccttaagacctggtttaaggtctttaaacctggatatttttaagacctggatatttttaatttttccctgtagttttggatggaaacctttctaaaataaatttttaactttttgggcttacagagtacattcaacctgagttaatgatttcttcattccttgcttatgaaagaatgaattattcagaatcactgaagtgtgtggttaccataatgacagggcctaccgatactcgtatgactactttgccgagtgaccccagaatgccatgttttctaagttactgtccttggcttttaggtaaccgatgctccaagtaacacacactggctcctcttttggatttactaaacttgtctctcttgaaggctgggaaacaaaagaacttttctgctttctaaaatgagaacaaacaggccttgggtgaaggtctgtctttttttttttttttttttgagacatagtttcgctcttgttgcccaggctggagtgcaatggcacgatctcggctcaccgcaacctccgcctcctgggttcaagtgattctcctgcctcagcctcccaagtagctggggttacaggcacctgccagcacgcacagctaatttttgtgtttttagtagagacagggtctcgccatgttcgccaggctggtcttgaactcctgacctcgggtgatccatccaccttggcctcccaaagtgctggaattacaggtgtgagccaccgcgcccggcccgaaggtctgtcttagaaggccttaagtcaagcgaatgtacttgatggcataggttttatcatatctttaacatttcaaagaaggaggactcattttgttttttcaagtctttctaacgctgaaccatccatatccgaaaaaaaaaaatgatattattacttctgctggcatcactgctgggtttgcagggtaaaaacaacacccccaagccttcttacactgtttgcctagaggtcccctggcttgccttttggttccaagttgtgtgaggtgaggtgttactgtacttaaggtttttttatcatctttgacaatggtggttatttattggtcgtcgaccacgtgtaaggcactacaaacagcacagggaaatgacttctttctagaaacttacattctagtttggaggaggacgtagtggagcagagctagccacagtacttggaatttgtcagaggtgcagcagggtggctccgccccaggaaggcctagggctggggagtcctcctgtccccagaagactgacatttgactgagagtgcagctttcagggggacttggatggagctgagagggagcaagaggccctgggaaatgcccaatagcagaatcagccccatctgtcagcgggtggcataaggtggccagaacaccacacctgagttgaagcttgtctatacatgccggtgggtagggaggacagcaagggccgcagcagatggaggaggtgaccatttccaccggggagggggcgtgaaaacttcatggatgagggtggattattgctgggtcctgcctaatgagcacagtgctggattggagaaggggagggaagggcgcccagggggagagatggtggccaggagggacgaggtggagaagggccaggcgtgtgttgtaactctgaggtgctggcttcttagcagaacttgttctacctcccggcttctctggctgagcctcccagtgggaagacaatgggttctggagtcggatgggcctggacctcaagaccagttctaccactttttagctgtgtcatcttcagcaatgtccccagtccctctccatcagcttcctcgtgtacaagggagatcaggagtgatcttgcagacttttcagaaggaaaaaacaagacttagatttaaccatgaacaatgtaaacatagtatatgctcagtaaatggtgatttccttgggccagctcttccgcagggccctggtctggagcctcctgaggcccgcagtctctgcccaactttctgactcactcacagccactgtcaagtcagcaggcacaggaggaaaggcatgacctcatcttcttcccacacttctcctctctcttttgtgccacattttctgtctagtgtagagtttgaacctggtccaaacccttggcaccctctttggctagtttttgcctttcatgtgatgtcgtagtccatcatctcatcctgtccatttctttctcccatgacactatagtctacggctgtgccaggggcacaccaccccacatccggatggcccagctgccttcccaagggcatctctgactctagcaagcccccgtctatcttgcacattctttagaccctgctgaactcaatccttccacggtcctttactttggccatatctttcccatctaaccttgtttttgttttccattagttccaagaacaataatagctaatattgatgtgtgctgggtatgttgaaggactttatattgcccccccccacttttttttttttgagacggagtcttgctttgtcacccgggctggagtgcagtggtgcgatctcagctcactgcaacctccgcctcccgggttcaagcgattcccctgcctcagcctcccgagtagctgggactacaggcatatgccaccatgcctagctaattttttatgttttttagtagagacggggtttcaccatgtgagccaggatggtgttgatctcctgacctcatgatctgctcacctcagcctcccaaagtgctgggattgcaggtgtgaaccactgctcccagctgtcccattttttttttttataaccccatgaggtaggtgtgataactattgccattcacagtgactcacgcctgtaatcccagcactttgggaggccgaggtggacggatcacaaggtcaggagatcgagaccatcctggccaacatggtgaaaccccgtctatactaaaaatacaaaaattagttgggtgtggtggcacgtgcctgtaatcccagctacttgggaggctgaggcaggagaatcatttgaaccagggagtcggaggttgcagtgagctgagatcatgccactgcactccagcctggtgacagaccaaaactctgtttcaaaaagaaaaaaaaaatagtggagagaactgagcatgggaaaattaagtgattgtctaagttgcacagctagtcagtgtttgaatccaggcgacctgactccagaccctatatgtcagacccactctgacttcactgtcttctagatgctctgtaagagccgggctctgtcgttcacctctactcgttaccctgtagagtagacactccctaaatgcatgcgctcactgtacaacgtcctcattcctcttctgtgccttgtttatgccattctcccccagcatcgtggcaggaggtggaggcaggggtcattgctctgaatgtgaactcagacagcttgggcttcagatttcaaccactttccaggtcactcttttaagctacagtttcaccctaaaaaaatggcgataatcattgtgcccacctcctggagcttgtatgatgaacacatcaaattttgcgagtcaatgctttagtcctatgcctaacgcatagaaaatgataaactaacaatagccccactagctctatcatctaactttgtccattattttctggcccctttcaacgtgtgtgtgctctctggcacttgtctaacgtcttcagctcataatgaactagatacttgttcctgtttgaccatagattagctgtgtgactttgagcaagttactacattttataagcctaagatgcaccatggtgatcacggagggttctttggggactgaaggaggaatgtgtgtatcatggtaagcactcagtccattttagtttctttgccttcttccttccttcatcaccaacttccctccactgaccagcaggccctccataaaagctcattgatagactcgatacctcacttagtttagaagaaagggaggttcctattgtatgggatagcctgggttgtagtcagttagcagggaactctagaaagttgtagagtcctgccctgtacgtttttttgttgttgttgttttgctttttttttttttccttttaaagatgtactcttagtggtagttctaagtatggccagaccttataaaataaaaaaaaatttatacaattttgacatcctctgaactcatccattcagcaaataattcttgaatatctcctctgtcccaagaactgttgtagctgttggcggcatgatgtggaccaaaacagtcgtggtttttgttttcatggggtttgttgttgggagacagacaccagccatccatagagtaaactacatagcgagatgtgctaggaagggaaatgataggtatcccgagatacgaaataagggggatttagagttgagggccagggaagtgttcccagtgaaaaggatgtgtgagcagagatctgagggcccaggaggagtacccaggtacagaggcagtggagtaccttcagatttaatcatcactccttttcttttaatgtaatatactatttagtattttattaagcttggatgatgacagatgataattattcttaaaatctggaggcatccaaatatgctgtcactggctgcttttatctcactataaatagtacgtgtgttgggctgggtgaggaaggctgaattgtatttaagcacaaccagtgcattgtgtgtgtgttttttttaaattatacttggggccagttctgtcagtaaagcccatccaggcactttgtcacattatggatagcgctgtctgggcttgcctgcccagggcaggtgctctttattttaatttgtattacgtatatttgctctgaaagttgtttttgttgaaacttgaaaagccaggtgcttgcagctagagaatgggcagacttattggaaatttgctgaacaaggtttgttaccatgaagtagggacaccctcagccaagtgtaatgggctatgtagagaattgtccatcaaaacccccagtatgatggccactatggaactggacttctatttcaggactggcatttcctgaagcgttatggcagggtctctcaaagtgaggtgcctgggatagtaaagagattacgttataagagacacaaacgtgacagggaactactgtgtcactgatggttccagcaccttgctgtccagtctgtttgatgaggtcaaggaaagattctctctgtagctgtcatttttccagcaccttttatttgcaaatttttcttttagcatgaataagcaggccctgggagacagttccatctagctaagtttgctttgctttcatatttatattcatgttatttatttattgagagggagtcttgctttgttgccgtggctggagtgcaatgatgcgatcttggctcactgcaacctccgcctcctggattgaagcaattctcctgcctcagactccccagtagctgggattgcatgcctctgtgccaccatgcctggctactttttataattttagtagagatggggtttcaccatgttggccaggctggtctcgaactcttgacctcaagcgatctgcctgcctcagcctcccaaagtgtgcattcatggtatttctatttatggaaagcaacacatatttatagcagtgacttaaaggttcttataaaaatgaaattaaaaatgaattgatttgttaaacaagtaaataagtagaaatgacactcagatttggtaaaatcatgagggtagtacttgaatgactgaatgactgaagtttgggaatactgtcttggcgtaatatggattttttttcttccactgtctggtatttagtttctgtttctgaggacctacttaaaatttggatgttaaaatctgataacacaataatacactacttcttacccactattatggctatactaaaaacgatggatgataactagtgttggtgaagatgtgaagaaattggaatcttcataaattgctggcaggaatgtaacatggtgcagctcctctgggaaacagtttggcagttcctcagaatgttcaagagttaccacatgactcaacagttccactcctaggtatatccccaagagaactgagaacgtacattcacctaaaaacctatacatgaatgttcatagcaacattatttataatagccaaaaagaggaaacaaacccaagtgtccatcaactgatgaatggataaaaatgtggtatatctatacaatggaatattagtcagccatgaagaggactgaagtactggtgcaggctgcaacatagataaaccttgatcacctgatgatatatgaaataagacaaagataaaaggttgcatattgtatgaaatgatttatatgaaatattcagaacaggcaaatcatagagatagaaagtacattcgttctcagcactttgggaggccaaggcaggtggagttcctgaacttaggaatttgagaccagcctggacaacatggtgaaaccctgtctctacaaacacaaaaattagctgggcatggtagcttgcatctgtagtcccagctacttgggaggctgaaggtgggaggattgcttgaacctgggaggcagaggttgcagtcagctgagattgcaccactgcactccagcctgggcaatggagtgagaccctgtctcaaaaaaaaaaaaaaaaaaaaaaaaaaaaaaggaaagaaagtaggttctttattacaggagttgggagaataagaaataaagaatgatggctcgtgggtagggtttctttttggggtgatggaaatgttctcaaattacagtagacccttgaacaatgtaggtttgaacttcacaggtccacttataagtagattttttttttcagtaaacgtactggaaaattttttggagatttgcaacaatttgaaaaaactttgtagtctcaaaatatcagaaaaaattaagaaaaaggtatgtcatgaatgcataaaatatatgtagatataaatctgtgtgttaatagactttatgttatctgtaaaacttctggtcaacagtaggctattagcagttaagctttgggaaagtcaaatgttacacatggattttttactatgagggggttggcacgcctaaccccaagttagttcaagggtcagctgtagatagtggtgattgttgcataaccttgtggaaatactaaaatccactgaattgtacactttaaaagagaaaattttatggtacatgaattacatcttaataagaaagatctggtagcaaaagaacatatgactggtgatagaaggctttttgtggaggtgttgtctagcgttgccaatggaatgggactggtgtcatcgtcccactgtttaataggatggtgcttttcctgatggtgcccacgtagcctttggtgccaaaatcctattgtaggctgacatgagcaagctccaactggctggacaaagtgtaatactaggtttttatcttcacagtagcactctgaggtctctggattattcatatatttattattcatatgcgatgatgatgggggaggagggcttaaagttgggtggtagagtaggggcctgaaccctggtctttatactttctttctactattatttgtaaacaaactatcacgcacttgagaggtagccaatcagttgcaaaatggggttgaagatgagaaagttcagtcttgccagattaacttgcttatttaaggatttatgctaatgaattttttctttgatgccagtataaatattgactcaagatgtcattaacagcaataataaagtactctttaatttgcaaagaactgtcaaacacagtacttcgttattttcttactttatttatttatttagagatgaggccttgctctgttggccaggctggagtgcagtggcacgatcttagctcactgcagcctctaagtcctgggctcaagcgatcctcccactttagcctcccaaagtgctgggattacaggcatgagccattatgcccaccctatcttagtataaagctgaggaaactgaggtctagggattaagcaacttctgtacacagagaggaaatcaggaagtcaagctggttcttaagcccaagttgtctgactctgtgtccgctatatttgaatttttccataatggcttcctgttgctttggtgtgtggggaggcgttcgttcttcattcattcagtagttatttactaagtgcctcctagaatctgttctaggaggtggagaagatactgcaggtaataagacagatgagatccctaattctacggtgcagatgttttagaggaggtgacagacaggaagccattatcctaatagagtcggtaatttcaaaaagtgttgtcttcagaaggaaaaaatttaaaaggcagtatgatagaagtgactgtgatacaaaggtggacttttttaggttagatggtcatggtgtgtgtgtgtgtgtgtgtgtgtgtgtgtgtgtgtgtgtgtgtgtgtgtataaaatatatatgggctgggtgcagtggctcatgcctgtaattccagccctgtgggagatcaaggagggtggactgcttgaggccaagagttcaagaccagcctggccaacatgatgaaacctcatttctactaaaagtacaaaaattagctgggtgtggtggtgcctgcttataatcctggctgcttgggaggaggctgaggcaggagagttgcttgaacccaagaggtggaggctgcagtgagccaagatcgaaccactgtactccagcctgggcgacagagtaagaccctgtctcaaaaaaaaaaaaaaagaaaaaaaagaaaaaaaaaaagcctaggcgtggtggctcatgcctgtaatcccagcactttgggaggctgaggcaggcaaatcacctgaggtcaggagttcgagaccagcctggtcaaaatgacaaaactctgtctctactaaaagtacaaaaattagccgggcgtggtagtgggcacctgtaatcccagctactcaggaagctgaggcaggagaatcacttgaacccaggaggcggaggttgcagtgagccgaaattgcaccattgtactccagcctgggcgacaagagcgagactccatctcaaaacagacaaacaaaaatgatatatatatatatatttataatgggtctaaccacatactttacatagttatatggtatatgtatataagtaaaatgttatgaaaataaacttgaaattaaatacttatttttcaatagaagactgtcattctaatgtgtgattttcccatcaaggcataagccttgtgcaaaatcacttcaaggagttacctcttacgaatatgacctatgcttcttgcttaagtcactaaacagctgtggcgatcgtaagcagaagatggcatctccagttgttggtgctcttcaggaccacctgttgacagtgtgtatagtgagaacccctgaaggcatctgtaagccctccatgagggagtgttacatagtagtagcatctagttgatgtatgtcctggctaaataaatataagttggtttagatggaataaattctttgttttggggaaagtgtcattcttttaggacgcccaagcagaaagcttttatattgttggcagtgccgtgcctctccaaaacaagaaacgggccatgagggatggaggtgattaaagtatctctactcccggtgggtatctggggaggatgcggtcggtggttccatgggaaaggtttcagtagctgttgttttacttaaagactgctcttgggaatggctgtggaggccatttgagggctctaactggaaacagtggccatctaatctgcttttcctcttccccaaagttttgcctccctctttgctgcctcctgcctgcctgtcctgtttgttttctctttgcttagctctcttccttggagtggtactcccacattttcttctcttccataaaaaaatacaggtgggctgagctcactcctctaatcccaggactttaggaggctcaggtgggtggatcacttgagcccaggagtttgagcaagcctggacaacatatcgagaccctgtctctataaaaaaaaaaaacaaaaaaattagctgggcgtgatggtgtgcacctgtagccccagctactcgggaggatgaggcaggaggatcatttgagcctgggaggtggaggctgcagtgagctatgattgcgccactgcactctagcctgagcgacagagctagaccctgtctcaaaaacaaagcaaaaaccaaaaaagcaattggaggacaatagctcaagaggtcttttttcactcatccttcccctccccacatccccccatccccaacatgttttctttaagggatcacctagttgtttccataagggccaaggctgggtcctggactctgggagtgtgaaccctcagtcagggtttacaatatttccaaaatgttgccagtattgctgctcatgcttgtgcgtgtttctgtggggcaggcgcttcctttgtttttgtttttgtggtgaaacacaagtccgtacatgagccaagggaactggcccttctctacttacaagccactagacaggtattttgtttctggagcccttaggatatacaggtacatggtgacctgtgctgacaactacttgacattttctctttctgtagtactgtttctctctccctgcttttgtctatttctgaaatgtgaatggcacacagaaaacttgaagtacacagcctaaagtaccatattgttatttggttccagcaagggataacttgccattttctaaagttttttcaaaataaatttggaacatataggtagagagtttgtgaattccacaagtgtttcatcctttggaggcagtcagttgcatatggctgcttaggtcactaccagcctggagggccagtttctagagatacattcaaacatgaaagccctagaaaagaattccatccagatttcctagaaagaatatacagaatccccctcacctgtatttttgagtgttatttagaaacttgggctacccaactcatcacatactggcttctgataatgtctttaagttaaaagtattttctcgtctgacccatccaggtgggagagccatttatatctacatggccatgaacatttctgatggcagtcacagacagtaagctaagttagcttaaatgatgtgtataatttcctgttatataaaactgtactttccagagatcagctaaagagacatctgtgaacgtttctgtgttggaggatgggggtagcatctggcagtgagaatgtgagtcccctggtgtgagccaggctcggcgaggctgtgagcaagtcacctccctctgggtgcctcagttcctcagctccaggtgggacagttatagtacacatatgaggggatgctaggagacttaaggggttatatatatatatattaagtcttagaaagcacctgccatgcagaaagtgacatttacctgttttctgtaattatacgtgtaattttatatgtgcattttcccaaattttagtagattcttttgaatattagaggaaatttgagttcttcttaaccataatatttggtaagatagatcgaccctattgtattttgcattaaagactttagaattttatttaagctgtcaattttgcagatctgaagatggaaactcttgtattcattcaccaaacacagacccccttttttttttttttttttttttttgagacagaatcttgcccagttgcccaggctggagtgcaatggcacgatcgcagctcactgcaacctccgcctcccaggttcaagcaattttcctgcctcagcctcccgagtagctgggattacaggtgcctgccaccatactcggctaattttttgtatctttagtagagatggggtttcaccatgttggccaggctggtctcgaactcctgacctcttgatccacccaccttggcttcccaaagtgctgggattacaggtgtgagccacagtgctgggcccacagaccactttgaagttttcccctgctctctccctcctatgccatgacgtccctcttgagagcgcactggtggcctgggctttatggctcactaaggcctttgactttctttttttcttttttctttttccttttttttttctgagacagagtcttgctctgtcgccaggctggagtgcagtggtgcaatctcggctcactgcaacctccacctctcgggttcaagcgattcccctgcctcagcctcccgagtagctgggattacaggtgagcaaccacaacgcatggctaattttttgtattttagtagagatggggtttcaccatgttggccaggatggtctcgatctcctgacctcatgttccgcaggcctcggcctcccaaagggctgggattacaggtgtgagtcactgcaccccgcccaggcctttgtctttctttaacgtgctgcttaaatccacgatgtgaattgtatgttagtgtgaatgtttccgagagtagaattttttttccttttgagaacctcagtggcattgcctgctcttgccctctctgggaaggacagcagaggggacactgctgtccctgctgtgacaatgtgcagtgatcacagggaggctttcaccctccaccctaacagtcagtcccagctgagccaacccaggatctggttttctgtatatcagatgcacgatgcacacaactgttttattaagcatgaaacaaaaccaagaagtataacagtgctttacagttcttctcttaattctggcctcgtatgatcttatcatgtattaacctcagaaacactacttttgcacatgtcagttaactgtacacaaatagtgccaattcctgccctgttgatgggagctggctttgctattagaggactttctgctatcgggggtttggcatgaaggtggtgcctgattagtttgatgatgggaaaaaacacagcaccttaagaagtacagaatcatagcaacgcagggccagtgggaaccacagggtcaccttcccagctcctgcattttacactgcagtgaagaagccaagtgatctgattgaggtcacttagctcatgagagccagagccagaggcctagatactcttccctcagcacagcaaaaaggtgactctgtaagatgagaggaccctagagattcatatcaagcagcataggatctgggaaatgttgtcttggcccctagagtgtagtgaaaactgggttttctggagaacaagagaaagcttcagttaagtcattctggtaaccagggctggcatcccgtgaagccgcgagcatagcaaacttgtgggaattttgtgttgaagaactcgaaggattcttcccctgccgtactgcaggctgcaggattgggatctcctttttctcatttcccacggtgaatacccccagcccatgtgccagtgggttgcataataaatatttggtgatgtatatatgaaagaaaggtgaagccgggcgcggtggctcacgcctgtaatcctagcactttgggaggccgaggcgggccgatcacaaggtcaggagatatctcaagaccatcctggctaacacggtgaaaacctgtctctactaaaaatacaaaaaattagccgggcgtggtggtgggcgcctgtagtcccagctactcgggaggctgaggccgagattgtgccactgcactccaacctgggcgacagagcgagactccgtctcaaaaaaaaaaaaaaaaggaaagaaaaaaagaaaaaggtgagaagatgagggtcagacaggttcaccggaaagaatactgacagggtggggggaaattgtacaactttattgatttatgcatctccaaactgcagtcttcaacctcagctggacttttccttcctttttttctctttcattcaaccaatcccaaagtgcttcctctgtgctgggcagtgcaggtggcgaaatggtaaataatgcggccatgcatggtcctggccctctgtggcgggaggcagggggctcgctgcagcataatgaacacataaacagtcacaggtttggaaaggcttgtgaagggcacagcgaataacagaatgctgggctccttcatataccgtggccagctgaagcctccctgcagatgtgaagggagctgagactgagccattctaggtagatgggacctcacagggaaaggcctcgagataggagcccgaggtgcttggccagcatccagcatagtggttaggggagaatgtggccggagatggagatgccttcaggaagatcacactggacctttttggctgtagattttatccccagtgcagtgggaagccagtagggcttggagcaagggaagagcattgaagttgtgcattaagaaggctttaaggaacctcaaaaacttgatactaagtgaaagaagccaatcacacaaaaccacatactgtatgattctgtttatgtgaaatgtgcaggatccattatgtgaaacatccaggcaaatccatagagacagaaagtagactagtagttgcttagggttgagggtcagacaggttcaccggaaagaatactgacagggtggggggaacttatacaacgttattgtataatttcggggggagggacttctaatgggtacagaattttctttggtgagggggtgttaaaaattctaaaattgattgtggttagggttgcacagctctgtggatattctaaaacccgctgaattgtttactttaaataggcgaattgtatggtatatgtattatgtctcaataaagctgctattaaaacattttagaaagactttaatgctgcctggcaaacctgctccattgtcccaggcggctgtccccagccgtttcggcccttttccagcctccttgtattggagcaccccttcctgcctccaactcctgccacttcaggaagtaaaaggcatcggttgcggataatatgagattcctgccatcaaacctccaaatctcgcaagcccatgctgggttcatgctctcctttcacaattctgggaaatggctttaaatcctgactctgcctattattggttgtgtgactttaggccagttacttataagctgagccccagtttcttttattttttaaatagtagcgcttactatatacctggtaatttttgtaagtgctttaagaatattaactcatttacacattttaacacatttaatcatccagttaatcccatgaggtatagggactgctgtcctctccattttgtagatgaggaaagtgaggcacagagaggttaagtaatttgcacaaggtcacacagctgggaagtggtagagctgaatccaggccttctggctccacaggccatactgtttctcctggcctgtatagttggtgcagagcttcttcttgcttattttacaattgtttaatcttcagctacttgaacagcaactataaattatgccatttccacaatgcatcccgtggtgccaaaaacatagtaagtactcagtaatggactctgcacattaacgtacttaactgtcttcccctccacttatttcttcattgaccacctcagaccccacaaggatctaggtgcccagttgaggtccgggttctgtcttagctttgcctttttcctgatagtctctgggatttgctttccttaccaataaactggagatgatgataacccggccagcaccctccgtggggtcactgcagggatccatgagccactgtgtgggtgggaactttgtaaatcaagccgccccctattcatgcggggttttaatttaatacaagacctggctgtttggaccacgcactttgaaatgatgatggcagtgttgggagagggttggctgaatggtttttccatggaaatcctgacggctcaggtggagcagaagtgatggatgtgctcacctccatacggtagaactcgcccaacttgacactcaagcaatgggtgcagctgtcgcggccactgcatgtctctgtgccgagttggttctcccccgtgctaaaaacataaacttgctgtgtggcaggggagctagttaattctacccttcattcagcgtaagcatgaactgaggatagttttgccggtgtttggtttttagaccaaatcgaatttacggttttggcaaagtaggctgcactagaggaggcaaaaagtacagcttcctgggtaaaatgcattcctttcttctgtttcatatgtggcttctctcttcccctcccctccccttgtttggtccaaggtctgttacaaaattggatacaatggtgtggttactgaattacaacaaacaaccttggaaagtacatgtttaccagagtattgcgtaggttttgtgttcatccccacagttgtgtttttgtctttagaatctctcattttgcatttttaatgtctgctgtgagatataggtatatgcttttacacacacatgcacgcacacacaccttcaaacatataagtcaatgttgtgtttcttccctgccctcagtattatctttcaagctcctcatacattgttttttgagggaggagcaaagaaggaggactcaaaggagaatattgagggctgccattatattctgaattctgatgatctcttcagttgacttaagatttgcatgtcggttctttttttgtgatttagatcagcataaacttctccctccaaaaatcctttcagataataccaacttctgttctttcgcctgtccctgctctgggtgcttctccctccatggctagacttttttcagcagctcagggtcccaggagggggtgggggcaggctgggtccatttcacagtggtcagaagttgtacagaatctgttggggttggggttgaggcagcgtaggcttgggagccctacaacttgagagccagaggttcctggttaaagttttcagctgggacacattacttacccattcagaaacctcaaatgagggcagcccgtctgactgttgttttctggttaacttgaatccttgagctaaggtattccttctatttttactttcttaaattatcctggcatggatgtgtttgctagttccaaattttgtttaaataatatgtcttctacttatgttgtgaaactcaaagtgtggttgttcgttggttacgtcttccgatgtcttcagggtgacctaagtcttagagaacattggttactaacaagaaagttgagtttgctttgggaacaagaaagcgctttagggttgactgtccttccattccacctgtttttgccttttgtaagaaattgaagctgtgggctcattactacgtatttggtagctcttcagcaatgtgtggatcagcttttcccaaatgggtaagagtctaaacttttattttctcttctgcattactgttctttcagcttggtaccccaaaaaatggccagtggggtgtcccttatcctcaaaatcagtcattccatttcagaaacaaagtgaaagaactttgctggttgtaagttgggcttcccagggttcttggtggctggatctttattatgtgtttggatttcacagggcccctgcttccaagggagcagcagttccagctcacagctctgatcagggtcaaaacccgacttacatgcatcgtctttatatggtttttttcaagaccaagttcattcatttgctagtctttctttctttcctttctttctttctttctttctctctctttttcttctctttctttctttctctctttctttttcttctttctctttctttttttcttctttctttctttttctttcttttgtagctttgaggatatttaggacttaagtttctgggcagcttatttcctttttcattctctgctcttgtaagtaaaggtaacttctgagtagctcaaacatatgttggaactatggatctttagacctgaaagaagcacggcagctttccaatccagttttcagacattatgtttcatcatggtccccgttcttcaaattaaatttaaccacaaacctcgaaggatgactgataaaatcagagctgcaattagtagtgtgcgtgggtgtcagttctaatggaagcctgctaatccactgatgggaagcctgagaaccagaactaagtgagttagccagtgttactggggcaggacagggagtacagccaggaggagaaattgggctcatttaggtagaaatcagattagtggcagctggggacggggctgtagggagggagtaggcagcaaaggggcccgagggaactttttttgggggtgataggaatgtttctatcatgattgtagtgtggttgaatgactgcctgtttgtccaagctcactgagttgtaccctggaaattggtgacttttaatgtctataaattatgcctcaagagaactgacaaaaagaaaataataaagtggctcaaaagttgtaaggaacctcctaaaacattcaggtctttcattaggggaggggggagcattttctatggttttaaattcagtgtaactgtatgaaatgattccttaaaaaatacaacaaaaaaagaaaaactcacattcccttaattccagactagactggtggagtctatttttctggtcggcagaggtcatcatcactctgtactcatcgctgctgtcagttataccaagggcctgtaaacctgggccaggtagtaaatattttaggctctgtgggagagccatacgtctctatcacagctattcaactctgccattgtagtacaaaagcagccagaggcaatctgtaaaccaaggagtcatggccgtgttccattcagactttgtttgcagaaacaggcagctggcaggatttggcctgggtgctgtttttgccaacctgtgcgtgacatttttgttacttttggagaaactcagcagaacaggtgcttactgtgtcctcaccagtagggtgagttacaggatgatgggactgcagggaggtttggaagaggacgggtcccaaaggacttgagatgctgtgttgagctaatggactgggatctgtaaaggacaggatggttttgctcagatggaatgatagaggatgaattaagaggaagaagggagtgagcatggccaccactttctaggttattgcagaaatccgggcaagacataagttcagctgtgacagtgaccacgagcagaaggggacatggtgaagggatactctgcagagacaaatgacagaacagaatgcagagaacgcctgtagctgggattacaggccaccacgcccggctgtttgcatttttagtagagacagggtttcactatgttggccaggctgttctcgaactcctgacctcaggtgatccacccaccttggcctcccaaagtgctggaattacaggtgtgagcccctgcatctggcccactgctgggtttcaaacatagtattattgaacaacctcaaattgctatatttaaatcaactctttatcaactagtcctgaaaattaaggcctacagacatcaacaaaacgagcgacagaagaaaggcatttccaagtgatgtaactgggtgactcatctcacgaaagggcactcggaggcctaccagtagaccacctttctggcttttggcatgccctgacatcagccttgctccctccattaatcatactacgctcacatagaagccaaaacatgtcacgcttctgtttgaaagctgtctttttgttcttagcaacatgtcatgtttgggggaagttataatatactggccagtggtgtcagtaagtcgggaaggctaaggagctttgatgtcaggtctttaccatttaatgtttttcaaagtattgggaattctgagaatattgtggtcaggtgtaaatgtaccccccaaatcctgtttccgtccctctggttcagataataataagctgacctacccctgaaccccgtctcctttgtaatggaggtcgatttccagtagagagtatcttacatatagtagttgcttcctaaagtttgttgaattaaattgaatttgtgtgagtctgtgatgattctcctcgtggaagagcatagtctaccaaaatcctgttggagcaaatttttgcatcacatgtcacttttttttttttttttttttttttttttgagacagagtttcattcttgtcacctaggctggagtgcaatggcatgttctcagctcactgcaacctccatctcccaggttcaactgattctcctgcctcagcatcctgagtagctgagaatacaggggcccaccaccaagcccagctatttttttttttttttgtatttttagtagagatggtgtttcaccatgttggccaggctcgtctcgaactcctgacctcaagtgatccaccctccttggcctctcaaagtgctgggatcacagacgtgagccaccgcgcctggcacatgtcacttgtgattcttaaaagtcttgagtgagatgagagtctacaagctttagctaaactgatttctgaatttaatcattaaaaaaacaaaacaaaacaaaacaaaaacccagaaaacaaaaaacaacctgaaagcacaaaacccaactcaggtgagagtactcaatgcaaaacattggaagaaccactctgggctcctgtatttgaagaattgtagcttctgccaacttgagcttgctaagctggaagcaaagccacagaaggtgtggtctgtgggacactttccactaaagtggtcatgatgaccatttgctttctgggacctagttcatcatctgattttactcttttacagaaaatgagaatagccatagttttttgttgttgttgttttgttttttgtttgtttttttttgcattggggcatttactctaacttcttagtcttcatgtatataatcctttctacacttaggggagattaattaattaataaaaattcttagtacaaggcaggtatcttgtcaaagactgatactgagaggcttggagttttattttgtttatgatatttctctttgtgcagaaatgacctcctttaatcttgaaatgttgaaatgtgcagcaaatatctgtaactgatatcacaatcaatagtttagttgcttatttgtataagaaaataaaagcaggccaggcatgttggcttatgcctataatcctggcactttgggaggtcgaggcaggtggattgcttgaggtcaggagttcgagaccagcctggccaacatggtgaaaccctgtctctactaaaaatacaaaaattagctggacgtgttggcgggtgcctataatcccagctacttgggaggctgaggcaggagaattgacaagagtgaaagaaactctgtctgaaaaaaaaaaaggaaagaaaataaaagcagatgacttctgtgcattggtgtgatattaatatttatgtggagctctttgtctttcttcttgcctcatgtgtttattttacaaatatttattgaacaccagcaatgttctccacaccagtggaggaagtagtgaacaaaacaaaatcactattttttttttggttttttgagatggaggctggagtgcaatggcatgatctcggctcactgcaacctctgcctcccaggttcaactgattcttctgcctcaacatcccgagtagctgggattacaggtgcctgccaccacgcctggctaattttttttttttttgtatttttagtagagatggggtttcaccatgttggccaggcctcgtctcgaactcctgacctcaagtgatacaccctccttggcctcccaaagtgctgggattacagatgtgagccactgtgcccgtccaaagtcactgcttttgtgatgcttacgttctgatataaatcataaaaattttttaggtgaaaccaatgatgattgcaggctctcacatttgggaacacgttctgggaaaggtaataacatagccatctaagcatttgggagtttctgtgtctctttagcaacttttattctctttcaaaaattttattattattttttttttttctgccaggtatagtggctcacacttgtaatcctagcactttgggaggctaaggcaggagaacagcttgagcccaggagttcaagaccagcctgttcggtatatgttgacctcgtttctacaaaaaaatgaaaaattagttgggtgtggtggcacacacctgtagtcccagctacttgggaggctaaggcaggatcatcacttgagcccaggtattcaaggctgcagtgagctatgatcgtgctgctatgctgcagtgagaccctgtctcaaacaaacaaacaacaaattttttctgttaatagagatggggtcttgctatgttgtccaggctggtctcaaacttctggcctcaagcagtccttttgccttggcctcccaaagtgctagaattataggagtaagccagcatgcccagccagcaacttttattctgaacatttagaaaattgaggacctgaataaatcacattttaaaatttaactaaatttacagagtatttactgtgtgttccatggtgttttaagttctttataaacattaacattaaattttcattacagttctatgtagtgggtagtattagtattctcattttacaaatgagacagctgagtaacttgctccaggttacccggtcagtaagaagggagactggtattggattgcgggctcttatctctctctctctctctctctctctctctctctctctctctgtgtgtgtgtgtgtgtgtgtgttttcatcttgcatttgggatttccttgaaggtttaggattatatgcagccagatttcatgacagtagagtaggtctgggccctgtggctccctttctgtgagaatttcttctctttttccttcacatttaattatgtgtttaatttgtataaatggaatgtgtttaatctaattttactgaattgtgtgtttctcttggtcctgctagactttctgtaaattgcttgaagcaagaaactggcagatagatccatctgacaaataagtaaaagaatatggtttattgcaaattctaagactgttagatcagtttactagaaattgaggcttttccctcctttgtgggactgcgtaatagtttaatttagctgtttataaatgtttaattgtattctaaacaataggactgccgaacaataggtcataatgtattggaataataaaactctggggggtgacactatttaaaacctagcatattcaatatatgtgtgccttgaggacaaagtcttcaggctacaatacattctattcttatgtgggcagtaacgtgatttttctgcttgataattctacatctcagggaacttgtgattatttgaggttacaatgcttctattctctcataatcctcaaggagattctggttagtttctcagagaaatgctctgtattcttcaattctcaatctctaatcatttgttgcctgcatactgtctagaactctcaccattcctcccatctcaaccttttcagtgctccaaacatttccttactgttctaaagctacttctgaaatcctactccttctgtgaatttttcggttcgttaaaagagaaatgatctggcctcatctttatgtttctccttagcattcaggaatgaagcttaaggaacatccaatatactttttcactttagttttaatgaactgatttatgctgtacatgaaaacgaatgtgaatctctcagtgttaatgctttgtattatgagcagtgagcttgttcagcacagtaaacatcacctgactgggccttgtttaagacagtccatcacgtgtggattaatatgaaaggaaatgttattatatttgtattatgttgcttcggctgccataacaaagttccatagactgggaggccggaacaacagaaatttatctcataaccattttggaggctagaagtctgagatcgaggtgtcagcagggtaggtttcttctgaggcctctctccttggtttacaatgaccgtcttttccgtgtcttcacgtatctttcttctgtgtgtgtctgtgtcgttatctcctcttctaataaggacacgagtcatatggattgagcccaccttaacgatgtcatttgaacttaattccttctttagggattctctctccaaatacattccagggactgtaacatatgaattttgtggggacacagtttagccataacaggcttgaaatgtataacatagttgtcctaaacttgtatgacgaattaaaacaaaaaattctttttaaagcttaaaagtagactagggaagacagcgtcccaggagagaagagaaaatcatgatcaggcttagtgattctgggtaaacttcacagtaatttctgttttgtctgtgctttctcaattttttgtactcagtgagatctgaaatgccttttaagtgcctctaagattctgtaattctattttaataactgtcttgtagttagaccttactgctgatttaagaagttgttggagaagaatttttataatcctgggttataatctcatgtttgcgagaaaatgcagaagagcgaggctgtgtccaacagacccttgatgatgggtgcatcagcccttctcttggcatctgaccagctgtatgactgtggacaggttatgtatcctccgtgagccttaattctttcatcaacaaaatagttaggaggctgtccttcaatcttgtcccttgtcatggttgcctgctacagatagatactgcctcccccgcagacgattgactctgagtgtcctggtgctgaggttgcatttgcagcccaggtagggtgttggtctcaacacctgtcgacttgcctggcctccactgcctgcctgactcgcgtgccacgaaggccacctgtagctcaaggctgtcagagcggagctgggtttatatcaatatccccagcctcacttgctgcgtaatgtctagcccctgggctagacagatgtcatttcagggaggatgagttgggttccaaatggttaccatagttttttttattacttcctcttcctatatttaatagccccaaatggttatcagaaaactactcttcttcctgtatcttattaggaggcaaatggtgaacatttgcagggcagagatgtagtttagcctcacacatcagattataatatccatagactttagtattacaaaaagtaagtgctgggccttttctagctcagagaaatacccactgacacaggttttgtgaggattaaatgaaataaatgtgtgtgtgcatctgtgcgtgtgcgtgtgtgcacgagtgtgcgcgtgtgtgtgcatgtatgcgtgtgtgcgtgtgtgtgtgtgcgcgtttggtggggaggggcagcagcatgctttctacatacttttcccgttaaattgagtgttcactctttgtgttaggattgagtttatataacttttaaaacacttttaaatcactaagtcttttaaaacactaaggtgacttttattattaggcttcaatagatcaattgattcagggtaaaatgttattccagtaaaattattaaaacaagttctctgtacaggaataagaattctcaagttctatttggcttactcgttttagtcattatatacaagcattaaaatacggcacttttggccatagtgtttgacctggaaaaattcccgttaagcgaacccatttaccatgcctttctatgtggtaccactgctgatacctgtctcctttagagtctgtatttatcagaactttttcagttgcaagggacagagattcgacacaaacaagcttaatctaaaaagaaaacttatttaaacttaagtgaaatattctagggctagaagtatctttattaagcaaggttagatccagggtcatataggatattattgggggcattttctctctctctttctcaaatggatttattctcagaaaactgatgagaaaaatgactgccagcattgccaaggtttatcttttgacttctgattggaaagtaagaaagagcttctcagttcttgtgtccatatatcaaatatcaaggaagattctgattggttctgcttgagtcacatgtccatccctaaacctgtgactggctggtgtatagagcactacgggagacctggccatgtgccacccactgtggcaaggcgtcttgactggcaagctccctgggattacgtgggatgggagggatgatgtcccaaaagaagggttgcttagcaaacagacagcatgtctggtctagataattagcattttaagtcaacaggggtttggtgtttattcctttagtttacagggaatgagaaggtaactatcataaaattctgttggatcacttgagaatgttaagctgcccttgaaaacctgtttgacatgtcatgcaaaagtgcccatcaggtgcaataggcctcacatagataaccagatagtggcatcataattgttgattgctgagattgatgtgacatgtgggcagtttgcagggggtgggtaaaggaacaaaatggcaataatgggacttctgattgtttttggcagggttggatgactgcctgcaacaatatgtccacaagtttgaacgagagaagatcaacggcgagcagctgctgcagatttcccatcaggacctggaggagctgggggtcacacggattggacaccaggagcttgtgttggaggctgtggaccttctctgtgcactggttagttcaggaaaagacggtctgtaccgtgatgacgttctttagagccttgctctcttaagccgtcattgtttgtgatttagcatatcactctttccttaatgctccatcaaaataaaacatgagctgaagatactataggaaggggaaaaataagttattttctacattaaaggttggcaaactatggcctgcgagttaaatctggcccactatctatttttgtaaataaagttttataggaacacaaccatgtccattcacttacgtgtttgtgactgctttcttgcgacagtgacagaattgagtggttgtaacgggaccacatggttcccccaaagcctaaaatatttattaacttgtcctttacagaaagagtttgtctttttcagaaaatctctgtattagtctaattttcttttataaggaaaaaatgatggaaatactcctgaatgaaaatgtcaccttctggcgaggcgcagtggctcatgcctataatcccagcactctgggaggccgaggcgggtggattgcttgagtccaggagtttgagaccagcctgggcaacgtagcaaaaccctgtctctattagaaataccaaaagttagccaggtgtggctagcacgcacctatagtcgcagatattcaggaggctgaggtcagagaatcacctgagcctgggaggtggaggctgcagtgagcagagatcgcaccactgcactctagcctgggtgacagagtgagaacctgtctcaaaaaagaaaagaaaatgtcatcttctaaattgaagtgagaaataggttctgattttcatgtctgattttgttactataaaaagcggttgagtttcacagatatttgtgatatttaaataactgatatttgcacttgacatgacctataaaatgggaaaaaaatgtggccttcattacattttgtagatgatgggttttggctttaacatgaatgagtaaaatcctgctgggtcctgacactagaatcacatgggtagcttcgttaggtgtgggccaaaaacacctgtaaggacattttgtttataaattggttagtgtgggtgggattcaagtctgcctgtcccggtgccaggctaaagatgcagtttacttaactgtcaggatttggacaaactcgacagcattcaggctgggttagtaatgccctgaaccccagccaggggtatatacaattacatcactgagaatggtgggaaagaatgtgctgctgatgattttgccgtcgctggtctgcgtactgttgattatataacacttgctgcattgtgtgtattcttcttcttaaaatggacagagccttgtcttctgctctgagatgtgctgctcttgtttaggaaagtaatggggaaattatttgtagttgataaatgagctgccgcctgggagacgctatggccaagtagtctgagcacgggtctgggaagcaggaatttgcattctaatcctggctctgctacatgctactccctctgtgacctctggggaaatggtgatgtctgtttttcccatctgtacagtaacgctcaccttagatgtggctgtgtactattgtgtgttttgcactgcccagacatctaagcatcctgtttattaccgaaactgtattttcttttttttttttttttgtacaaacgtgtttgagtttacttttattatactttctgggaacatggcttttccgtcttttctgcttgatgttttgcaaattgtctctttcactttgcagtaatactttgaggacaggtaaatttacttggaaatccaaagtaagagaggcaggaagggtcagctagagacgcatcacatgcatcaagtgggatgataaacgtaacagctgcctctgggcattctctttgctttttcctcttctctacctcttagagcattaggctaaaatgaacaaagctggacaaatgccagaacctaaagctgtgttttatctcctacaatttccttctaatttcctttgtagaccaagctttgacctcagactcattctggacctgctctgtgccagtgactacattggacagggggggtcacttaggggttcacaaaagagtgtggattattttagtgagttttactaaaatgtctttagtctggatataatctcctttttgaatattcttattataattcatatactaattatactgtctttttaatccatttatagcatatagatctttggatatataaattggtgatgctttgaacagaacatctccagggcagttaatgtgtaaatgcagttggccttggtgttataaaagaggtttctatgtaaacttagtttagtggatgttgattttatgatagacaggaaatgaatataattaaaagtaaggaagggggaggggagaaacaaaaccactggaaagtatcaatgtaaggagaggggcagatagatgggcaggaacctaaaataggaaacagctattaatgaagattccaaaactggtgagcagtggctcacaaattagctggtcatggttagagagcaatgagagaaaccatcttttgtgaacattgactttggctggcagtcgtggcttaggagagtgatttgtattatatgatgagaccaggaccactttcccagattgaattagaatctgtacccaatttttcttcctctctctgggtagagggtacctgagaccgattatagagctgctcttttcagtaggatagctgttacccaatgtgactgtctaaatgaaaatcaactaaaataaaaaaaaaattcagttcctcggttgtactagcaacacttcaagtactcagaagctccatgtggctagtggctacgatattggacagcacagataaagaacattttcatctgtgcatagagttctgttggccagtactggtcgagagggtgtgattgagaataaccagtaagaataaccaataaggataagtatgactgtggccgggtgcaatggcttacacctgtaatcccatcacgcctgtaatctcagcactttgggaggccgaggcaggcggatcacaaggtcaggatatcgagaccatcctggctaacatggtgaaacactgtctttactaaaaatacaaaaaattagctgggtgtggtagcgggtgcctgtagtcccagctacttgggaggctgaggcaggagaatggcgtgaacccaggaggtggagcttgcagtgagccgagatcatgccactgcgctccagcctgggcgacagagtgagacaccatctcaaaaaaaaaaaaaaaaaaaagataagtatgactgtaacctgtgttctttgccaagtcagtgaggccctagtttactgaacaccaaggcatgggcagctgtgttttgaaggttgaaggaggttgagaaatgaacagagttggaattgatgcatgtgttaaatgatgctacctagacttggggttaaatgaagtacctgtcatgaatctatgggcctagagtgcttatgcgcactggtatacctctgagattatttgttgtttattattcacccaaggcaaatcatttaaacatgttatcttttttatgagaagaaatgcaggaacaggaatttttgctggcaagttgtatttaacttgatcttgcttatgagcttatttaaaaatgccttaggaaaattgtgaactatatttcttaggttgtctcttaattgacccaagtcaataagatggctttgattttgtgtctctggcacaccttaatcacacgttagatcacgaacagagctagtaggaatggagaagatggtagagaagaagttgtgtaaggtgtgtccttagctaaatgtgtataattttaagactttttgctttccttttctcccatttagtgtatggtttctctagccagatcaggaaaggatcccggatggtgaaccctaggaagtgagatctcagtggaagggttttagtaggtgaacagattttcagaaactcattgtgttacttaatttgtatctttttgatgctttatctcaaagcagtttctgaaggagacaagttttggggaaaagactggtgaaaataattaatctggtctgagaaattatttattttcggtctttatggggcacttaagtcaataatcctttcctgattatgcttctacagtagaggttctttagagctactataatcagtttcttgttctctctttaatgtggaatggggtcgaagggaaggaactttcctttcttcttctcctccttccttcttttaaaaattctattctagctatatttattcatctttctaggtccattatttgttttggggaagaaaaagagcaaactgagtggaaaatgaagagaaccagttataagaagccactctacccctttatttcagtattaaaagtggtatgtttttagaagattgaggtttaaagtttcttgcaacaataaaatgctcttaatcctctttgagttcaataagtaaacgttatgtatatggtaataaaagttccaagtaatttatggtgacattgattattgaaagctgactttcctgcttttagttcaaaactcttcatgtaagttggcaggctgagtgaccgaatgaggggacctttccctttaatcatagttacaagtccttcaaaacaagctctgtcttgtggcctctttatccattcaattgtgagtctttgattctttgaatttaaaaagctgtgatgcaaatccatcttatttttgtctctctattgaaggacaatattattatattttagtctctagaaaataacaaaaaatgaatatcacatttagatagaaaaatactgctaatatagaatattcatttatattttgaaattcagtttttttcaaaagtttggaagagaacattttcagctaatttttgcttctttcaaaatttctaattttttaaatattattttttgtttcactaggaggtaacataaatttaaacttcaagtaaaatctatttaaaattagaattgttttgttaaagttaaagccttttgttgttgtttttaacttaccattgttcatcttgcaaaaaaaaaaaagtttcttacctacttccgagtatatttatgctttatgtatcttgattttgacacgtgacttgcctctctctggcccacatagccaaagccagctgaaagaagtttctccacagccgggtgcagtggttcatgcctgtaatcccagcactttgggaggccaaggtgggcggatcatgaggtcaggagattgagaccaccctggccaacatggtgaaaccccgtctctactaaaaaattcaaaaattaactgagcatggtggcacttgcctgtaatcccagctacttgggaggctgaggcaggagaattgcttgaaccagggagtcagaggttgcagtgagccgagatcacaccactgcactccagcctggtgacagagtgaaactccgtttcaaaaaaaaaaaaaaaaaaagtttctccacttcagaggggatgtgtagaattttgagaagctgaatagctattcagcttgtgctggatccaggatcactggacagttttccttattcttgtctaatgtccatcttgtcatctgtcttatcatgtggcgcttttttgggcaggttgtatggaaggggacatacacagcagagtaatcaaaagcttgtgccctagatgcagattgccttggtcaaaagctcagcactaccgctgatgagctttgtaactttggagaatttatttactgttatcatgccagtttccttaccggcaaattagagataaaaacatttctaccttcacgggctgttttcctgagataatacatgtcaaacactgagtccagttcctggcataaagtgttcaataatgttaagtattctgttagtttcagtttttaaatggtaccagattcttgccttgggatgctattgagatggcataatgtatctcaagaaatatcgtcatgtttttttaaaaatgatgaaacaatttaggacatacagaggcaactgaatacagaaatttatacccccacctctaatgttgcagatttacatgttgtttcctgggattggctcttttctctgaaaaggagtctaggacagtattatctcatgaaattgatttttttgaagcacccacataagctgaacattgttcaaaaagaacacaggttagaagcacaagagcaagaaattaattttattgattgattgagacagggtctctctctgtcactcaggctggagtacagtggcacgatcatagctcactgcagccttgacctcctgggctcaagcgatcctcctacctcagcctcttgagtagcttggagtacaaacaggagccatatcttcaagctcaggagatcacgcttagtgaattggtgtttagttagtgctgctgtgtttttttttgtgtgagtgtctcgcctggtggaaatccatgcattccatgactctatgattgtccactgtgctggaaatacggtagtgggcatactcacagagccctgcttctgcagccctcacgtcccagtggaggaagaaggccacaaacacggtgcttcagatggggcagaagtgggtgatgggctagagagtgaatcgaaggggcgattctgccaccaggggacacagggcgatttttggttgtcacaccgggggaggaggtactactgccatctgatgggtagagagcagggatgctgataaacatcctgtaagacacagggacccccaccccacaagcgttatctggccccaaatgtcagtagggctgaggttgagaaaccttgttctagattaagtggtcagggaagccttgcaggggaggggacatttgggccagcacctgagtgataagaatgagccgtcggccaggcgcggtggctcacgcctgtaatcccagtactttgagaggccgaggggggcattgtgcctgagctcacaagttcgagaccagcctgggcaacacggtgaaaccccgtctctactaaaaatacaaaaattagcccggcatggtggtgcgcgcctgtaatcccagctattcaggaggctgaggcaggagattcacttgaacctgtgaacctaggaagaagaggttgcagtgagctgagatggcaccactgtactccagcctgggcgacacagtgagactccgtctcaaaaaataaaataaaaaaaataaaaaaataatgagctgtctacgacaatatttgtaggaggcgcatttggggaagaggaactatcaagaacaaagtccctgaggcccgggtggctgtggaaggagcagagagaaggctgatatgggtggggtgagtgaagtgggctggggatagatcacatagggttttgtggttgttgtaaggtttttttcaagtgactaactgggcttttgagttatcagagagtttgaatattggtgtttgtttattgttttgtttttattttgaaacagagtctccctctgttgcccccaggctggagtgcagtggcgccatctcggctcactgcaagctctgcctcccgggttcacgccattctcctgcctcagcctcccgagtagctgggactacaggcgcccgccaccacgcccggctaattttttgtgtttttagtagagacggggtttcaccgtgttagccaggatggcctcgatctcctgacctcgtgatccgcccacttcagcctcccaaagtgctaggattacaggcgtgagccaccgcgccctgtcgaatattgtgcattgttttgaatttttctctttgattttattttccacagaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccggtaagttggagatgtgccttttactgccctgcaagagtagatagagtccaagctgcatggaagctgtactttgtcttaggaaaaggaaccattgttcttttcatatcatttttaccggctcttaaggagtcctcgatcagtggtagattttaggattcctttgccagttaacttaaaaggttaatagcaggaacaaattaacctcagcttagagaagagtgaaactgtgctaaaggttgtgttttactgagattaaacattaatggttgaggatttgattggtatgaaagctgttagttgacttcagaagggatgttaactgtcaatttttgttttgttttgtttttaatctattccttctctctttctattcagattgctattttatgtgtcacttgagagaaaacagttaaataaaaactaatttaatacaaaatttagctgggcttggtggcacatgcctgtaatcccagctactcgggaggctgaggcaggagagttgcttgaacctgggaggcgtagattgcagtgagccaagatcatcccactgcactccagcctgggcgacagagtgagacacagtctcaaacaaaacaaaacaaaaaggaatttagagtagcccatggggtagctatgcttaccaacatccagtgggatccccgtggattctccctacccctttttaagaggattgttgctaccttctagggctccgtttacagggatcactgatttctcagtcacgaagaacaaaattatccagctttgcttggacctgaccactacagtccagaaggtcagtagtatgtcattttcactttctttttctttttttttttttttgcttttcctcttcttgaaaggattttcatgcaggtatgaagtactactctcctctccccacctcagttttttttccatcagagctgggaagagatgaaaggctttaaattagatcattgtaaagatggtttctctgaaaactgaccagtggcctttgaattaaagattacctttttgtgtgtgttttaaaataggcgaactaatagttcctgtacttcccctaaaatgttagagcacttaatttttttttttaatgaaaattctggagtaactaagttgcatgatagtctttgttctgagtactttactatatctgcttcttaattttcttttcattttggcctcttgttgttggatttaccagtcaggatgggctaggttgtggtacaggaacaaacaacccccaaacctcaaaccttagcagtttattccttgattatttacatccaaatgggtcagggctagagggcaatcacctccgactcctcatttcaagatgtatacaggacataggttgacagaatcactagtatgtcatgttgcctttccccaaggcagaaaggtaaaaaccatgaaggtcctcacactgactgatgttctggactgcaagtgacacatgtcaatttcactcatggctcattgcccagacctaggtatcttagtaaaggctcaggaagttttatattagccagtctgtaactgattgagcttctgtgatcttaattttaaaaaaaatttcttcttggaccatcagctcttaggactaccttctgtcctgttacttggcatgcagcagatgcttgtaaaatatttttgaattgaattgaggctatgaaatgtaaggaagagcttgttgttttttcacgtcccacttggttctaaaattctgtttccacatttgtttctactgctgatttggcaaaacataaagaacatcctcccttctgtcctgaccatgccataacagagatgcaattctgaaaagccgtgctttttctggttgtttctggaatgtgaattgtgaactttgtctctgcacgtggcagttgtttgctctagtcctgagcagccattgttctcaaggcacatggatttttgaggtcatgatcttagaaaggtgctcagagcaagtaaagtagcttctgagtttttgctcttttttatggtgcataaagtaattttgacaaaaaagagtctgataccagttgtgatgcattagtcatacagccatgaaggcatggcatttgtggttgaaggcatttccctgatacctaccttgagtgtccattttctcccttgcttccctcttcccgtaatattttcctcatattttgattttgttttatttttaagagacagggtctcactctgttgcttaggttgaagtgcaggggtgtaatcgtggctcactgcagcctcgacctccttgctcaagcaatccttccactttagcctcctggatagctgggactgcaggtgcatgctaccatgcccagctaatttttcatttttttgtagagacagggtcttgctatgttacccaggctggtctcaaactcctggcctcgagtaattcccctgcctctacctcccaaagcactgagattacaggcataagccactgcacctggccctgttttgatttttaacagagtttactagcgatcaattaaatgaaagagttaaatattgtgattagcaaatgggaaagttttgcttgttggtacatttgtgttttattgtgaagggtcctcaactgtgtggctgattcaggctgtccccactgcaatgtagggagaggagagaaagggatgaaagtgaaggcagggggggtcatgtttgtttcacggggtgaacttctgcctgagcaagttgatgttggcttccgaggtatttggacacttctttcaatacatttttatttagcacttattctgtgtctgctgccctgggataccagagtgaataaacagataaaaagtccctgaccttctggagcatacagtctctggagagaaaatggatagataagcagacttttatatatgaatatatgtggttatattaaggtagagcaatgctagggagggaaggcgcacaggaaggagtgaggggagtacagtttgagatacgtgcctagagccgcctccttgagaaggtgacacttgagtaattcagccaggagaagtctgtgcttgtctgatgggatgggcttatgcatcatctcaagtgctacttttcctggtaattgtagagaggggtcgatcgttatgaactgatgattaaataaaaaaatcttcccataggaggtacatgtcctggtcacatcagaaaggtacctgtgagcgtcttcattgcgcctgcccagcttattggggcctaagaatgcctgggacatgatgaatggtgctttttaaatgtgtgttatatgaacgaaataatgctttggacagataggctgctgagaatttgacttttatcagaactcaagggacacaagaggtattagttttgtttgtttccgcattcattttctgtttctctttttcctgtggtgctcactgagggaggttagtctagtggttaagagcatattcttcagagagaggcagctataggttcaaatcctacctctaccattaattagccctggggccttggacgagtcacttataatttttgaacctcaattttctcatttacagaatgggaatacaaatatttaccttaccagataatttggtgggatttctacaagttaatgttgagttaaaaaagaaaaaaggcaaaaaaaaagtgtggtatgaagataaatggttaccataaatacctaaaatgcatgtgtgtgtgtgtgtttgtgtgtgtatatataaaacacgcatcatcctatacaaacttgtatacgaagtaatatgtaaatacagtggataatttagaaaaaaagttgtgtttactctggcagggggagagagagggagggaatgtaggagccaaggcaaaaaaagagaacaaaaaattttatttataaaaatcatgtatatgaccacatttatgtaaaattagatacagataaataatataaaatacttaaaaaataatacctactccaaaagattgttatgaagattaaatgagatataacatgtgggccaggtgcagtggctcatgcctgtaataccagaactttgggaggccgaggcgggtggatcacgaggtcaggagatcgagatacaacacgtgaaaagcacagtgcctgcttcagaaggagtagactgtggtaggaaatacaaaaatcttgccttgtacttgttttctggaatcaaatttgatagtttaaagagaagaactggacaaatatactgcccttattctctggtatttttttgttttaaatttgaacagttttgaaggagtaagactgatatgtaaatatatatcaggatatcattttctgaacttagattgaaaaatatgtttcttgacaagtgctcttgacaagcgcatgttctgtagtaattgaagaacatagctgggagaggtggctcacgcctataatccctgaactttgggaggccagggcgggtagatcacctgaggtcaggagttcgagactagtctggcaaacatggcgaaaccccatctgtactaaaaatacaaaaatcacccagggcatggtggcggacacctatatatcccagctacttgggaggctaaggcaggagaatcacttgaacctgggaggcggaggttgcagtcagccaagatcgcgccacttcactccagcgtgggtgaaagactgaaactccatctcaaaaaaaaaaaaaaaaaaaaagaacataggtgctttgccaaatggtgatatttgtgcatctgtgcgctcagatacatacaaattagaaattacaaacttgataaatgagttgagtgtggcttaccccatgtgcgttgtgatggtagcaatgagattgaacgtgccaggggacttcacattctcttgcagctgcttgacagaagatctgttgactctttgggaagacatctgtctttgccatttattccttttaactggggaattggaggaataaaagttgtatctctttccagtgacaaagaacatgttctgtctgagcctttattcttggtgtccttgtctgtgaagagacatttgcttgtcccatctctcttctacatcttgccgtccccccttcttcttcttgtggtgacatccttccttccatccatctctgcatccttccttccaataataatttatgagtcctctaatttgaaggatacatattgctgcttcttttctcctgcaaggaaactgcacatttcttttaagaaatttcttcatttcttaacattttttcagctgtagtcctacaccaagtacaaggatagatcttcccgttcagtgttgaggctgtaatttgagatgaaggaccccaaggtgggaagggattgagatctgtatttccagtgtagtctcctcatgtcggatgccatgaaaactgaaatagagacggcaagagagacacaatggccctcgcaggtgctgagtttcagtctggaaagaaataggaaaatgacgccagatgtgttggtgcacacctggaggcccagctactagaggctgagatgggaagatctcttgagcccaggagtttgagaccagcctgggcaacataacaagatagtatcttaacaacaacaaaaaaaagaattaggaaaatgagcaatatttgtccttgagaaaactgaatggaaagaaaacaagcctgccaggctcaatggctcaggcctttaatcccagcactttgggaggccaagttgggaggattgcttgagacctgcctgggcaatatagtgagacctctatattaaaaaaaaaaattaaggagttagccaagcgtggtggtgtgtgcctgtagtcccagctacttgggaggctgaggtgggaggattgcttgagcttgggaagcggaggctgcagtgagccatgttcatgccactgcactgcagcctgggtgacacagtgagaccctgtgtcacatacacgagaagaaagcaagccatggaagcagaagaggaaaagactgctgctgagtgctgactgtgtctcaggtgtctatccacacttgacacatgccatcacaccgaattctcagcaggtgtgcatccacgcttgacacatgccattgtgcatccacgcttgacgcgtgccatcacaccaaattctcaggtgtgcatccacgcttgatgcgtgccatcacaccgaattctcagcaggtgtgcattcacacttgacgcgtgccatcacaccgaattctcagcaaatctcagaggtaggctttgttatcaccccattttagaaagaaggaaactaaggctcagagaagttaaacctactgcacaagactgctcagttcctgagaaggcagaataggaggagaggcaggggggtgctgagtgccacccaggctgggcctctgctgccaggtgacccagggctgtgagaagctcagctcactgtccagcctgggagggtcggtgacttggttttgcactcatttttccattccattgccttcatgccaaaaaacaatgtgaagtcatgcctgcagctgcttcctctcggcaggaatgggtgtgggaaccacgttcacagtggcgggaggtgagagggagtcctttcacacgccaactggaacaatttgggaggcgggaagctccttgtgttgctgtctccatcaccaccgcagtcaccactgcagggaaccgatattcttggtggcctcttggatccctcaaggaatcaagttgtaggaaccttgcagtcacaagtctaccttgttcttgggctctggtgtattgagagttggtctctgcctctaggtgatggtctccctgaagtgacagtgcttgtattaatttagagatttgtgggccgggtgtggtgaccaatgcctgtaaccctagcattttgggaggctgaggcaggtggatggcttgagtctagaattcaagttcagcctgggcaacatggtgaaaccccgtctctacaaagaatacaaaaattagccaggtgtggtggtgtgcacctgtggtcccagttgcttgggaggctgaggcgggaggatcacttgagcccaggaggtcaaggctgccggtgagctgagattgcaccattgcattcctacttgggcgagagagtgagaccttgtctaaaaaaaaaaaaaaaaaaaggaatttgtagtgaaagattatagacacaaagataaagtattagttttatttctagcacacgatcacatatgtatactgtgtttctaaggttgaaatgtgtttaacaagtctgccagacagtattaataggggatgagccataatggtagttgacagtttagttttatctacaagatagaattggaaaagcacatttggagctataattattcctgtttacagaagccgctcctgtagtttaagataatatcaaattcacacatgtaaaaatacatttctaaatttattttttttaagtcttttctctctaggctgctcttttcctgagagtcagtataaattttaggagcagtcattattattgtttcctacatttttatttagtagaaaaaattttaaacaaatgtaagaagacaataaaagtctgattattaaatcatatagagtagaaactgacaggcatcttcctccttcagaagtagtaaaaaatgacctaaaaatgactttttgattgacatgaaaaatcttcacctgacaattccaacacagttgattaacattttgtcatgtacataaaagaaattagcattatctttaagattgtcctaacttgggattatagttaatagggctgaataaactctatagaatctagttgtatcgattttttttttctgcatgcattctgcagtataggttgaaatcctttgctacagatgagttctagaaggttaactgtgaaagtttcacattggcaatttcactttggcagcttttagacaagacaatggtgattcctataatcagctaacccagttcatacagtgttccaagccttttgttcttaagctgaataaataatgctttgcattccagccctttatttcatgtcatcaatagcatacctcaagaccacttttttgtcagtgtgttaatgaatgttttgttgaacccttttcatctatcaaggactgaaatatctgatttaatctcagtggtgcttaaaataaacttttgtggctgagtttactcaagcccttatttgaaagctattcttataggcaggcccagagctaaagactgccagcttgttggcccactgctgtctgttcctgggggcacattgggagccgtcgtcaggtttcttgacttggacttctgacttactactctctggacagtctggagagtaggtggatttcagttcagttatttttgtaagttttcaaattaagtaattggccaagtgggttccttggatgagaactccttaggtcaggggagagcaggaccttcggaaggtgcaaacgtcagctctgttcccactctgccctctcattcccatcccagtcctgcaggactgtgcaggctgacgggtgtgtcagggaccgtcttgagctgcagaaaatgtctagaaagctaggccaacagttctgaacgtttttaactcttgtacttagtattcattttctccatccccttctttaggattgctttgtagcggaaatggaggataaagttttaactgtggtaagtatacattctaaaagttattgtaaaattcattttccaaaggcagtgggaatcacattaagtaaatgccctgtggctaattacttcaggagatactttgaaatattggcttttgggacatgagtttttaaatttaggtggaagagaaagcataaaagttatttaacaagaccaactactgtgaaaattcctgtgcttaaattaactacattgagtctctgttttatttttttttctgaacattttatcaggatacagttatatgtatattgctagctagcctgctagtcaggattgaactgatgtgcaaatttcactttaggaccattttgatttaagaaaaaaattcttggcaaaaaccttatgatggaggggggatgtgctgtaactgtttaaggagcattttgtaactattcatcatcacttcctccttttgacatacgccagcctgtgctcttttgataaggccttcctcctactgatgttgaggaatttagcaatgaaactgctataaatatattttccataaatagggaggccaaacaaattggaggaatgtaaaaagtatcacttcttggattctcccccttggaaagaaaaatcactctttggaatttcctgatttctttggttgtttaattttgaaaggttagatgagtctgattggggaaataccacacgtagccactgtgacttctataaggagaccacttaatagggatcctctcattgtctctttagttttaccttgtcagtgtttggcattcaaagaatgtgagtgatcactaaaaagatgatagacctaaatgtaaaatgcaaaactataaaccatctaaaagataacataggggaaaatttgggtgactgtgttttgcaatgagttttcagatagaacaccaaaagcataattcatgaaagaaaaattgataaggtagacttcattaaaattaaaaactgctatgtgaaatgcactgttaagagaatgaaaagacaagccacagactgggaggatatatattttcaaaacacctatcagataaaggacttgtatccaaaatatacaaagaacaagaacaaaatatacaaaaaacaagaataagaagacaaacaacccaattaaaaaggagacaaaagatctgaacaggtacttcaccaaagaatacatacaaatggcaaataagcctatgaagagatgttcaatgtcatttgtattagggaattgtaaattaaaacaacaatgagataccgccatatacctattatataggctaaaatatgaaacactgacaacaccaaacgctgctgaggttgtggagcaacaggaacgctcgttaattgctggtggaaatgcaaaatggtgcaggcagtttggaggacaatttggaagtttcttacaaaactaaacatattcttaccatatgatccaacagttgtgctcctacatatttacccaaaggagttgaaaatttacatcaaaaaatgtgcacaggatgtttatagcagatttactcaaaattgccaaaaaagttggaagcaaccttaatgtctctcaatagatgaatggataaacaaactgttgtacatctataaaatagaatattattcagcaataaaaaagaaataagctatcaagtcatgaaaagatatggaggaaacttacaagtatgttgttaattgaaataaggcagtctgaaaagactacatgctgcataattctgactatttgactttctagaaaatcaaaaccacagagacagtaaaaagatctatgtttgccaggggttcatggtgagggatggggtggtggataattaggttgcatacaggggatatttaggacactgaaactatcctatatgatactgtaatgaaggatacgtgacattaggcatttgtcagaactcatagaatgtacaccacaaaaagtgaaccctaatataaattatagatgttagttgataatagtgtctcaatattagttcataatttgtttttggtggctttttttttttttttttttttgacagagtctcgctctgttacccaggctagagtgcagtggtgcgactcggcttactgcaacctctgcctctgaggttcaagcaattctgcagcctcagcctcccgagtagctggggttacaggcacacgccaccatgcccgtctaatttttgtatttttagtagagatggagttttgccatattggtcaggctggtcttgaactcctgacttcaggtgatccccctacctcagcctcccaaagtgctgggattacaggcatgagccactgtgcccgtcctagtttgtcatttataacaaatgcaccacacctagtacaagatgttaataatagaggaaactgggaatggaggctggtggtggaggggatatatgggaactcaatgtactttttgttcaattttttttttttataaacgtgaaacagcttaaaaaagtaaagtccattgaaaaaatggcttagtctcaaaacaatttttttttttttttaccttgtcaatatttggtattcagagactgtgagcaatcattgaaaagtcaggtaggtggttggggagagatgattccacttcattgctgaaaggggatttctgcctggcctgtgctcttcagtggccataaaggagctaatataaaagctgccttttctaaacaaagctgaaatagtggcactattcccacagatggtaaacatggagtctaaatgccatgcattcactgagcagaattatcaaaatgattgccaaccagaactaacaattataggtgaaatgcatttctctaaaaatcagcttgagataaacttggttaatgattgaactttcctgactatttgcttctccaattctaggtcaaggttttaaatggcatctgtgacaaaacaatccgatctaccacagatcctgtgatgagccagtgtgcatgtctggaggaagttcacttaccaaacattaaacctggggaaggcctggtaagttctaataacacttgttttattttcagataacatacatcatcatttactaaatttttaaaaaaattccttattgctttcactataattctgaaaagcagaattaatttagactgccttccattatgtaattaggaatgtgctatcttgaatcctgttgatatgttttctatccacaaagtataaaaataaatacagtttaaaaactgtatactcgtattttgaagataacactttatttttaggacttagcaatgcaaggaaatataaaacacttacacaaaggaaagatggtctctgggtacaaaaataacatctgctctgaaagtattagcacttaggatgaatgtgagaagggactggctgaaggcagtgattcttaagaagggtttagaaatgtttcataagtaatatatgagctatatcataacaggctgtgggactacatacaagtgatctcctagtacctagcgtgcatcttatgggattaatttgctgaaattttcgtgaagaagctgtgaagcccattaattagcttagaggctttgagtcagagagagctgggtttaaatcccggctcttgagggacttaacctctttacatgtcagtttcctcagagggttgttgaaagtattgtattagattgtgaatgccaagtaccaggcaccaagcatatagtacgtgtgcattaatgtggctgcagctacagttgctggtattgatgatgttgaggagaaggaggaggaggagacgggggagggggaaagtatctaatgtataggtagctgtcaggagctgttaaggcagtctctgctcttagaaaaaacaaaaatcaaccaattgttgacaggcccacattcttagtgagcagaaaaatgcatattggtactgcttggcttcaaagcaaatgatggattatatcagattaagtttaaacagggaggacttcctggaggtaggtttatagtcacatatttaagcagataaatgtcctgagtaggcagaaatggagttgtcatttcagatggtaaagttataccagcaatgccctgggagggggagtaccatgtgtagaggagaagctgatataatctgcgagtgaaagtaacaggataggagaggaatcaggagaacctgaaggcgctggtgtttgatggggctctcatcatagattagcgtaggttgatgagcaggctgggtgcagcataatttctgaggagggtccacattattacagcatagataccaggatgagcaactactttttacctggtctactttttgctctctttccccatcttgtaacagtttaatttaaaaaaaatgtacacgtggtgagtccaactgcagaaatagttcctcaatgatacattcggtgtatcactcagtgaggcattggcctctgagtttacctctcaggcctctgaggagagagaatattcattcatctttacatttcccttaaaaggaggggtgtctgttactaatttgctacctatgctttgttatttaacaatctttgttcatatatctttgtctggattattagtagctttaatagtcactctgaggttatttctgttaccaaatttaaatgaatatattgtgtccctagacagagaaatggtcaagaaagaactgttctttggctgggtgtggtggcttacacctataatcccagcactttgggaggccgagatgggaggatcacttgagcccaggagtttgaaaccagcccgggtaacatagtgagatcctttctctattaaaaaaaaaaaataattagctgggtgtggtagcacacacctgtagtcctggctacttggggaggctgaggtgagaggatcacttgagcccaggagttcaaggttacagtgagctgtgtttgcatcgctacactccagtgtaggcaacttagcaagaccatgtctcattattaacataatagaacagttgttgtttgaagtgcctcactcattcactcatcctgtaggtctaagaacactcccacatcctcggagttgtggcataattctgtgtgcctggtacacagattatagtatcaaagagatcacatgttttatttctttcaccagtatttcagtttgcttagctccccttcaccaccctttggatcttgtttctcgatgtttcaggaggctgaaaaatgagtattgttctgaagggactgttgttaatgttttataagtttaagtctcactcggggctatgtctctaaacgttggagtaatgagttaatctatttgtgattcactccagggcatgtacatcaaatcaacctatgatgggttacacgtgattactggaaccacagaaaatgtaagtgtatattcattaagtgtaaaatctgttgtgtgtttaaacagatttgatccacagtctctatactttgaatttaaacgtgtgcatgctgtttgattattgtgagagcgtgggtacctgctttgtttatttctgttgatagagtactgcttgtcaccagctgttgtcaatctattatttaaattgtcctttattgctcttgttcatataccttgcccagtttttacccctacccttgtgttaattattccttttgcacactggaagtgttaagccataaatacaaaagcaatgatctttttgtttttgagagtcactcttataagaactgggattggtggccatgtgtataaaatataattttttttatttaatggaatttttatgtctccaaagcagctatttcaggattttttacaacatatttttatagttgtgtttcataatatttggcatgatattgaagtttagtcctctctccccagcccttgaataggaaaagcaggtctgtttctactgtgagagacttctgtacactgtgtacttccttctggaaattctgctatgtgtagagttgtctttagcccctcaaacattttgaatttgtgagaagtagagctggttgaatgctttcttcttgcagcctacaatgtggcttgcttttgaaagacattgatatgaaactaaaaatgtttgaatagcttccctgggtctgtgcaaaagaagcatgtatttgggggaattaacctatttaatcagctaagacaggaggagataattcctaaaattaggggaaattttagtagctgcttttctaatctgtttggtagaaatatgtgtctaattttgagcttcagatgctagatcttttgataaaggaaaatggcatgatctttgagtgtctgtgataagcacttgatgtttgtagtgagaaaatgatactgcttaaggcagtcaatgaattataaatacattgcatggttctggcagatgaatgggtaggaaatggtagtgtgtttcaggattctctgttgagctgcagcgaggaagccctgagagtcactaggagtttttataccatgtcacctcctagacaataacagcacaggaagctctgcttttaggctggggatggtgcggaagaaaagacacaagatgcaacacacgattcttccttcatccttgatcgagactcagtacattgcagctcagccgtgataagaacacagtcatatctgtttgtatggaagagaaacatggtgaatgtcttttcagtttttagagttgaagttttgcaatctagcaatttgatgattacgttgtctgtcttaaccagaccagtgtgttttccaactctattgggtcttcttgaagcaatttccctcttggatctggagcactacagaattactactggaaggcatagtacttccttcctcttgcaccaccccccgttttaaagaaaagacgggccgggtgcggtggctcacgcctgtaatcccagcactttgggaggctgaggtgggcagatcacaaggtcaggagatcgagaccatcctggctaacatggtgaaaccccgtctctactaaaaatacaaaatattagctgggcgtggtggcacgcatctgtaatcccagctactcgggaggctgaggcaggagaattgcttgaacccgggaggctgcagtgagccgagatcgagccactgcacagtccagcctgggtgacagagcaagactctgtctcaaataaataaataaataaataaataaataaataaaagagttcaatgacagactaaacaaagctgcttttgaattaaatgaaatgtcatatgccattaatgatatattccctgaattcctaccagaattgtaacactggctaacagactcaggggctgtcctggtattcccatgtaggactgtatggaagtcgtctcagggagtggtggctaccatcttgttagagatcaaaaaagaaaacttgtcttcttccatctggtaatccacttgaaaatgtcactcattcctttagtcattcaattcgcatttattgaggacctggaatgtgctagacactaggctaagtaagtctaagtcttctagacaagcatgggaagttaggtgagagcccacttctcccaggctcaatctggatattttattcttaatgttgggtattaatacacttgaatggcagtagaaagtgccagctccaggtcagcttttggctatcacttaaggttgctatgacttcactgtcagaatgttttaatggaagaagcctagtatggtgggtagcagtggatgaaaatcacccattgttttcacaagtgaattatgtccatattcttcaatcttggacttgaggctgaagcaagcaaggccttcagtccatttctttgaaggttacctgagaggccaggatcattccaaagtcagacaagcagtgtctgatgtttctcttatttctttttttgatgttattttagaccttgacaagagtcttgacacagcctcatccatacttctgtcctccacccctgagatccggtgggagttagattagcctctgaagaatgggtgcattattctctaggtcatgacccttctgcagcaaaccaacacaagcatcatttttcagtagtcctcctcatggtgaagataggcaagagctactgccctgggcagaattttggtaccaagctctctctttaccagtgttctgccaaacacaactcttaatcacttgattggacatttgagaaatgaaggcaaaaggatccttaggaagggaagtcaattcaggacatcagagcatgttttttaagattacacatctagagacagggacttcctagccttggggctatcttttgtaaagtgaagcttatcttaaatgaatcctttgcccaggaagattaactggactggaccgattaggatcagaattactaaagtaggcctttaactgtaggttaagcatctggcacacagggacaaaaaggagcatagataaattcattttttaagtgatgtaagaaatctgagatgagccgggtgcggtggctcacgcctgtaatctcagcactttgggaggccaaggcgggcggattacctgaggtaaagagttcaagatcagcctggccaacatggtgaaaccccatctctgctaaaaatacagaaattagctgggcgtggtggtgggtgcctataatcccaactacccgggaggttgaggcaggagaatggcttgagcctgggaggcagaggttacagtgggctgagatcacaccactgtattccagcctgggtgactgagcgtgagtgagactgtctcaaaaaacaacaacaacaacaacaaaaaaacaaaacagaaacttgagatgaacatgggctggtctctcaggtgagcactgtcgggtacggtagcaggttaaatgttttcacaaataactcacagttaccagggccttgtatgaggcctagataaaatcaaagggaatatttctacagtttagggctgcttgttaatttcccgttgagcctgtcacaacaatttagagaaacttcagccagtgtgtcttgggtctcattgctgtccctctccctgtgttcaaaggtgctattttttggatatttggaaattgtttgaagatttagccagtaatgtaagttagaaaattaaatcctctattctagataatgtttgattagaatttgaaatccaaggtttatcttttcttcttctcttagtcatatatgagataccttcaacataaagagttctaggctaggtggctgatatgaacaagaacaccatgagcaaaatatttgacaaatggattatatccctttatatttcttttttcttttcttttttttttttttttttgagacggagtctcgctctgtcgcctaggctggagtgcagtggcgcgatctcggctcactgcaagctccgctcctgggttcacgccattctcctgcctcagcctcctgagtagctgggactacaggcgcccgccaccatgcctggctaattttttgtatttttagtagagacgggatttcaccgtgttagccaggatggtctcgatctcctgacctcgtgatccgcccacctgggcctcccaaagtgctgggattacaggcatgaggcaccgcgcccggcctatccctttatatatattgttgttgcagtgatggtaaattaataaccagccgttatttgaaggaaaaaaagtctggattttgttttgacactgaagactcatttttgaatgtaatctgaaaatgaaaagaaaactaaattcattttctttaaagcaatttctgttgccaccaactttctattttaacagcattgcaataatatgtaaaagaagatagaatgagaacaacatttagttttaataaggaaacgagatgacagacttacaaagatgattttccacgttgaacagttggtcagcttttatgagattaattttgataaggatatgtgtaagaatttttttagatgaaccaatagcttttatcagccaatcattttgacagtatgtccagactgggcgcggtggctcatgcctgtaatcccagcactttgggaggctgaggtgggcagatcacctgaagttgggagttcgagaccagcctggccaacatggtaaaacctcatctctactaaaaatattagctgggcatggtggcagccacctgtaatctcagctactcgggaggctgaggggggagatccgcttgaacccaggaagtggaggttgcagtgagctgagatccaccattgccctccagcctgggtgacagagtgagactccgtcttaaaagcaaaacaaaacaaaagacagtatgtccagtctcttcccgatagattagctgaacctggctgttctaacagacaaattatcagttataacagacactaataagatagataacacaggattcatgtgttaaggtcctatagactgtgtagtctcaggggaataaagtgcattgttttatttttcctgagaaaatgttatttcagttgctaattgtctacagaagaaagaagaaataaaagcagaaagaaatagaaggtttaaaagaattaaggcaggttattttgtttctgtacagtctcctgcagacagatctcagaagattcatgctggtgacgaagtcattcaagttaatcagcaaactgtggtgagtttgtttattgaggctcaattttcctccttaaaacttttaattaaatctaaaaccattttgtttaaatttttaaaatttgccgcttatatcctatttttcattattttaggttgtgctaacatgagcatacttacgcctgcctattttgtttctatgtatctgctcacaaccctgactgccctgagataaattcataggttcggtttttttcgttattcatgagcaagtcttccctccccatttgctttctttgaaggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacaggtatctgggattaactgtaaacctccatccaacaatgttgagtatctcattagtctccaaacaaaaagagattaaaatttgaaggtgattgattggtttcaggagtttgtatgtaattatcctatactcctgcctatgtgaaaatatgaattctagatctacatggaacagtatatatagtagccagtaaccatatatgactatttaaagaatgaggccaggcgcggtggctcacgcctgtaatcccagcacttgggaggctgaggcgggcggatcacgaggtcaggagatcgagaccatcctggctaacacggtgaaaccccgtctctactaaaaatacaaaaaattagccaggcatggtggtgcgcgcctatagtcccagctgctggggaggctgaggcaggagaatggtgtgaacccgggaggcggagcttgcagtgagccaagatcgtgccattgcactccagcctggacgacagagtgagactctattctcataaaaaaaaaaaaaaaaaaagaatgaaatgacattaaaagttaatctctgcatgatcactggctacatttcaggtgcagaatattcacatatggctggtgactcccatatcggacagtgtggatacggacattttcattattgcagaaagttccttctagtccttctcctctctcatttcaaacacatacctacataactgtatacagtttgaacactaatcctggagagaccacatgaggttgagtcatcagcagcgctttaccaggggagggttgggggcggtgagtgcagcccaccccatggggacagtatcacaccattatttagacattatgtagtattgccaatctgcgctgataatagaagactgactgagttttatttaaattcctttcaaacgatataccctcttattgccgacacctgggtggatcacactcactggtcacactccttgttatgccattggtccttagtgcttatttcataaagcaagaatgaaaagcaataaccttataatgcccttttataagattgagattatggtttatttgtgactatttttgatgttattgtatgtcttcctatggaagaacagtagtcttaaaccatcaactttgaaactttgtgagacaaggtactggagacattgtaggtgtcacagaagagaggttaaaaataaataactgagaggccgagtgtggtggctcacgccggtaatcccagcatcttgggaagctgaggtgggtggatcacttgaggttaggagtttgagaccagcctggccaacgtggcaaaaccccatctctactaaaaatacaaaaagtagttgagcgtggtggcctgtgcctgtaatcccagctactcaggaggctgaggcagaagagttgcttgaacccaggaggcagaggttgcagtgagctgagatcgcggcactacacttcagcctggatgacagagtgagaccctgtctcaaaacaaaaacaaaaaccaaccaacaaacaaaaactcacagtaataaaggtagggcaagaggggaacataattacaatcagtttataaataatgaccaaacatattttaaaattcactttttaattgacagatacaaattgtatctatttatattgtacaacacaatgttttgaaatgtgtttacattttggaatggctaaatcaagctcattaatacgtttattacctcacatacttatcatttatttgtggcaagaacacttaaaatctacaagtgttatagcaacttagcaatttctagcatgcaatgaatttattaaattgggttgtttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaccaatgcatttttattaactatagtcactgtgctatacaatagatctcttgagcttattcttcctggctaactgaaactttgtaccctttgaccaggattccccaatccccttccttctaacctctggcagccaccattctactctctgtttctaagagttcaatttttttttttttttagattccacatataagtgagatcatgtggtatttgtctacatgtgcctggcttatttcacttaacacagtgtcctccaggttcatccctcttgtcacacatgataggatttccttttcttctttttttgttttgttttggtttgagacggagtttcactctcgttgcccaggctggagtgcagtgccgtgatcttggctcactgcaacctccacctcccaggttcaagcgattctcctgtctcagcctcctctgagtagctgaaattacaagtgcccgccactacgcccagctaatttttgtatttttagtagagatggagtttcaccatattggccagtctggtctcaaactcctgacctcaggtgttccgcccgcctcagcctcccaaagtgctaggattacaggcgtgagccaccatgccccacgagcatttccttctttttttaagggtgaatagcattcccttgtgtatatacaccacattttccttatccattcatctgttgatggctgggctgttttgaaaaatgctgcagtgaacatgagggtgcagatatctcctcagcatactgatctcatttcctttaaacgtgtatccagtagtgaggctgctttttaatttttcaggaaacctccgtagtgttttccataatggcaccactaatttacattcccaccagccgtgtgctaggatttctacatttccacatccttatcaccacttaccttttgtgttttgatagtagccattccaacaggtgccagctgtcatcttactgtggctttgatttgcatttccctgatgattagtgacactgaacattttttcatatctctgttggccatttgtatatctccttttgagaaatgtctattcggggctggctgcaggggctcatgcctgtaattgtagtgctttgagagtccaaggaaggaggatcgtttgagcccaggagttcaagaccagcctgggcaacaaagcaagatcctgtctctacaacaatttttattttttaaaaccaactagctgggtgtggtggcacgtacctgttgtcccagctacttgagaggctaaggtgggaggattgcttgagactgggaggctgctgtgagccttgattgtaccaccgcatccaccctgagtgacagagtgagaccttgtctccaaaaaaagaaaaaaaaaaaaaaaaagcaagagagtaatgtcaattcaggtcctttacccatttttaaaatcaggttctttgtgttttgttttttttttttttgctgttgagttctttgagttccttatatactttgggtattaaccccttatctgatgtatggtttgcagatattttttaggttgactctgccttgtcaattatttcctttgctatgcagaagctttttaatttgatgtaatcccacttgtctgtttttgcttttgtcacctgtgcttttgcagtcagagccaaaaaatcattgcccataactgagcctattgattatactccagctgtttctgttggcattggtcagtgtaaaatttaaacttggttagatttttttggatttctcagaatatgatgcttaacattccagaggcgctaattccttgtaggtaattgatggagtgcctgtcaaatgcttgctctgcccgctaattgttgcataagataaatgttggattctgaaggagagagaggtatggactgtgaggtgggagcctgggagggtaggtgggatttgcattggcggatgggagcatgtatggtagaggagatgaatgctattcttcaaacacactcgcccacaaaacatagatagaccaccatcggggaagggcggtgtcttagataaggtatcctagagcagagtcttaggtgtacatccttgtgaaagcaattttgagggtatgtgctccaagtaaaactggtaagggagagagaaaggcagaatgatgacggggaggcagcaaggatgcctctcaggtgcagcgtagccttgacctactaggcaggacgaagcatcctggtggagccacacagctccgggttctggtggccctgctcgggcgaggcagctccgtcagctgagggccattcttctgagaaggggcagctgtgtgctttagcagctgacattcccagcagcggggggtggtagtggcggtagtgagactctagatgggctccagagcttctaccagaagaaatgagtagctcagactctgtggagctgagggtgggagataaagttggactggttgcctgagactatattggcaggtatggagtgccaggctggggagcatgggctttcttccacaggtgacaagttgacagctgcttttacattaatacctctattactcagctaggcctgccatacggggtggtagaagttcaaagtcaaggagtcagtggagatggcttcattctgaggaccctctccttggtgtgcaaatggtggtcttcttcctctgttctcgtgtggtcttccctccatatatgtctgtgtcttaatcttatgggacaccagtcatgtcagattgagcccaccctaatgacttccattttaacttaaccacctctttagagaccctatctcctaatacagtcacattctgggtactgggggtgagaatttgaacacaggaattttaggggacacagttcagcccataataacatctaaacataagaaccaccaaaagggaggctgctgtataagggtagctacagggcgatgtggtcctgggcaaggctggtgatgggtgattcagtgaaagaaagactaagaatgctggaggccactgggaagcacatcagaaggcctcaggaagcagcacagcctagtggttatgaatgtggcctctgagttgaaccacttcagttcagatcccagctctgccacttactagctgttgtgggacccttagtcaaggtatgtaatctttccaagccatgctcttctctttaatagtgttgactattcgaaaatgttttggggtaagggtgagaaaggccagcaaggctagggagaagcaagtgtccaatgtgacagggaacctgcgtggtgacaaaaattggaaagtcagaaaagaggccatttggaaggaagagatgttaggtattttgagcataattgagtttgaggcaatagaggaaaactcacatggttatgttcagaacatgagtgaaaataatttttaagttcaggctagcgttggtcccttgacttctggaaattcacttaagaagagacactgcgatgttctctggtttgcctactttcctgccaagtccctctagctgcagtttggggaagaggtgctggtgagagacagagactcctaattttgcttgtgacacagggagataattaccatcaaaatgcagacaccattttatagcttagttaccaggtgttcttgcgatgtgcccaggatattttcagaatataaactctggtagacaaatactctgcagacttagtccccagccctgggggtttctctgtgttccattcttcattattctttgtacctgggcacccacccttctcagaagagagctctaagttgttcaacatcattactgttgtcctatcatagaaaaggcattcaccactctgttttgatgccacactcctgggaaatgagagttactgatatagaagtaattatcaatatgtgtgttttcagggagcatcaattttgtggaaatgttctagtttacttttgcttctaagatttggagaatctggatcctggcctcatgttttcagatatggtccgaaattgacatgttgagatgtcaatcaattacaaattgagtagaattgatagattatgcattaatggccacggtttaaaatatgggggttctactctggaagactgaaagctcagtccctgcccctgtgacttggtatctctcctgaaaatgagctgtcctctgtgaatctcctggtggccatgtctagctccgtcacactggctagtcagtcctttcaatccttagaatcaggtcacagtttcacttcagagatctcttccattacaaccaggctgggtagggttgaagggtagctttttgttttcgtttttgttttttttggtagagacggggcttcattattttctctaggctgatcttgaactctcgagctcaagtgatctacctgcctcagactcccaaagtgttgggattattacaggtgtgtgcccacacgctgggcctaagggtacctttttatgtctgcccagggcttggcacagtctcactggccttcaccaaatatttccctgccttgactccaagatttccttgctgttctttaccaaccagaaaaatcattgttgtcattgttagattgtagaaggtaagattgaagttctcacatgagatattaaaaaccatgtcctttgagaccagtatcatagttcaaactcagccatgtggatttgaagttaagattaactcgtatatatgaatgcatatatgtataaatagtactaaaataaacggtataaggttgtgtattttctatgggaaagcagtgtcctaagttgtttacatgtgttatcttacttaattctcacagccaccctatgttggtgctatccttgtccctatttattctcattttatagatggggcacagagacattgtgtgacttgctcaacaataaacagctaataagggctgtgcgtggtggttcacacctgtaatcccagcactttgggaggctgaggtgggcggatcacctgtggtcaggagtttgagaccagcctggccaacatggcaaaacgccatctctactaaacatacaaaaattagctgggtgtggtggcacgcacctgtaatcccagctacttgggaggctgaggtaggagaatcacttgaacccaggaggcacaggttgcagtgagccaagatggcgccactgtgctccagcctgggagacagaggcagactccatcttaaaaaaaaaaaaaaaaaaaatgggcagctagtaagtctagccaggatcacatccagagttccaagcaatactcctagtcaatagtagcactgctactgattgctttttcttttcttttctttcttgtttttttttttttttttttttttttgagacagagtctcactctgttacccaggctggagtgcagtggtacactcttcgctcactgcaacttctgcctcctgggctcaagcaatcctcccatctcatcatcccaagtagctgggactacaggcgtgtgccaccacgcctggctaatttttatatttttttcgtagggactgggtatcgccatgttgcccaggctggtctcgaagtcctgagctcaagcaatccattgtccaccttggcctcccaaagtgctggggtaacaggcaagaaccgccgtgcccagccttgctagtaattttcatgaactaactcatctaattctcactgcagctctatgcaagagatattatcagtatcactcctttacagaagaggaaagggaggccacagatgtttaagtgatttgctcagagctagagtcataaccctggcacctggctcctaagcctctgcttcttgccactatacatcgtcattcaaatccctcagctcattctaaggtttcaaagaagaatgtaagttaaatattgccaatatctgtaaacacatgaatgacctcagtccctgttcagacacggggttggtgttggtttgggggaggggaaataaacaccaagaatcatctctgaattgatctccactctttgcattgctgtgttactcctgtttcagacctcacctccacccgcgacaacccagtcccctgaaagcactatggatacctcactgaagaaggagaagtcagccatcctggatctttatattcctcctccgcctgctgttccctactctccccggtatgttgctgtccattgtcatggtatgcttgtctcctgttggtgtcatttgtaaatggtggtgtgaaaagaggatcttgagagaggaagttgctgagccacagtgtgacagggctgaatcttgaactgccgttaaaagtatgatcagccttattttataggagtgtagggacatatctgggttctgtggggcttgaagctatacagtttggtggggagggcccttctgagaaaagaatatggcagtattggccaggtgtggtcgctcacacctgtaatcccagcactttgggtggctgaggcgggcagatcacttgagctcaggagttcaagaccagcctgggcaacatggtaaaacctcatctctataaaaaaatacaaaaattagctgagtttggtggcagatgcctgtagtcccagctactcaggaggttgaggcaggaaaatcgcttgagcctaggaggtggaggttgcagtgagcagagtttgtgccattgcaatccagcctgggtgacagagcgagaccctgtctcaaaaaagaaacaaaaggatatagcaataccttacttttgaaaaacgaatgaaaacgtgctctcctggggccttggaagggtctattgggggccctgcaggttaagtttcattaactccatggtaaattcatcttgagggggtagataataagtatttctgtgagattaatgagagttgcagcttgattttgctgagaaagatgtgttcttcatagaacttgaaaaaaaacctatgtggccaggtatggtgtctcacgccaatatttccagcactttggaaggccagttcagaggattgcttgagcccagaagttcaagaccagcctggggaatatagtgaggccccatctctacaaaaaatttaaaaaattagctgggtgtggttgtgtgcacccgtggtcctagctactcaggaggctgaggtggtaggatcactggagcccaggaggtcgaggctgcagtacaatacaccatgatcataccactgcactccagcctggacaacagagtgagacctagtctcaaaaacaaaaaaacaaaaaacagaaaaactcagaccttgtgagtgtaggtatgaacatttcatatttgtgtgtgtgtgtgtgtgtgtgtgtgtgtgtgtgtgtgtaccataaattcttaaaaagatagttgctttcttcatggctaacttgaatactgtatggtataatgagggtggtatatagagtgtacaggatgatttaggtgtgatctaggcttatttttatcaactcacatatttatatatgttgataaaactagacaatctggctcatttattcagcatatctttcctgagtattgggtctgggttaccctctgacacaaaacagactcggtctttgaccctacagaactgccagggtcttattcaacaattcaagcatatattgagaaatatatgattaggttataatatttcataaaacaaagttcaggctggattttattacagtgacattttactttctatcagaattttttgtttgttggttttcatttgaagctgaggtatttgcttcattgtatttcttctgcattgggtgcagagattcaacattgttttccatttccttgagtcttggcttactcagaacttattatagcgtgtagagaatgtacctcaggtgattggggcattctggtttgcaggatcttaagtgtgtttaaagttacaggtagtctttccctctgcatatagagagcatgacattccactactaatgtgtggattgttctatcagaaactggaggaaggcaccctcccttgatccagaatattcttgtctgggttcctggagtagtggcaagaaaaggggtgctgtgtacatagtgagagataaaggaacctggggctaggaggagagctggattaaactgctcgggaagacgcttttgagagtgcacacacaccactcatgaaggattttctgaggaatgaaaaatgggaatggattactgagaaacaagtcatgagtcatgaaagctttgtgaatggggagttatatgcccggtttaaaggtatggaaggagatatatttgtgggtgggaggggtaggtggatgccatcccacctgggaataccacacacagacatggctgattagtagattgctttgggactcagttgattctgtattttgtctagcagtttttgtcctgatttgcctaatggaatttaccaagtgcaaaaaaactaagcagctggtaacttggactcaaattaatcctacagtttaaactgacatgtagatagaattagaatggaatcagtgatccaacttttgctggtttttgtagtatttggttcagaaaagaatcactctccattggttactataaaggttcctttgtatcttttgacatggttttcaaatctaacaacttcataatatatcaagtcttttttgctggattttggcagagatccgactcttggcatgagcaacgtggttcgctagagcataccttaatgtgtgattgctgtagtaaataggatattcagctacacacagaagcacaggaaaactagagctgtcttttcaaagctatatttgtttggatataaaaaaaaaccctgcatttactcttctttttttttttttttttttttgagatggagtctcgctccattgcccaggctggagtgcagtggcatgatctcagctcactgtaacctccgcctcctgggttcaagcacttctcctgcctcagtctcccaagtagctcctgccaccacacctggctaatttttgtatttttagtagagatggggtttcaccttgtttgtcaggctggtcttgaactcctgacctcaggtgatccacctgccttggcctcccaaagtgctgggattacaggcgggagccgctgtgtccggcctgcatttattcttatttcatcacgtcatggtattttgcttatttaataggatctgtatgtatttgagcggcaactggggttgacaaaaggaatgcttttcctccagtggaaaaggagaatttaaattatcttctgtgtgctggaggtagcagcactgctggaattcttcagtatgagaacatctttgtaaacaacttaattattgtccatattatcttccagggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggtaagtttcaagtgtttgttttgttctgccgttggccttgacttctcctccccgccccctgccttagttggaactgttggatgaatttggcagacttcaagagtaatctgaggaaaacataaacctcaatgaaattctaagtatgagacctttattcatctctgtcaagcggatccttgttgagtcattactctgcctggcatgaaagcccaactgggtgagatcatgttacagttttaactttcagtgcctgggttttagctttggagttgctttgctctgtagactcacaggctcaagtttaatgtgcctctatcttagtagcactctatttcctgctatggaaatacagtgctttaaaatacttttattttaaaatttgttattgcttctgtctaagtgggtgtggtattgtgaggtctaagttatacataaagggaacggttcactaaagttccagaactcatcaaacttgtcaccttctttctcgtccctctgaaggcaagccacggcctttgtccatgcctgctgatgggaactggatggggattgtggacccttttgccagacctcgaggtcatggcaggaaaggtacgtttcatccaagcaaaccaaggaacagcaaatggggagtgaacagccccagggcctggtttcacctctgtttctaaatgtgttataataagtagactgagtacttggcctttctgagtcccgttttctcatctgtaaaattaggactgctgaagatctttaagatcctacttatttctagaatggcaaaattatataatcctagttagtgattgtaaatatcctaattagcattgagtgctgtaaaaaggctatagactttaatggtctaatttttattcatttactttttagagacaggatcttgctctgttacacaggctggagtgcagtggcgtgatcatacctcactacagccttgagctcctggactcaagtgatcctcctgcctcagcctcctgagtagcagggactacaggtgcacgccaccacggctggctaattttttttttttttttggtagagacagagtctcaatatgttgtccaggctggtctcaaactcctagctgtaagtggtcttcctgcctcagcctcccaaagtgctggaattacggggatgtgccaccatacccagccaatagtctaattttttaatgaatagaaataaattattcattaaacaatctttttcaaaatttatttttaaaaattgagatggggtcttactatgttgcccaggctggccttgaactcctgggttcaagtgatcctcccacttcagcttcctgaatagctggtgttacagacgtgtgccaccatgcccagctttcattaaacaatcttattctaaattttgttgcttttatttttggagtctgtttgatttctgatgaacaaacatggatttttttttcttccaagtccttcttatgttagaaggcagttactatttgaaaagaaatttgtgtttaattcaccctgtaatcaaagtccctggttattatgctggtcttgagtgaaatgttttaaaacattctcattttattgccagattgcatttgattgtcatcattggcagaacattataacattgtttttgcagttgttgaaacaaagggcagttgaaaagttaaagtacaataggctttagatagtaaaaggaagaagaaaaaattctggaagcctaaccttccaaagggattgattgacccctgaccctttctagggacttggtaaagtttgtcacctaagtacccatatcacctgtattatgctaaagtgaaaaagggaaagatgcctgggtacctaccattcaggatccccttagttaacgtgtgagtatccatggagcagtcagcaggtggcagggctgtccgttgtttagatttagacacgttaacatcttccttgccgttcatctgagccagggttgagccttttatttattttatacatggagagatgaagtgtcagggttatggggtgtgaaattgggaaatggaaaaatacttgttccctccactcctccttgcatatttttcttgcatgattgttttggaataaaggtatctatctatacacagccacttaaaaaaataacagttttattgagatataactctttgcatgaaattcagctttttaaaatatacagtcaggtgggttttagtatattcacggagttgtaccccagttgccactattccagaacatttttgtcactccaaaaagaaaccttgtgccttttagcagtcactcccaattccgtccttcttcagcccctgacaggcactcatctactctgtggatttgcctgttctggacatttcatataaatagacttatgcaacatgtggctttttgacaatgggcactttttcaatgtgactgttcccctttcattacaaaagcaaagcaagtacattgaaaaacatggaaggcatgagaaaataaaactcagctggaatctgtttctctgacctaagaaataatcactgtgaatgtttcgtgtgatttccagttgttcctgtatttacatttatatacttagaaaaatgtgcaaaatgggagaagttggccaggtgcggtggctcacacctgtaatcccagcactttgggaggccaaggcaggcggatcacgaggtcagcagttcgagaccagcctggccaacatggtgaaaccccgtctctactaaaaatacaaaaattggccaggtgtggtggtgggcgcctgtagtctcagctattcgggaggctgaggcaggagaatctcttgaacctgggaggcggaggtttcagtgagcccagacctctccattgcactccagcctgggcaacagagtgagactccgtctcaaaaaaaggggagaagtaaatattcaataatactatgtaaaaatgaatattatctaccccatatttgaaaagaatatagccgtattagaatgccatcttatggctctagcgcctatttattcaacgtgccactgttggaaatttaggtttttttttttttttttttttttttcaaattctaaaatttgaaaaaggctaaaattttctaaattctaaaatttagaaaacttagaatttagaaaatttagaaaattctaaaattcaaattctaaaatttgaaaaaggtttcagtaggctaggtgtggtggctcatgcctctaatcccaacactttgggatgctgaggcaggtggattgcttggtctcaggatttcgagaccggctgggtgtggttgtgcgcacctgtagtcctagctacttgggaggctgaggtgggaggatcgcttgagcctgggagatggaggctgcaactagctgagatggcaccactgtactccagcctgaatgacagtgagaccctgtctcaaaaaataaaaataagcataaaaataaatgtttcagtaagcatccgtgagtccatagatctttgcacattttggggtgtagaatttccgcttcacaaggatgctacatgttaccaaagtgtgctgtattttaagtttctattcagtttcttaacattccagccacatcccagggggtctgctggcagttagggcaggatcactcttttccttgttcgggaatgttcctgaatgcccagcttgaatgccctgcattaaacaatgcataaacagttctgttcagccatcgcggggacactacactctatggtccccacccactaaaggagacccgtgtgctacctctcaggcgctaaagcagcctaaagtatgagggacccttcccatttctgcttccagagcacccattggtgggcccagccacaggtgggaccttgtggccaatccagggaggagagcagtaaaggtatggtgcccacattcagggtggtggcagaagtctgggcaggccgagggccctccaaagagcactgtgtaggggattgtgattttttttttttttttcctggaggggacagagtctcgctctgtcaccagcctggagtgcagtggcgcgatcttggctcactgcaacctccgcctctcgggttcaaacgtttctctgagtagctgggactacaggcgcccgccaccacgccagctaatttttgtattttcagtagagacggggtttcaccatgttggccaggatggtctagatctcttgacctcgtgatccacccacctcgacctcccaaagtgcggagattacaggtgtgagccaccacgcccagctgggattgtgacttaatggactttgtctggaaacaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcggcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactcttagtcacctgtaattgaaatatttctgttttgcgtcatacacgaagctagtgaaaaagaaagtgcaaggcattttcagatgagcaagtgactatcgtggctgttgccagcagggcagtattgttaaaaaaaatcaaaataaaccctcccaagcattttgggattttatggattagaaatggaagaacaggagaagcatatgcaaagtgaaattgcacgaggggaattttctgaggtatcttcctaggcagagccgaaatctcctactccaaaatgccctttctcataccaccggaattgttgagtttgctgaactgcctggaattcagcccatgaaaatcactggagttaggaaacatcttccctttaaaatgcttctggtgtggttaaaggaactagcaaccactcatgtataattactgtgactgaattcagtcaggctggttttttttgtttgtttgtttgtttttgagatggagtctcaatctgtcacccaggctggagtgcagtggcgcaatctcagctcactgcaacctccaccttccaggttcaagcgattctcctgcctcagcctcccatgtagctgggattataggtgcccgccaccatgcctggctaatttttgtatttttagtggagacggggtttcactacgttggccaggctggtctcaaactcccaacctcaactgatctgccggcctcagcctcccaaagtgctgggattacaggcatgagccaccacacccggctcagtctggctgttttcttctctacctctaagacaactgccatgaagatctggtatttcggcctggcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggccaacatggtgaaaccctgtctctactaaaaatcagcttcgcatggtggtgggcacctgtagtcccagctactcgggaggctgaggcaggagaatcacttgaaccctggaggcggaggttgtagtgagccaagatcaggccactgcactccagcctgggtgacagaaggagactctgtctcaaaaaaaaaacaaaaagaaaaagatctggtatttcatggagacatggagacccaagggtgtttggcagatggagagaagaggcttgcagtgtgtgaccacagggtgttcaacacactaggagggtggggtgtgggctggggaggtctcgtgtagggcactggtgatgaggagggagctgtgtacgaggggcgagccagccctgcctgttttactcttgtcttgagctggctttatgcccaggaagtgggtggcaacatctcctcttactccccagattgtggggagaactctaagagctgtagttccactggatgatgagttaaatcactctggaggccttagctggctggtgagctctttttctgtggggaaaatgccacttgtgaattgaacagccatcctttaagtgaatattcggcagtcagtcttcattataggcagtggccaaccagattggtgcttttcagcctttgttccctggagtcccaggacccgcgagagaagttcctggctcctctacttgcagtcaccctccacagcttcatctttctttttatttgaggttttctcctgaattgtgtttgaaaaatatattgctgctaaaaaaaaaaaacctttgtaaacctctactatggacatacataaataatagtttaatatggatttcttagaaattaatggaaactgcttgcctcagtagtaatccaggtttaattgtggacgtgtgttcacatatgaagttgcttgatgatgctttttgacaggattctttatttttatttctttaaaaaaaattttttttttttttctgagacagattctcactctgtcacccaggctagagtgcagtggtacaatctcaactcactgcagcctctgcctcccaggttcaggcaattctcctgcctcagcctcccaagtagctgggattacaggtgcccgccaccacacctggctaatttttgtatttttagtagagatggagtttcaccatgttggccaggctgatcttgaactccttgacaggatactttacaagagtgatttttaaaactctcccagacacaactcaacacctacccctattataatattttatagcatcacttttcaatcttcaaatgaaaatcatggatgatgaagcttaccttcactcataaaaacatcactccatttactattctgaaatgaaactagcaggtaatataactagcctctaaaacatacccatcagtgacgttctaactgaaacagataagatattttataatgaaataattattttcatatgtacatattctagcatggttatattacaagatgtaattaaactactaagcagggcacatactttgtatgtgtgtgtataaatataaatatgtgaaaaatcaccatgaatgtggtagttaccaattcagacctgctgcattggcagttcaataccaggaaaggggtcgatgtcagcagtatgattttctaaaatgtggccaattctttagataaagttctaggcatacctagtctgtaatggcttcactcatatagtgcttgctgtgtgcctggcattgttctaatacctttctaataaatctatgaggtgagtactgctgttagtcccgttttgcatatgagggagttacccaggttatgtgctagtcatcctggttatgtgctaataatggcagagctgggattaaaatgaaagcagcctggctctggctttcttgctcataatcactcagtatataggcttccttccatttatagaattctctcattgcattcttgaaaaatccaaagcatattaaaactgggctgaaaattctgtgtgtttatatataaaatgaaatgagatcatagatttgttattgtaaactgagttcccatctatatgaatattgggcggggcaattgaaagttgtgttgatgagtcagctctttgttgtgagggctgtaagctgcagggcttgtgtatcacgcatgctccaacaggttaaatctcagtagtggccgcccatcagtggcacccctaacatgctcacatttccagaactgcctcttgggcggaggtgggggagggtaccatctctttcagaacaagtattttaaaagaaatcctgtatcctccttaagtagtatttcagtctatatatttgtccatttcctatctctgcttctctctcagttctttccccaccaaacctgaaatttcagaatctattttgtgggctttctttttttaattttttccctggaagaccatgaacattcctctttaggttgttagtattgcagcaaaccctgaggtattgacacaaaacttttcatccgccaaagagctcgagtaagtaaatctgtctgacatttgaatgtcaccagcaaagcatgagactcatgctgccttttgccaccataggcatgaatggtatggagaagtaggcctgacttgttttcttctattgtagatgagattagttttgtagaccattagttcacattttgctcctacccttgtgcataaaatcactgcatcatttccgtggggatgagactactgcaagctacttccttggagattctgtggaagatggacatcttaaaagtaaactacttttggtatgactgctcattggcttggccagtgatacttgatgttatttattttgtgagttactctgtgtcttaatcagctcaggctgcaataacaaaataccatacactgggtagcttaaatgacagaaatttctcaccgttctggaggctgggaagtccaagatcaaggtgagttcctggtgagcacccttaccctggtttgctgatagccatcatcttcccattgcatccttacatggcagagagagagaaaggaagcaagcaagctctcctttcccttcttgtgagggcgctaatattcatgagggctccaccctcaggacctactcacttcccaaaggcccacttatggtattagctccgcctcctaataccattgctttggagattagggtttcaacagatgaattttgggaggacataaacatgcaatccatagcactctgcttttgtatatttttcaaacctttcatgctaatcagctggaaggtgaatattttaaaatctattttaaaactggcttaaggagcacacaaaagctgatttctgatgtttcttccaatacgtggaaaattttgcatgatgtattaacccctagttagggtccctcaaccccagttgaggacctcaacacacatttggtaatacctaagggaatttaaatatatattttgtagcctatagcatatggaattagaaaaaaattagtctctttactgtaaaatttaccttttaattatttggaaatttcacaattgccaagtttcaacttaaagtttctatttatttggggccagaattattgccagaagtgtgctaatttgacaaagggtaccttttacataagtaaaggaaaaagtgattacatcatgttcagacctgctagagggccttgtttttcctctagttttaggggtgtggagtctgtcccaaaccctatatatgtgtgcatttgtgtatgtaaaagacaaattttttatactcaaaagtttgtcttaaataatggcctatggcctactgatttggatagaggagagaaattttgtctataagcaacaaaaaatgctacacagccaggagactgtcacacacagtttttcagaacctttgggccacatactgcactccccttccatagaaatacacatggggtcagtgattaaggactcaattctggttgtgacttggccatccataggcatattctaaagttctatggcaacctttatgaagctcgtcttctgagttgatcacctgttcatgcgctgcccatttacaacatacctcagggattaaaacgtgaggctacacctaaggaaagtcggtcctaatcctgcgtttcctcctgcatgtcactgaccattggagtcactgctctctgaggaagacagtttacagcctgagcattcatgtcacgctcacagccaacctgttacttgctggcctcctttaccaagctccttgtttcatgaagaagttgtgaaactgaagttggaggaaaaaaattaagaaataaacctcaaaggtatttaaaagggcagtagagtaattactcctcacacccagggataaggatattctcatcattttctctcctcttgcctggagcataaacattcagatgtttgtgaagaaatgattaaaaggagagaaaatatcaggagaaaaatgattaaaatgagagaaatgttcttccactgactagacccattaaaggggaggatttaactttattgttagaggggtgaaaactggattttaagatatttcttcaccattttgacatatcttgggctgaacattttgattattttagagaatcagggagcttcagaaatgaagtttaatataaagtaagattgtctctgaaggaagaaattgtccttttaactcagtgtcaggttccgttttcttactcatatctaaacttcctgtcactccaactgaggctgcaccaggataagaggagggatttgaggaattagcgcgaatttagaagcctttgacttttgggaatttgcatcaagcagatagaagcaggcgggggctcagcttttgaagttggatcatccagctgtctcactttgccacttatgggatctgtgacttgaagcaggtgactgacctctccactcctcagttatctatgaaatggggataatactagcatctacttcgaaggcttatggtgattaaatgagataatgtttttaaggccctttcttcgcatagtctggcacacagcatttaagagatgttgactcgtgttcctgtagtagcagtactgactccatctcagcctctagtgaataaggtattcagagctggccaacaggaaattgctcattcttttgtccataagcagcaaaataatgccagtgtgacactgtcagagggctgcagtgtggtcagtggcctagagatgcagcttttactgttagaaaactcactcggatgttttagccgattcagaactcaagaaatgacaaaagtctgtgattggacacacttttttttttttttttgagacggagtttcagtcttgttgcccaggctggagtgcaatggtacgatcttggctcaccgcaacttccgcctactgggttcaagtgattctcctgcctcagactcccaagtagctgggattacaggcatgtgccaccacacccggctaattttgtatttttagtagatggggtttcttcgtgttggtcaggctggtctcgaactcccgacctcaggtgatccgctcacctcagcctcccaaagtgttgggattacaggcgtgagccactgcgccccgcctagagtattctttcaatattgacttgatttgtcatcatcatatcttttctattaaatcccttccacttccttcaatgaaatcgtatatgaaaacaaagggaatcggagcattttgcccacctcctagttggctgaattatttttgcctcccattcccatcttgaagtggtattcctcaaactcgtttctatgtttcctgtggttttaaataaaggaataatgtagaatggtatctattttggacattctcatcgtgaaaaggaactcttacacaaatacaaagccaagagattgtgttgccattgttgaagctgaaaaggacagtcactggatgcctccccacccaaggccaaggctttggtaggtccaggaagtgaaaaggaaagagaagctatgggagagacaaagggaagtaaaaaatggttgttcggctcagcataacaatcacttttgtggggcttattggttgtgcataaatttcatccatttgggcacacacacagatgtgacacccagaccactcagacacttggctaacactgatgccgtcatcctgaatgttgtttctggaaggactttcatgaatagaatctatttcagattggccgtaagtctcgatttattgatccgcaccactggactggggtggggttgtgtccactttttccctgccccttccctgctttggctcttgtgattgtgtcctccgtgtgtcaggcagagccctgtgaaggtgtggatatgtggccatattttacctgcataatctgcagttcatatgattcagcctaatgggttgcaatgccctgaggacagagaccatactttttcttcctttgtctttttagcgaaattcaatcctgttctgcgcctgcgccacagttgcaggctgtactgtctgccctgtgcatctcacacacccccactgcactgtgcacctagtgatggccgcagatttgcttttactcatcttccagggcctaccctgttaattccatcacagttgcaggctgtactgtctgccctgtgcatctcacacacccccactgcactgtgcacctagtgatggccgcagatttgcttttactcatctgtttgcagggcctaccctgttaattccatcacagttgcaggctctactgtctgccctgtgcatgcatctcacacacccactggactgtgcacctagttgatgaccacagatttgctcttacccatctatttccagggcctgccactgttaattcctaggaaaaaagaaaaaacaagcatggtggattggttaaattggcattttatattgtttgtgttcatggccatgccaatgataaacaagagctggtcatgggcattcagatcagatgagcaattaaatcccctccaaaaaacagaaacctacttttagagaagaaaagaattaaaccaagatctttcagggttttgcttctccttttgtttttaaggcacttaaataaatggaagaacatgtaagctaaccgtgtttagagtactatgttttactagaaagtgctacccttctgcagatttctcctcaatgaaagaatgccactgaagcacctttaatggtgcctttatcctatagtcttattgaatcattctctttagccaacataaaatacaaagccagggtataagacttcatgtaggtggtaatttaaactaacaattagtgaggccgggcgcggtgggtcacgcctgtaatcccagcactttgggaggctgaggcaggtggatcacaaggtcaggagatcgagaccatcctggctaacacggtgaaaccccgtctctactaaaaatataaaaaaaaaaaattagccgggcgtggtggcgggcgcctgtagtcccagctactcgggaggttgaggcaggagaatggcgtgaacccgggaggcgcaacttgcagtgagccgagattgcgccactgcactccagcctgggagacagagcgagactccgtctcaaaaaaaaaaaaaaaagaaaacaattagtgaatttttgctgatgctttccttaaaccccttacttagcacttagttctggattcttaaatcctgataatggactcatccttctcggtctagttaccccagtaagtcccaaggtcatccatatgaggtcctccttgatcttactctgaatagaattaactggtctcttctgtttttccatagcattgactcatcgtgttagaccagcttgaattgtgagcctttctaaagcagggtctgtataatttacccttatatttgctctgtaggcagagaaaatattattgaagtaactagatggtaaaattaactgtgcaatcagaaaagaagttagaaaaaattattaaaattttctgtgaaaattgttttaattttattaatatattaaagcattttgcagactattccataaagaattttattacattggctctcattttaaagaaaacattataccaggtgtcagaactcaatcatatttataggaagaataagccttggccatcaacaacgcttctttggttacaggattacaggaactgctgagaatgtaagcactttccgaagtccacaaagaactcatttaaagctcgtacaggcagtttcaaattagccagggaaaagttaatggtggggaggtaaggtcatagaatgctctataaatggaggcgacgtggaggacagttgcagttgtataacatttgattgaaggagagggatttggacctgaggaaaccaggtctataaatactaaggctggctgggcacagttggctcatgcctgtaatctcagcattttgggaggctgaggccggtggattgcttgagcccaggagtttgagaccagcctggacaacatggtgaaaccctgcctccaaacaaacaaaattaaccgagtgtggtggtgtgcacctgtagtcccagctactcaggaggctgagatgggaggatctcttgagcctgagaggtagaggctgcagtaagcccagattgcaccactgcactccagcctggtgacagagtgagactccatctcaaacaaacaaaacgtacatgcatatataggctgtagactaaatagtgaaatattactaagaaccttcatcccaaggggttgagtggtagaaccactgagaatattgttgctgctcttttggagacaacaaactgcattaataaaagtctgagaacaagaaagttgagttttcaagtaatgtcctttgcatattgctacatagggctcatctgagtctgtgatgttctactttgttgatgaaagaaaacaagtggaaattctgctcccccacacatcctgcactgcaaaaagataacaagtagcaggagatactcaattatgatgcagttcaacaaagaaaacaaattaaaataaagagatcctgggtggttaaatacagagtctcctttgtaaacagcaatggatgatgatgatgactgttaccagggctctgtatgatcattttcccaattctttgga

SEQ ID NO: 1679 - DNA, 3351 bp, Homo sapiens
caaccggagctgaaactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggattggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaatgtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcggcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactcttagtcacctgtaattgaaatatttctgttttgcgtcatacacgaagctagtgaaaaagaaagtgcaaggcattttcagatgagcaagtgactatcgtggctgttgccagcagggcagtattgttaaaaaaaatcaaaataa

SEQ ID NO: 1680 - protein, 718 aa, Homo sapiens
QPELKLCNPSAHALRSALPGRHGRAAQEVGPAPGRLRDASARGAGTPESQQARRPAEGEPIAPREIRGSGRGPGGSRAEPRPGVWGRSPACLQLPSLGSSSCARDPGGGGGRRSCSWTVAAGGRGPGSPGGAALGRLADRGHAVLTESLGRRGAAAGAPSREGAPERRQQHFICDSPAQREAKRFTMEPVTKWSPKQVVDWTRGLDDCLQQYVHKFEREKINGEQLLQISHQDLEELGVTRIGHQELVLEAVDLLCALNYGLETDNMKNLVLKLRASSHNLQNYISSRRKSPAYDGNTSRKAPNEFLTSVVELIGAAKALLAWLDRAPFTGITDFSVTKNKIIQLCLDLTTTVQKDCFVAEMEDKVLTVVKVLNGICDKTIRSTTDPVMSQCACLEEVHLPNIKPGEGLGMYIKSTYDGLHVITGTTENVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPSYGKPRPLSMPADGNWMGIVDPFARPRGHGRKGEDALCRYFSNERIPPIIEESSSPPYRFSRPTTERHLVRGADYIRGSRCYINSDLHSSATIPFQEEGTKKKSGSSATKSSSTEPSLLVSWFTRLKLLTH

SEQ ID NO: 1681 - DNA, 68140 bp, Mus musculus
  misc_feature (1)...(68140): n = A,T,C or G
gtaaaattccctagttcattgcctggcacatgattggttttcgtagctaaaggtgtagctttggtaggatgtgtgtttagcaagctgaagtcttgggttctatcctgagttgtgtcccccccccccaaaaaaaagcctttgatcttctctatgagaatacaaagtaaaatgtcttccatgtagactagttaatgggcattttttttctagtctttctgaggatataagtgttagatttatacattttcagaattaggataatttacatgtgtgtgttacatgtgtgtgtacacacaaagggtgctgaacagatggcccagtggttaagagctcttaatgtgctcttgaagaaaacctaggtttggtttccagcaccaacatcaaattgatcataactcaagttcctcaggtctgatgccttctgaccactgtgaacaactgcacacaactcagacagcctcacacaatacacataaataaaaataattttaagtaatgtttttaaaagatgtatttgtttattttatgtattcatatacactgtcactgtcttctgagacaccagaagagggcactggatcccattacagatggttgtgagccaccatgtggttgctgggatttgaactcaggacctctggatgagcagtcagtgctcttaaccgttgagcactccagcccttaaataatgttttaaagggccagtgagatggcttagtgagtaaaagcacttgccacataaactggtgagctggattcaatccctagagcccacatgaaaatggaaaaggagatctgagtgcataaggttgtcctttggctgccatgcttgcctataaacagtactaaaaaggggtgggtaagaataatactgtatatgattttagattctgcattttacttaattccttaattggaactcaaaatgccattatcaaaaaatgcttacccaaaaggatgtaactacatgttaataaatcattctcattcaacatttgtatactgtttccttatttttaagtcttttttagatttacttatgagtaaaagtgttttccctctgtgtgtgttatgtgcagtacatgcgtgacgtgcccaatgaagtcagcatagagtgttcagtctcctggaattggtgttgtggatggttatgaaccaccatatgtgtgtgtactggaaactgaacatggggtcctctccgaaagcaacaaacgtctttaactgctgagccatctccagccccttcatactgttcttggttatgcattttacaatgatcttttggcagggctggggatcaaactccggggcattgagcatgacaggcagatactctgccagtgagctacatttccaaccctacaatgaacatatttatgtatctatcttgcattctaatttatatccttggagtaaattattaagttattggaattagccaaacaatggtggcgcacacctttaatcctaccacttgggaggcagaggcaggaagtttgaagccagcctggtctacagtgagttccaggacagccagggctatacagagaaaccctgtctcaaaaaacaaaaaaaagttactggaattaaagaattactattttctgttcttgatgcagattttgacaaaatcccacccagaaaagtttccattatttctgcagaagatgatagaaagttcaaatgagatcactagaatgacagacacattaacacattaacatgagtcattcatcctatattgtcagttgatgtttagtaataatagtttaataatgttccattcgtacacttctctaaaacttctttaactctcacttctggctgacccacaggtggctggaagagataaggtaggtcccagcgtcagggccaccatactgttatcttctagcagcaagggggcctacccatttttagtacatgctgtgtcatacatgttccttgagaaagcatttatgtgaatgtagataggagcagaaggaaaggctttgaggaatttagtttggggtagtatttttatgctttaataatgagaaaatgcctaccattttactaaaataaaaacatctgacataatagaaatgggcagttgctttgatttctcagaattctcacatataataacactgtgtcccatctctctgtaagtcactaattaaaattttcttatttttagaatctaagaatgtcccgtcctccccacccccagatacatgacaatcttacaattagattggaaggtatctggggtgggggagtgtgcatcacaaaacaattccctagagattcattagtgtcttgtttcatgatcagtaggagaccttgtatttttccacaggctcaagtccctttacaggaaaaatgagatcttcctggtaggctttggaggaccatctctcactactgacctagattgcccttcatggtaggaaatagcagacaagccagttggcttgttgctctctttagttttttaggaaagtgggtctgacttaggttctccaaggcaacttccagggagatatttctttctgtattctattttaatatttatcttatttttctgtgtatgagtgttttgcctgcatgtccagttaccacatgtgtgcctagtacttgaatgtcttagttagggttttactgctgtgaacagacaccatgactaaggcaagtcttatgaaggacaacatttaattggggctggcttacaggttcagaggttcagttcattatcatcaaggtgggaacatggcaaaatctaggcaggcatggtgcaggcagagccaagagttctacatcttcatctgaaggctgctagtagaagactgacttccaggtagctggggtgagggtcttaagcccatgcccacagttacacacctattccagcaaggccacatctcctaatagtgccactccctgggctaagcatatacaaaccatgacactgagaagtggtactccatgtggtactccacgtgggtactgggaactgaatctgggtcctttgtgagaaatgtaagtgatcttaaccactgaaccaactctccagccccactttttgcactcttgatgaggtttgtgggtttgttgattggttggggttttttggggggtgttttatggttggttggttggttggttggttggttggttggttggttttttcaagtcagggtttctctgtgtagccctgactgtcctgggacaccagggtggcctcaaactgagatccatctgcctcagtcaacctccatagtgctgggattaaaggtgtgcaccaccacaccaggctcttgtagttctgtgtgaggatccacgcacatggtttttgctgctaccactaatgaggattcgtctgttcattgcttgcctctcaaaggaccccctcagaaccttctttatcaggagttcctggtgttttccctctctcttccctaggacatcccacctatacctacattgattgtgtttctcgtatttatcatcagagtctacactgcctatgaggggttcccagaatggtttagttgtctcttgaccacattagtattagtattattagtaatccccctctaccttcactacctcatttgtgattgtgttctttattattttaagttatgtttatttttcagtatgtgaggccatgagtacctagaggccagaggcattgaactctctagaactggggttataggaagttgtaggttgcagaacaaaggctctggaactgaactggggtctcctggaagaagagcaaatgcttaagacagctgagccatgtctctagcccttgctttcttgtctttaaacatatccatggtccactagatcacaagaatttccccagatcttggccttgcttctttttctagacagtttattgaatctctctcaataatagaacatttctgactggatctaggttagtcatataaccagtagggctattacctgaagcagtcaaggactcatttgtccaaatggaaaaggattggaacaaaatgatggtaaatttcagtttgattatgctaagtttaactggaaaatcctcagacaaagccaggagccaacagaacagtggtagatcagagactccgaatctaaaataacacagagcaaaacaggctgggatgaacattttagaataggaatgcttaatctggctctagggtctttatacttttattatagggtccttatctttgtaagtcattagttttgaatcagttctggttttcttttttcaactcctacatgagaatggtggaaccactcactggaagaggacacacaactagtatcaccacaaattttagcccatggtaccatcaaagctgcttttcaattccatgtgtccttgatccctctgctgtgtacctcagtggttattccaaatctttatgactcaaacggttgcaacataggaagccttaggaagaaatcaagagtaccaggccttgacactctgaagcaatatccttgaaatatagaaagaagtcttgtttcccaccctcatcccaaggatggccattctgtgagagacaatagggcttcatgtaggtcaggctggcctcaaacttagtatgtggctgaggatgaccttaaactcttgatcctattgcttctgcctcccaagtgctggaattacaagaatgttccatcacatcttgcaaaattgcttgtctttgaaaggctgaactgaaagcagtgtgctcagagaacagtccttcaatttaggcatgggaggtaaagaggattataaaatactgaagacacagagaaatctgcttatcagagttacacctgagagcctggtgaaggaagggataggtgaggataagaccttaaagactcgagtttctgaatgactggctataagttgagctgtaaaatagagaagtatttaattctgccatccttgggatgagggtgggaaaccagacttctttctatatttcaaggatattgcttcagagtgtcaaggcttggtactcttgatttcttcctaaggcttcgtatgttgcaacagtttgagtcataaaggtttggaataaccactgaggtacacagcagagggatcaaggacacatggaattgaaaagcagctttgatggtaccataggctaaaatttgtggtgatactagttgtgtgtcctcttccagtgagtggttctaccatcctcatgtaggagttgaagaaaggaaaccagaacggattcaaagctaaaggggagaaattgctgctctcttcccagagcttcccttgctgcttcctgacgtctacccttctatctcttcttcccggtggctgccatactggcttggccatccttgcctctcctagtttattacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgtgtgtatacaggaaaacacaacaaattttgccatgtagtccagactggctctgaacttgctgtctttttgcctcagacaaccgagtgcttaggttacaggtggttaccacctcaaaaaattccttcctttctcccttccttcctccttccctttccttcccttcccttcccttcccttcccttcccttcccttcccttcccttcccttcccttcccttccctttcctttccttccttcttttctcattttctttctttctttctttctttctttctttctttctttctttctttctttcttcctctcctttccatctctcactttcttcccttctttagtcctttcttaatttttaaaaattgttatcatatttatatgtgtgggtattttgccttaacatatgtctgtgcctcaacatatgtgcctggtgctctcagaggccagaaaatacctttggatctcccagaactgcagtctcatgtggttgtgagccaccttgtgaattctggaaatcaaacccagtcctctgctgagccatctctccagccctctgcacctgccgttatacaggatctcaccatgcagtttagacttgactcaaattcatgatcccccttccttagcccccgagtgctgggatcacaggcttgtgctatcaaggccagttaatgacataatctcacacattaaaatgaccttcccacactgctggcaaatcccattatgtttctctaatgaggtccatttatcattctttcaatttgtttgtttattgtttttagtccaggcaaggtggtgtatgcctttaatccctgtattcaggaagcagagacatgaagatctctgaattctaagccagtcacatctattgaaatcttctttcaaaaaagtaaataaatacataaaacagaataaataaaaatatctatgtgtgttttttgcagcatgtatttatacgtatcacatatgtactcagtgccacatgggaagcagtagagggcattagagcccctgaaactggaggtacagatgactgtgagttcccatgtggttctgggaactgactgtgtcctcttgcaaaagcagcaagtgctcttaaccatggagccatctctctaccccagaattcattaaattgctgctgagttgatttcattttattttatattggtctctctgtataaccagttagcctcaaacatgttatgtaaatcaggcttgcctccagctcaacagagatcacccacctctgcaccctgagtgccagtgttaaaggtgtgtgccagccatcgggcaagaattttgtcctttctctttcattccccttcccacccaaacagctagcaaattctgtgaactctagagacaatcttaaatctccctgctcttaccatttcacctctaccacccttgtccaagaaacctttgtgtcttctctgagccactgcgggcatctcctaagcactcaccccgcttcctcccttgctcctgtctgctccccaaacacacagtctcgcacaacttatttcaaaccacactagttctctgctgaaatcctctaaaggcatttgctcagaatagaagtcaaagttcttttttgtgctcttttgaaactggatctcactttgtagatctagctggcttggaactttctatgtagaccaggcttggctcaaatccacagagattatcttgtctctgcttcttggggaagtgactttaaaaaaaaatttagtttttgagactaagtctcaagtagctcaggctggccttgaaatccagatcttcctgtctctccctcccaagtgctgggattacaggcctgtgctaccaggactgactaaaagtaactttgtacctgcagcactgaccacagccccagtccttctccagctgctcgctcttgtctgagagaggaagtacttgttctgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattcaagtcatgtatatttgtgtggcatttttcctcactggattgaaaactctgggggggggggagaagactacatcctactcatctttcatctgaactggtatctagggagtgtctggcataaagcagtttgttggacgaatgagtgaatgacattagagaggaaaaaaatactacacttttaaacattccctgaagactgagacagattgaaaaaaaaaaaaaacaagtcaagaacaacgaaaacagagactaattatatgaagagctggtacaaataaacaggtaggtgacagggctgagtgagaatgcaggagtcaatcaggaaaggctctgacatgtaacatctgagatgttttcaaacacaaaagagacataacttgagagtaaatgaaaagccagtcatagagttctggtgaggtagggcaaaatgagcaattcataactaaagcttgtttgttaagcagatctgtttaacaccaggcctttttcttggctatctaagcaggcatgttcattcattctgtgtcttggtatttccagggccagcccaacatgaggactttatgttctctaaacactcaagaaaggaagtttctgtgaaaatatgcaagggaatctgtcctgtgggattgaacattttgctaaccctggctctccagggaaatgaacttcctccccattcccaatgttaagaggagaaactcaaacgactttccttaaaaggtatgataggatagcctagaaaacattttgttaggtgaagatccaaagaaatcatggatgtatgagtgaggactgaaaaatataactgatagaaaggcctctcctagacctgctctctgctcacaggacacaggtaaaaatctatggtggtggatagtcagttaggggttcagactgttcttgtaagaaagaacacattttccatctcctcctctttctttttttttttttttttttttttttttttggttttcagagacagggtttctctgtgtagccctggctgtcctggaactcactctgtagaccaggctggcctcgaactcagaaatcccgcctgtctctgcctcccaagtgctgggattaaaggcgtgcgccaccactgcccggcactcctctttcttttaggtagggcctctctatgtagatcaagttgacaaactcacaagagatccatctgcctctccttccagaatcttgggtttaaaggcatgaatcctgggtttaaaggcacgtaccatcctaccttactcttataaatactcgactccaagaaatgtttctcattttaagaaccaacattttacagcgcggaaggcatatcaagtcccacagaatctcttgaggctgagttggcaactgtctactaagataacctagttttcagggtcatttttcttaaacattatgccaggtccactttccggaatccaccgcctttctacccttcgtggaggtaagacaatttttgtttactgcatgcatggaggagctgagttcggatattttatttcctaacagattccacggtgggagcgcttcagcacagggaggcatctaaatcccttatgctgccctgaaatcgacatggcagcaaacaatttaagtaaaaactgagaattctaaaccctcagagtcatccccaggtagtcaatgtctccctgcgctgcccaatcgctgggatgtgattgggatgttgggggaaaatcacactggtttggggtgatgtcacactagctgagatgacatctaactgtaagaaacccgaccgccaccaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccggccgcagacgggcgcggggacggctccggggggcgggggccggggcccgggccggctcgtgcggggggtatgatgacccggctgcggggccccggatcgcctctcctccgccgcctcctcgcggcggccccgactcgaggctgagaactacacacaccggcggtgagtcaggctcggcgaggggctggggtcgtggactttgggagtcggcgccccgaggtgggacggagcgagccgcagactcccttgggtagccggcttgcttggggtgcctctctcgccaggccccgcgcggccctaggcgcctggtcgcgagcggccaggcgcgactgcgtgccggagaaaatgggcagctccccctgcctcctgcctttccctccagatcgtgttgtcctcaggtgacaggggtccgtctggcatctccccaccgtacagatctccaccccaaccgcggactgcggtggcaggttcttgtgcttgtgcgtgtgcatgtcaccccactccctgtagctgtagtttgggcgtattggtgcctttggggaccgggaaaccgcatctagagtaaatcgtggtggtcgggctggtatggaagcttttctgttctcttggttcatgttctgtagtctttgagtatgtaatttgtgatggtggtaacgctgtgtggggaccagcccacctatatgtttatctctgcaaggcaaagctagaggtctaaacttttgcagtccgtcgtcgcctttaaagccaagaacaacaaaatccaaaacattaaaagatggaaacaaccaaaagcctttgggtaggacccacactataaacagctctgtagggcagcgnnnnnnnnnnnnnnnnnnnncttggcaaccgagacctaaaaacttggtctctaggagcgttggtctaacctccagtttgttgtggtgacgaaccgtgagcaatggcctgtgtgtttatgctgggcgcgttttctttcctgtttgggaatgggtactggaacgggaagccggagagggggtgggggcaagctccagtaagtgaatcttttctctacataaccagtgactcagttgtggatactcataagatgcgcattcttgtctctttggtgacactttgagaattctcagtagtgtagtgcagccacaaacaagagtttcaaatgtagactccgttgccccagtccgctctttatcttgtttcctagtaactgatgaaaacagcagcatggcttcctgctgtagacggagtggggttaaattaagtggcggatggcctcagcaaaacctacaattttgctcttgtttgtgtaaagctatttttgattcatggtctgtaagattttgttttttttgtttttttttgttttttttttggttaagatgatagagaatgcaaaccattgccaatttttttggggggtgggggttgctcagttaaaagcctaaagcttcctgtaaaacatttaaaaacctaacgactcattttacctcatcactgttattcaactggttattttaagactttgcatgcaattttctcaggactcagtgttgcaatgtgatggagtcttttagatactctccttggcagcacacacctttaatgccagcactccagaggcagaggcaggagcatctctgtgagttcaaggccagcctgggtctacagagtgagttccagaacagccagggctacacagagaaaccctgtctcaaaaaaccaaaccaaccaaccgaacaaacgaaaaaagatactcttcttggtttgaagaatatttcggtaaagtttttgagattgaagctagaggctgccaaaccggtaaagcagctgacaaaaatgttggcgctggttggcaggtcgtttttttgatagcgtcctgaacagttgatctctggacattgtagtttacagattttagagcaagttgatcagtaatgagatttaaaatcaaaccagatcttcctcctgaaaggaaaaaaaaatcagagttgacatttctctggaaaacagaattcattccttttttgtttttgtttttataagcacagaactagcaatgctttgttggtagcgatcagtgagccagacctgcctgtgaacttacactcggaacttgtgcagcgtgttagctttgtattttaattggttcttttgtaatttgaataactttgtaagcctgagcagcctgatctgtcaactgttctttcttttggactgtgtgacaacaatctgtgtttgttacagacctttcccctactgcttcttagccagtttctctccttacaattcatgccattttggacacaagttattaaaatcatttccttgagctaacacttactctgattttctttttgtttgctgtaaagagcacaggctagtgctccgttgaccaggcttgatcccactcctgagctgaaggggtggtcctgccccagcctactgaaaagtcatggtacctgggatgggtctcttttggttttgattttgtcttttatcgttttttagttgtagaaattcagttagtatatgtagcataatgtatttctcagtagtgtatatttgttacattttgtgtatgcgtgcctgtgaccgtgcgcacgcattcaggaaaaaacaaattttgggaattggttttctctaatgtggatccaggggataaactcatttttaaaggcttagcagcaagtgcctttacccaatgagccattttgctggccctctagtgccttttatactttgattttattatattttattttttccttttttgggtgccatatccagcagctgtctaagggtattgaatcccctgtggcttctttaaaggcacctggtaccgtattttctttgttactttatgaaaggaaccagcattttgctcattagctctgggtaaaacttatttggccttttttagtttctagaattagggatttaagaaagattttttaaaaagtagctgtaaaagtcaagtactgtctttttttttcctgctttttctccagtcaaatacacttccttcctttacacaggtactcgttttccatatcccttgtagcctggcaaaggtattttattgtttccaaaagagcctcggtgtacttcccgtctgccaaaccattgttaccttctttaagccaggcttcctttggatctttgctggctgatctgatggggccctcacttgctattatttgtgttttatggtgatctctacttgttagtctaactctgttcttatgttggaaactcttagtgctgtcattttatttcaaactttatagccttgttgactgtatcttgtctacatagtaagataatacctttccccaatactcttcttttatcgctatcgatttgttatgcagaaccagcaggtattgagactcgggaaagcacgttacccagaaggaaagatcnnnnnnnnnnnnnnnnnnnnttttatcgttttttagttgtagaaattcagttagtatatgtagcataatgtatttctcagtagtgtatatttgttacattttgtgtatgcgtgcctgtgaccgtgcgcacgcattcaggaaaaaacaaattttgggaattggttttctctaatgtggatccaggggataaactcatttttaaaggcttagcagcaagtgcctttacccaatgagccattttgctggccctctagtgccttttatactttgattttattatattttattttttccttttttgggtgccatatccagcagctgtctaagggtattgaatcccctgtggcttctttttttttttttttaaagatttatttattattatatgtaagtacactgtagctgtcttcagacgcaccagaagagggagtcagatcttgttacagatggttgtgagccaccatatggttgctgggatttgaactctggaccttcggaagagcagtcgggtgctcttacccattgagccatctctccagccccccctgtggcttctttaaaggcacctggtaccgtattttctttgttactttatgaaaggaaccagcattttgctcattagctctgggtaaaacttatttggccttttttagtttctagaattagggatttaagaaagattttttaaaaagtagctgtaaaagtcaagtactgtctttttttttcctgctttttctccagtcaaatacacttccttcctttacacaggtactcgttttccatatcccttgtagcctggcaaaggtattttattgtttccaaaagagcctcggtgtacttcccgtctgccaaaccattgttaccttctttaagccaggcttcctttggatctttgctggctgatctgatggggccctcacttgctattatttgtgttttatggtgatctctacttgttagtctaactctgttcttatgttggaaactcttagtgctgtcattttatttcaaactttatagccttgttgactgtatcttgtctacatagtaagataatacctttccccaatactcttcttttatcgctatcgatttgttatgcagaaccagcaggtattgagactcgggaaagcacgttacccagaaggaaagatcctttagccagtttaccaaaacagcagagcagtttttaaatgactgaggttacacagctgtaggtgctctcctggcagctaatatcacctttccacaccctgttttgcaatactagttgggaaacttgcttgtaatccgcaggcccgaatgcaggaaggaaggaaatactactgcaaaggggtggctaacttgttatgcaaatgctgtccttcggggtttaagcttagttttttgcctctgtgttactatgcttacagcagtaatattttatcacagacaaaagactagtttgtcacatgtgtttctctaattcagttgggatcattgctgagattcccttacatttatgtcaggagcagtagtgtgatcttcatagtcagtcatgttaggaagtgattgacacatactgtaaggcagccattatgatggatgatagtgatgcagaaaggaagaagagaaaaataacgatagtggctcactaccctgctactgaggaccacccttacagaatttaaacttcagaaaagaagttggcttttatttttaaaattatttttaaaaaatatttattttatgcatgtaattacattgtaactgtcttcagacaccagaagagggcatctgatcactttacaagatggttgtgagccaccatgtggttgctgggaattgaactcaggacctctggaacaataatcagtgttcctaaccactgagccacctctccagtccgtcgtaaacgattttatacatgcgtgcgcacacccggcaagggacagctctcttcctctgtggttctggagattaatctactcagctatctcactgcacccgaagtcacccttaaaattttcttagttttatttatgtgtatcagtgttgtgcttgcatgtgaatatgtaccatgtgtatacctggtgcctaaggagatcagaaaagagtgtcagattccccataactggaattgcatatggctgtgagccatcatgtgagacctgggtaccgaaccctgggtcatctgcaagagcaacaagtgagccaaccatggagctgactcttaacttccacctctgtcctcagaggtcaacttttaaataagtctaaatggtgatgctggaaaaagttagaggaactacccctgcttgcctctttgggttctgcatctgcctttcccattcttctgctacacagaagatacaggctatacacagaatatcactatctgtgtaccaactgttcttggctatcatttagatcgctgtttaaatgccaacaccataaaaagatttccttgaccaccatctcgtgtttttttcgtagcttatcactggttgcatatctatctatctatctgtctgtctatccatctgtctatgcatgagtgttggggatgtacaaactatccctcctcctcctcctcctcctcctcctcctcctcctcctcctcctcctcctcctcctcctcttcttcttcttcttcttcttcttcctctctctctctctctctctctctctctctctctctctctctctctctctctgacagcatttctctgtgtagccctgtagccctggctgtcctggaactcactctgtcttctctccctccctccctccctccctccctccctccctctcaagacagggtttctctgtctagccctggctgtcctggaactcactttgtagaccaggctggtcactgtgtctcttgtgtctagaacagttcctagcagccaggcagccaggtcttcggtgtatgcttgttaagggactaagttaaataagtgtaactataaaggaggtctgtgctatgggagcctttcaggagcctgacctactataaaatagccctagggaagacttctgagtatttttatctgactaaataatctagtagaggaaaaattgtttctgttttatgtaacagcctaattgtaaatgttctatgtcaaagtggtgtccaagcttattaatctgctctctgctgcagggccactcacagacccgggcttcttccagcttgttactctactagtacttgggtgtcatctcagggtagaagcttggatctctgaaagccttattttatgcattgttctcaactggtgaggaagactggtcaacatagtctagccatgtgcctaataaaggagaaagtagatttttagacaactcagcaagcctaacacactgaagtaagatttatgtggcaaagagaaggctaagaagggacatgaagttcagttcaggaagagcaagcacattatacatgaacaagcacattcttccaagcactgaaacttaggagagtgtgccctggggaaagagtggataaaataaagccttgagagtaatcacaggtcggactttataaggtgtgctaattaaaaaaaaaagagagagagcttttggactttatcatgaaggcttaaatggtgggacagatgtttattatttttccagatgtgcatttttaagcaggctagtaagtgaagagtgacctggaaaagtgagctctgacaagatgcttaagagcatcacttggggatgctgtgtaggctgtctgagaggttcagaaggtgagtgttgagtgagtagcgtgggtgggctggaggaggctgagaggagtcaaaggtagttagggttctagcttaagaactctcttcctaaattttcattttgcgtttatgtttgtaggtaaatgtgtagagaccaggttgatgttgtgtgtctctattagtaaccatcttctgttctgagactgggtctttcactgaacctggagtttgccgattggacagagagctccagggatctgcccatctctttctgacccagcccgcctgcacctcagcacctcagcacctaactgggtgctagggattgaactcagctcctcatgtgcacctcatgtgcttgcttactgacacccccccccccccagcacctcttgtctgtcatttctttctctttccttcttttcttttcctcccatttctttcgtttgttctttgtttattttatttatttattttattttatttttgtgacagtgtttctctgtgtagccctggctgtcctggaactccttctgtagaccaggctggcctcgagctcagatctgcttgcctctgcctcctgagtgctaggattaaaggtgtgtgccaccactgcccggctcttgttttacatttacaaaaactgtattcttgagctggaaacatggcttagtgagcagaggtgcttgttaggcgcctggccgggtatccttggaacctatgtaaaagcagaaaggagaactgattccacactgttgttttctgacctctagacaggcactgtggcacatacgaccaccaccatggcatgtatatacttgtaaatgtaacttttattctcctgaagtaattgtctctgaagcttactgcctccaactgctaacctaggcctagtcctggaagcttctagcttccgaacaatcttatctatgtctagaatgttttcagctctgagacttaatgctgaattagctaaatagctcaccttttcttgttctttctgatctctggttggctggttcaaaactcagctgttctgtctcgaactcctcgagaagctgactgattcaatctctctctctctctctctctctctctctgcctctcttgacctctgcacttgacctcaagttaactctagcaatcgttctatcttctggctccttcttgttctctggctttacctaatattttgtctttacctttagctgtgtctggcttgttctctcttcagcctgtgtagccctggctgtcctggaacttactctgtagaccaggctggccttgaactcagaaatctgactacctctgcctcccaagtgcttggattaaaggcgtgcaccaccactgctgggcttctgcactgcatgaagtagcttccctctcataagagttggacagatcctattctgacaaatctttctctgatctgcaactcaattagacatcactttcaaacgtggctggctgcttccttctacaaactaacttgaccttcattgtgtgatagtaaaggtgtttactaagggcttgtctatattacagccaaggggattaaagttgtgtgctaagggcggagccacaccacaactagaaacaggtttttccagtaaacaacacaatcttgggcttcacaaatgtgatcaaatgtcctgtaatatatacactcactaataatatatataataaatgaaagcatgttcttttacttccctgtctaatgttaagaatgtgtatcagagtgtatattggagaatgtatacttccttgaccatctaagtcaggactgatgactggaagaactcaatataaaatattggttttaggttatttaggtcatcggttgttaaattgtgccagagaggaaagatgacattgaacaaaagcagcatgaatttagtataggtacatgggggaggggatgaggaagttacacacgcctttagtcccagcacttgggaggcagaggccggggcatctttgagtttgaggccagcctggtctacaaagtgagccttaggacaaccagggctgcacagagaaaccctgttttgataaaaggggacagaagctttgagaaaatgattatctttgctgtgacaccaaaccactccatgcagtgttacaattttttaactccttgtggcaggaccacctgcctatagtaattgcagtctggagtctgtagagtagagaagctctgaaataaccgtgtttgaaagccttttttcagcaagggccagctcgcttttgagtagtaaacacaagtactaaacagcctttgcctattaattctagtttgggattattgcagggagcaaatttgttattatatcacgttagttgtcactggaaagtgatttttgaaatgaaactattgctagatccaagaggtgaaacatttcaggaagtcagaaatagcatttgatttattgggagctatcttcttgtgcactgaaaagtttgtggtttgtttaacagagcgttctatatagaaaaatacccacagttgttaattctaccccatattttttgggaaatcttacctagcaagagaattgatcctcatttgcaaaggcagatttgtgggacagtatctgtgcctagaaatgactttttaaatcctcacctgaaagagtggagtataaataacagtattgggttttctaggccattttgagtctgtgtttacttctcaccttgttactgaggtcgagtgagtgtcagccacatgaagagtctcggtgctgcaatatgtacctgggagaagggctcatgaaattctggggttttttcttttgtttttggttctgtttgtttgtttgcctggtgtggactaggtgtgtttttctgagttaagttatattcaaaatgtcctagaacatgttctcatgttctctccctctttctccccctctctttctctctcttctctaaggtgatgttgaattaaaaactcgaagtttttgcaattttgctatagggtcaaaagttggtgataacatcattctaaagatgcaatatttttaaaggctacctagttatgaactttacaaaaaaaaaaaattggccaagcgtcatggtgcctgcgaatcctgcgttcagagggtatcgagaggaggggcagaagttcaagggcatcctcaggtacatcgtaagtttgaggccagcctgagctctgtgagagacagtcggaaaaaacgggaacaataaataaaaggatatttgtgagttctttgcagtgtgactttatgaccttgtcatttttgttttgaggaaggatcataaaacctatgctgatctcacagtgaccacacttagcctgattttcctgccctgcttttcaagttcaaggactgcctgtatgtgctaccaggaacctctgcccttttgtagttgctgcaaactgtaaattttatattgcataaatattatgctccttgtttttggttgaatttttaaatttctatttcagtagggaaaacaaatcgatgatttacctactgttttttagtttggctcaattttatgatggcaagtaatgctttgcatgtattttaataggtaaatttagtaaaggaactacttggtttcaggttttttttttatatttggttttttacataggtgatgaaagtaggccaagatgctttgcatattcatgactttgtaagttgaagtgcactggccttagctttcaacttgtgctttttttctctttgaggttcatataaattatggaaactcttgcttagagtaaattcaagcaccattttagaaattgaaggttggagatacattttttctttgcagctgactccattgcagatagctttaagttgtaatcaagcacaaagaagtgcacacgtgtcccccctccccgctcgctctttatacacagtgccagggatcaaatcccagtcccgtgcattctgggcaaacactatttcagacctcagcttcagccctacacagtgcttttgatgctctgtaacatccgttgtcatgtttccttcctttctaattgtatgtttatttacttatgacttgtaaaattgtgctatgtgggtttgagtggtgacttcacccatatcataagaaccatgcagataaaacagaaggatgtgtaaaaaaacaaaacaaaacaaaaaacaaagcaaaacatttgagaatacagcagtttatatacgaatgatagtgagttgtagataatgaagttggtaggcaggagtcccgtcttttttccagcaaatactgcgtttatgttacactaatagaatgtggaaggacctgggtgatagaagtgaagaagaaaacagaaggcaatctatagtggaagggatggctgtggatcactgagatgttggggtgtgtgtgggtgagagagaggaagagaagagttttgtgttagcagccagatggagttgctttgcaggaactagtgagctgggtatagtggcatatgcctgtaatctcagccctcaagaggctgaggtaggaggaggcgagtccaagtggggatgctggccagcaaggacattcagagaggtttctggagagtctgtgtacatgtttgtgtgtttgcaggtactacgggcatgtatgtaggctagcggtggctgtcatgtgtcttgttcaattgctccccatatgagtttactgattgagctagactggacggccaccaagcctcaggaaacttgtctccatctcccctctgttgggattacaggtgcatattgctgtgcctggtcttttttgtgggtgcatacatcttaacgcaggtcctcatcaccccactgatctagccatcttccttgcctcttggtgaacatttttatctccacccccatgtactgagggttgaatcagtgctttccacatgttaaactttacaagctaagctaactttctaccactgagctatagtcccagctactgccacacccactctttcttgttgttatttttgtttttcaactttattttgaaacagggtctctcactaagttacacagactggccttaaattcagtctgtagcttaccttcttttgattctcctgtctcagcctcttgagaagttgggattaaaggcctgcaccacaagatctgttttgaagatcttttagctttaatgcccaaagaatggaaaacttctgggggaaatgggaagagattaagaaaagactgcttctagcctgctgtttaaaagcaaagatgtcaaaagttcaatgccctcctcagctacatagcaagcttgagggcatcctggatactaaaggtcctgtctcaaaaacaaaacaacaaaaaacaaccccagcaacaaacaaaagcaaagaatcccttgagtatttaaggcagttcataagaggctgtttgcatcgtgaactagcatggtggaaaaaaatgggtgacttgaattatacttagactgtagttcagccaagtagtagtttgtgaagaaagggagaagagtgagtccatataatgagtatgtgccagaagctaccgctttgcctatgttaaatagctgcgttctctgaatagctccaagaggtggctattgctagcgctggtgtacagaagaggaagctgaggctcgttgtcccctggtttttggcttgcgtgactgggtgtttgttgtattccataagtgagaggaaattgagagtgtagtggaggcttgtaaatttaatcttggacgtacagaatttaaggtgtctgtcttataatcaagtgggcataagataagacttggataagatttgcagatttggtgataagagtagaaagaggagtcgagaagaggagtctggatttgagatagaattttttagattttttttctctttttttgcaagggacatactaggttataattactgcaaagagggaaagtataggtctagaaaaggggttaactgtcgagcttcaaggcctctgaagtcctgatggcaatctgagaaccgatgaatatgtgctagggctgggtgtttgggctctattctttaaacaaaacagcttcgagtgtagtcttgggcttactgagcttgagggatccgtaggatactcagggcagttggactgttctcacttcctctccccatatcttctttacgttctttacagttctctctccctctttctcttccctcccccaacccccaatgtagtccagcatgatttcacggatgtgataagtatgtcatgggaagactgtgggaaggctgtggaggacataggacaactgctgggatcacctgtctccttccaccataagtgtctgggaagaaaactcaggttgttgggattgtccgcaaagcactgagctacgccaccacctgatcgtgtcttgttctaagagtaactttctgtagagtaacttcttcagaagatactctaccctggtcatcagctggttgatttcttttggtcagtggcaatcatttccagtgttagagaatagaacactattttatgtttgacttgtacagagtagttagcctttgctttggcacagtatggacactatatgtgtgacttgcctttgagaggagggagacagtacagtgtggtcttatcagctacacctgttctcacatgagctgttggtgagcttcgcatcgtgagccctgtggtctcattcttccttctctccgtgtaggtatggcctcacagctgcaggtgttttcgcccccatcagtgtcgtcgagtgccttctgcagtgcaaagaaactgaaaatagagccctctggctgggatgtttcaggacagagcagcaacgacaaatactatacccacagcaaaaccctcccagctacacaagggcaagccagctcctctcaccaggtagcaaatttcaatcttcctgcttacgaccagggcctccttctcccagctcctgccgtggagcatattgtggtaacagctgctgatagctcaggcagcgccgctacagcaaccttccaaagcagccagaccctgactcacaggagcaacgtttctttgcttgagccatatcaaaaatgtggattgaagagaaagagtgaggaagtggagagcaacggtagcgtgcagatcatagaagaacacccccctctcatgctgcagaacagaaccgtggtgggtgctgctgccacgaccaccactgtgaccaccaagagtagcagttccagcggagaaggggattaccagctggtccagcatgagatcctttgctctatgaccaacagctatgaagtcctggagttcctaggccgggggacatttggacaggtggcaaagtgctggaagcggagcaccaaggaaattgtggccattaagatcttgaagaaccacccctcctatgccagacaaggacagattgaagtgagcatcctttcccgcctaagcagtgaaaatgctgatgagtataactttgtccgttcttatgagtgttttcagcacaagaatcatacctgccttgtgtttgagatgttggagcagaacttgtacgattttctaaagcagaacaagtttagcccactgccactcaagtacataagaccaatcttgcagcaggtggccacagccctgatgaagctgaagagtcttggtctgattcatgctgaccttaaacctgaaaacataatgctagtcgatccagttcgccaaccctaccgagtgaaggtcattgactttggttctgctagtcatgtttccaaagccgtgtgttcaacctacctgcaatcacgctactacaggcaagtacaaaatactgtgcttaacatgcataggatagaactgtaactgttctacccaggagcctacttatttctagattccaagatggcagcaggatttgtctcagcttacgtgtatatgtgaagttcctataagtaacacacaattcttgcttcaatcctacttagtactagcaaataactcacatttaattctgaagattgctggctgaattgtgctagtatctggttcattcttgactaccattacatctaactaacttttcccacttgaaggactgtacagagatgatcaatctttacagatgttgtttttccccagctcatacctttgtatgtaaaatgttttgggaatatctttaggtttcaccttagaagcagtttattctgttttttttttttttttttccctcctgatagcaaaaattgaattagatgattgctgtggtcttctgtttgaacattctcaacaagatagcttagtgatttttatttctagattagtacttctaatacaagatccttttatgatattcttgtaacagtacttaaatgttgtgtacacaattttgtgtgtactataaccaaggctttaaaatattcttttatttttcagatctttattttatctagttattaatcttaaagaatctgatacctaatttaatatatataaattgaatattgattatacaggtgtccaatcaagaaatgagcatgggctggggtacgtagctcagagatacagggcttgcctaacctgtgcgaggctgactttaatgcaccctatcccaaaataaaaacctccaccaaaaataagtagttaaccacaaaatatgttttcttttttttcctttgagggaggtatcttttttgggggacaaggtctgactgtctagcctggaactttctgtatagaccaggctagacttgaactcacagatcacagagatctgtctgagtatttggattagtatatttactatctgtttttgtttctttaagatttatttatttattataagtaagtgcactgtagttgtcttcagacactccagaagagggtgtcagatctccttacagatggttgtgagccaccatgtggttgctgggatttgaactcaggatcttctgaagagcagtcagttctcttaccggctgagccatctctccagcccctggtttgtttttttaattatttttattttatgtttatattttttgtcagtatgtgcgtctgtgtaccaagagtgtacctggtgcctgcagaggcaagatccagtcctctggcccttgagttacgggtgcttgtgagctgtcatgtggatgctaggaattgagcttgggtcctctggaagagcaatcagtgctcctaagcactgagctatctagctagccccatccctagatcctatgattctgaggtcagtctattctgtaacactcatcaggatgctaccacttctcgggttgagtggtgttacattgtatgtacttacatttgtttatccatctttgataggcacttgggttgtcaccacctttgggctcctgtgagtgatgctgctgtgaacattgctgactgtgtatctcagttcttattctcaggcctatagagtgtgggtagacttgctaggacctagggaattgtagtagctttgagaggctactagacttttcctacctgcagcatatgggaggcccagtttccccatgtatcctccaacacttgtcattttctatgtatttttatagtagttctctttatgagtataaaggtgtctcaggtagttttgatttcctaattagtgatactaacagtttttcatgcccttatactttgtttggagggatattcattctattcctctgaccaaattttcagttgattttgttaaatttcagaaattaaaaaaaaaccattctagacattaatagatgtgattttcaaatatttttgtctctgtttatagtttttgaacctgtggctagtatttaatacgcaggtgttctgagccttggtagagtctggtttgtctgctttttttcctgtttattcttcaggtatcttcattacagagccagcatcatgtagtttaacttctttttgcttctccaatcttgggcttttagctactgcatttagctatttcattttgagacaaggttttgctgtataaccctggttgtcctggcgtcagtgactcaggctggctttgaactcagcatttctccttgcctcagcactcattggaagtgcttggattgcaggctgtgctactgcaccttgtccagttgttattgtttaaggtgatggtcagatttaattctccgtgggattgtttagttcacacgatgacttttgctctaaaaactgcttgttcctccactgagtggtcttgggagctttgaccatatatttaagaggtcccccccccccacactgcctgtctatagggtagatttttctattttttcttcagaaaacatcatagaatttaataaaagtaacattgacatagtactgacattttaatgatagtcttttaatatattctcacttaaaatttttttatagttttataaaactctgacctgttttacttgcaaggaacttagagggcctgtggtttctggtttcccgcctctcttggcaacctctgctaattttgagaatttcacttcagtttatttatgacgtggggatatttaggatccaactacatttgctctgatcccctttaagtactcccccccacccccaccccttatagtaccagtgcaccgcatgccatcgggtgttgaagtaagtatgcccccccacacccaccccttatagtaccagtgcaccgcatgccatcgggtgttgaagtaagtacgccccccccacaccccttatagtaccagtgccccgcatgccatcggtgttgaagggctggtgctgcccagctcacttgactggggatgcgcgggatcagctctggcgggagcttgtcagctctgccgcagtctcggagtgtgcaggtgttcagtaaccgtccttcagaaacaaccaagcagctttaaaactgaaaaaggctgaacaaaaggagatgcaagctattttacaacatcatttttggcaccattttttacatcaaagcgagttgtgggacagagtatcctgcttagccttccctgattggcaatccacgtgactaattttcagtattaggttgctagtctttggaccttttttgtatccttttaattttggtattgattttacaaaaaaataaggtttcctaagttttaaagtgttcttcaaagcgtcttacaaatttagctgttggctttaagaatactttcaagaggaagaaagtttccttcttaaaggttcattctgttcccacaccatcactgcgtgcagctcagtggccaggggctgtgactggggctaggatttgcctgtgtgctctgttgtctcacggtagtacttgatccttaggctgtgcaggccactgtgtggccctcctcaccaccagtctctcctcagtgggccttaagctgcctcatatgcctgtgttgtcagaggtcactaacaccttagattcttgtcttttgcaaatctctgtgaaacccttggggctggtgaagctgccttcaaatccagctttttcacccttcttttaagtttatgttgctttgtcctgatgataagtatgctcagcgactgcatatttggcagaaatttgccacactgttagccataggcatggcaaaatgacccaggccctggaaatgtttctctagcctgctcatgtaccctgactactccaagcaaagctgctgtctttggggcttgagttttagggacacaagtttgccacacttaacagtcccaatgcttttacttttttaaacaaactagctagcatttatttcaagctcagattactttgttatttatgggcagacactgcctaaaagagaaaagtatagcttaatttatctgatacaaacaatctaatttcctgcaacagtgaaactacagtttcaatttaagccacagatgcaggaagtcggactttatgtaacatctctaatctggtaaataagtagatttggtgcctcagatgggaagaaagaaactgagtgtgtgaaaccaagcagagaatgatttgtgctccctcgctgtggatgccagtgaacaagggctctctgaccttggaggagcttttcagtatgaggaagttgaaagtgcgatgaacctgcaggggctgctgctctgccactgggctcttgtaattatgcccagtgtttgtactttaagcatggggttgtaccctctaagttctcaaccttcctgatgctgcgaccctttaatacaaatactcatgttgtggtgaccaccgaccataaaattatttttgctgctacttcattactgtaatttgctactattatgaattgtaatgaaaatatcattatacaaaatatctgatataagacccccaaggaggtcacgacccacaggttgagaaccactgctcgagggtgacccactacttccaaagcacaattgacagcattttcctattgcagtaaacaccatcatggctgtcatagctctagctttctcctgcccttgtagtcttttattgccttatgtttactataattttagagctgaaacagatgagtaattacctaactcttccttttttaaaattttatcttatttttgagacagagtctcagttatagctgggctggccttaaacacttattcctcctgcttctgtttctttcctaagtgcggagaccacaggtgtgtgcttggctcacccttcttatacagagtaggaccagggttttcatgtccataggatcaaatgcagggccttgtgcttgttaaagatgttccctagagagtggagagaaattaaagccaagaggaaaatactgtgaaaataatttcaacaatcgtaatctcagcttggaggttaatgatgttgtcattttccagtaaaggggaaatgctccttcctcacttcctagaagtgaaggtgaatatttatagttttaggtccaagtgatgaaaaacacccactgaagctttctttttcttttttccttttcttattctttgcctgcctgccttcctgccttccttcctcacccagctccagtccacttttatctgtatacctttccgttagtttaagtcctgcggttttctgtagtccttgcctctgaggaagggagcgtggttgtccagggtgagctctccctagagtccttagctgcttttgtcattccagaaccagccggaaccaggagactggatgattccagattccacctgatcttcctttgttttgttgttggaaaaactgggattactgttaagctgtgttttttggccattcctcccgacctaccctttcaaaactgtcttctcataagatggaaccgttaaaaccgcccgctgctcagttgacgctttggaatgttctcaacccagtttttattttggcaccaagccctgtccacttgccctgccagctatttctggtgttgtcatgaacttggaaattaatgttgctgcacactgaaagtcagacattttttttccttttcacttttagaaaagcttttatattttttcctgggtactctcattctcagctttattaatgctcctatcaggtttgtgtgatcataaaggcatactatagtggttgggatttcattgaactgtgaagttgcatccatcataaatggctgcagttgcttgcaacatcgcacaacacctttctttctttctttctttctttctctctctctctctctctctctctctctctctctctctctctctctctctcctcttttgtttctttggtggttttgtttgttttttgttgttgttttatagacaggtcttagagctacaatgtagaccatagaccaggtgggcttcagatttgcagtgatcttcctgctggaattacaggaatgtgcaagcatacccataggggtatacctattgagggttgtttgtttgtttggttggttagttgtatttttcagggaacaaaactgaagttcctatcaaatgctacaaaagctgctattagctgttctactctagctgtctagcagaatgagtttcaaagacctagattttctactatttcaaggtaaggatcagaaaatggcttagaatctctggagtttcccattctacccgtttcctaaagatgttgatgtttgattgcttgtagaagctacctttttggggaaatatcctagctaagtcatggtgatgcatgtttatagtcctagcactaaggaggccaggagaatcccaagttcaaagtcatactgggtcataaacactgtggctacacagcaagaccctgtttcaaaatatcaaaacagtagacaagaaaagcccaaccacaatagtaatcagtgggtcttttgttgttgttttgtttgtttttctgactcagggcttacttgtgtagccctggctgtccttagaacttgagctgtagaccaagctggccttgaactcagggattcacctgcctctgtctcccaagtgccaggattaaaggtgtgtgccaccactgcccagtggatgctgagatttcagtggttttgtttatttgtttgtttaatttgtacatgggggaacatgtatctggaggtcagaggataacttgtggaggtgtttgtctcccaccatgtacactcgtgggctagaactcaggtctacaggcctggcttttcttttgatccatctcacattgtgtgcaccgtcatcttaatcatcatctgagaaagcccatttatgcatgccaccattccagatacatttatggagatgtgaatgtagataccttttatgtattgaaagttagcatggtatatttaattctggagtcagatttctgagtcaacttcatcagttactaactgtagttttaggcaagtctgtgcttgttctgtttcctgctctatcaatgttggtgataatttcacttcaaatgtacttgaagcattaatgaaaatgaaatttaaaagtatagtttcaagactcacaatcatggtactctaataatagttactttatacctaacatttacatatgcatattgtgggccaagcccttgtccaagactttactaatttacttaaactttgtggtgactttgtgtgctactgtctccattgtctatcaggaaaccaagacacagagtggaaggtaaatggtggcagctattaagtgatgagctcaagttcaaactctctcaggggggcttttgagtctgctgcaagtattatcttctcagagatcatttttatgaagatagtaaaacaactaaggtgctcagaagaaaaattaccatcttttatctataactgtaatattaaaagacagatattaatgtgttcaattatgtggcactgtcatgaactccagtggaattatgggatatgtagattatgttctatattatctttctgcagttcaaaacctgtgaattctgaaacacatcaggccgtagagttttgactctatagttgtgtactgatggttggtttccagtcccttgaacaagtatgcctgttgctgacactgcagcagaatttagttaccatagttaatttccccaagtaatgtttgttattttatccaatatctttgtgttttgctgtagagctcctgaaattatccttggattaccattctgtgaagctattgacatgtggtcactgggctgtgtaatagctgagctgttcctgggatggcctctttatcctggtgcttcagaatacgatcaggtaagagtgcttatttgtatggacgtggaaggcaccaccccttcagactgcacaggtccacacagagagagagcatacagagagtgctttcacaacaatttgaaaaacagaccacacagcccaggaatattgaaaaaattaagggtgtcctaagtgcataaaatagatgttgacaaattgtctattatattattatctacaaacatactgctcttttaaaaatacttctctctctctttctttttgaggttgtaatgtacatcattctcctttacaaatttagttctaaaggttaaagctttctgaaaacttacacaaatgaccacctgtgatgctggttttgttttttggagacctggagagccggtctccctgcctagccctaagactcactgtggctttgtagactaggctgagggataggactagagacctgagccattctttggtttttcgagacagggtttctctatagccctggctgtcctgggactcactttgtagaccaggctggccttgaactcagaaatccacctgctctgcctcccgagtgctgggattaaaggctaaaaccatggcccacttgacctgagccattcttaaacagaaactcaaaaatgacagtgcggtgctaaaccctaacttgttgtgtactgtgctgttgtagccatctggcagacacctcttggtgatgataactgaactcaaagggcggtgtgcgccactaaagatgctgtgtgtcaataagcacttgtcttgttgatagctagaaaaacttgatctcttgtgctgtgtggtaatgacctgtttatagttttggtaaggtttctgcctaacactaggtgataagcagttaagtttgggggatccaaatcagggggagatgacgcttaagtgacagtgtccttgtctagctaccatgtgggagagctgaatttgatacccagcgtgggtttggaagggggatgtgcaagactgactataatacaggatggagcactggtgcctttgccctggtgtggttcaagggttgctcagctgtagttgcaatagattccagagaaagaaatgtgctaacagtgactaggtagaggaaaaggagtctaattgttactgaaggttcaaaacttttttttttttttggccaggtggtagtggcacacacctttattcccagcctttgggaggcaggggcaggtggttctctgagttctaggctagcctggtctacagagtgagtttcagaatacccaggtctatacagagaaaccctggcttgaaagcaaaaacaatttttttcctctaccactcatttggtctagaattatttcatctctgtgataaaaaagcgttttattttctatttcctatgattggcattctcctagctctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggctgtggaaataatttcaattcccatttcttgctcttaaaaaaaaaaaggctgtacaatattggcagctctttaatagtaaagacttccagttcaccagtctgtagatacatacattgttgtttttttgttgttgtttttttgttttttggggttttttggtgtttgagaaataattatttgtaattaggaagtaaaaaggcaaaccttttttttctcttaccattgaactgtctcctttttgaaccaacttggaatgagttatgaaataggttgttcataagtaaccagttatgttgtgctttgtaagtttttaatctttcctaccttgcaagaaacaaattagctttctaatctacgagaaaaaagtacaagggataggaaatgatgcacattcatgatctcggattgacttagaacattcctagtcctttttaaaaactcttttgagaatataatggaagctgtcgattctgcccaccaaatagacacactttgatttgcacatcttgaggggattcgtggatcctgctccaagcaattatagcctccaggaatgcagttcctagcctaactattgtgtagcaccagctcaagtgtcatagcagttctaggaagtggaaacaagaacaattggatttagaagcagagatagtcatcagagctttccttgtaaagaaaaggatatggttggtccttgtgtaaatttctgtgtaatttgttaatgggaggtaggaggaagtagtttgcctgggccaaataggatgctgctggcgtgcaggattgggaatagattattttggtccatctgggcaatacaaaaggattcatatagcagggtccaactaagattttttgtttgcttttataaaaataatgatatagagttagaatttacatactaccaaacatttgaagtgtacaggttggtgggttttttttagtgtgtttacaggaatgcacaaccattatcagttttggaacattctgtctgtcatttgatgacatctagagtccattagctgttaattttatcctccaaacttttcagtttctcttagttctatacaagtactaatctattctttctctctataaatctgcctactccggcatatcataactattcatcacatggaaagtgtgctgctgtgtgacacatcctttacttgtatcagagcatcgctttctatggctcattgatgctccattgcgtgttcacaccacacagttggttatctgcagatcactgcatttgcctgccgtgagtaaatgcttctgtgaacactgagtaaatatcgagtgtccatttttccttccttctttttccccttggtttaatagtgctacatacagccttatacatgctaggtaattattctgccaaatgagcaaaatcctacatttgcatatatagcttggggtggaattgctaggtcatagattagcagtaattacctttctgaagggccactaaatattttggaaagagacctcaacatttcagcagcagtacctgagtgtttcctttcttcccaggtagacagtatgtatttttgctttttctaagattagctatctttgtgaatgtgttatgttgttgtttagatttgcacttcttaatagttagtgatgctggacattgttctccatgcccttcttgatcattgggatattttatgtctgtttaggttcattgctgatttttttactgtggttattggtttttagttgttaagttgtagttctttctactcttaagtattaaccattgccaactgggattttcccatgcctcctgccactctgggctccttttcagattgatgatggtgtttggaacacaaatattttttgctttgatgcttagtttgcctgtctttttttcctttgtttgtactttatggtattatagccaagaaatagttgaaaaaaaaaaaaacaaacaagctagtaccatacagcttccatattagttttcttctgatagcattataattctaagtttttatttagggtctttgatccatccaggatttgggttagtaggaactcattgaggagtaaaaaatgtttgtcctctctcaggctttagatcaagaaagacattataagaaagattacatgctgataactgcgtaatacacttgataaattcttttttttttttaaagatttatttatttattatatgtaagtacactgtcactgtcctcagacactccagaagagggagtcagatcttgttaaagatggttgtgagccaccatgtggttgctgggatttgaactccagacctttggaagaacagtcgggtgctctgtacactgagctatctcaccagcccgataaattcttttaaatgtatatagtttgagtgttttgcctacatgaatgtcagtaaaccacatgtgccagtggaggcctcagggcccttagaactggggctaacagttgtaaaatgccctgtgggtgctggggactgaaccagatcctctgccagagcagcagggctcttagctggaaccagtgctctcgtagtgcccacagttcccacgtagtgtgcatgtgtgtgtcacatgcacacgtgaggctgcattaactgtggcctcagcacctctccgctacatcccggctttccactgctccggcactgctccaggctctttgttacttattctgaactaggaactgttctgccctgtcccagaaatctaggtttgtttgtttgtttatttgtttgttttgcaactttttattaaaagtctgacatgagaaaaaagattgcactaaaaatatttcagaactgagttttgtttaaaatagtacttcacagtagttactaagtaaatagttgggtattccctatggctgtgcattctgtgtatagattgtttacaggtgcatttcagttgtgttggtcagagagttaatttcttcatgacacaccccttttctggccagagttactatttcagtgtaaaagcttttgataatttttttccacttgaaattgatgtttgatggttttgatgtttcagattcgctatatttcacaaacacaaggcctgccagctgagtatcttctcagtgccggaacaaaaacaaccaggttttttaacagagatcctaatttggggtacccactgtggaggcttaaggtatgtcttcctactgtacagcccatttctgtacccctaccccaactttggatttagattttagtgaataatgtcttgacttagaggaggggaagtgggggaggggtatgtttgcaggagagagaaccccttgaaaacttattatagtctgtttagccttatgctgggataaaaactgagataatgaagccaatgcagctgcctgaggctgtgctgaataagcagggtcagtagctgaggggactggagagcagtgctcagtaagtgtgggagctagggaagtggagtgatagctgccacggagatctcacttctaactcttcacactcaggccttcgaggtttcctgaaataagagtttttaattctgagcctacttcttcagtgtgagaaatcaagttacctcacgatcctctgcctctgagtctagtaaacagtattggcatatggtgtccatgtccaagaagcgtcaagagacaataacatcctattcacctgaccgtcagtgctctgcggcatgaccgcaccacccccctttagaattgctgaaaggatggccacacttctccactgcaaaattttcagggtgctatctttgccttctgtagttgacactgtacaatacaatctcagtattctggcttcagattaaattaaaaatgtaaaaataatgtaaagttgtaaaaaaattcatgttttatagacacctgaagaacatgaattggaaactggaataaagtcaaaagaagctcggaagtacatttttaactgtttagatgacatggctcaggtgagtgtgacatgcttctttagagacatttttaactgtttagatgacatggctcaggtgagtgtgacatgcctctttagagacatttttaataattatatgtgctaatactttgccatgtgttaaataaaagtgtaagggtctgttgtgatacttcagactcaaacagtatggaagagcagaagaccaggggtccctcagtccaaaatgagctctcaggctagatttaaagcacattaggggttcctggtgacctctagcttactccatctctaagggcatcccattacctggcatgggggttggaaattgttcctgaggaagtctggggtaggtggcctttatcttactccatcttggaggacattccattaccaaggcctgggggctggaacctgttacaggggatctggaaatccctgacccattgtccttgcttcaggttaggtggctgggcactttctagttcctgactagctttctgaagcctgcctggggtttttcttagacagccaatttgaaacctttcatggagttagcctgtctcaaaagaacacctgaatcctaatagtggatactgtggtcctaacaatctaagtttatccctgactagctgacacataaatgaggctcataccatggttgttttatttggctctgacagttactgggggtcacctctaatctgctctgctaactgctggcttggctacctccccagcggtgtaccccagatacttgctgtttctcctggccatgtgctcatgggtcctctcccctcaccttggcttcctcctcctccctcatgcctcctctctcctcctccagcctaaacccacctacctctaatcactccagttattggctgtagtcacttttatttaacaaggaacaaggtttacacaaccaaagcttgtaggcccagactcttgggaatagaatttagcattacagtgcgtactgttagacctaatctccacgggatactttgaagatgcttgatttgaattttctttaacccaaacatcatgaaactcaaatttgtagctttttaagcaccaagaggtactaaaaaaccgttcagattttgaaggtttccgagttggggtttttgggttaaggttgttaaactgatgaagactgtgcagatattctgaattagtttttattgttgtttttgttttgttttgctttattttgtttcaagacagggtttctctgtgtagccctggctgtcttggaactcaccaggctgacctcaaactcatggagatccacctgcctctgcctttgagtactgggattaaagcccccaagcttggctataaatattccaaaatctccaggctctaaaacctgaaaccctttaccccggccttgtaaacagcaggcagcctgcgtctgttcgcctttgcttttgcttactgatcttattttggaggaatatttgtaaaggtttctctcttgtctgtctctacctcataagtaattgtctaagagctcacatttactgcctattgtgttagctaatgaagagagctagcattacacttgaaagttttgttctgggctgacaagatggctccatcatgaggaagggggcttgctaccacgccccacatcctgagtgtgactcccacagtccacataagaatgcttactgcattccaaatttaactgctttgtactatgccatttcattttttcaatgatagaaacttgtttatttcaataatgaaaaacatctttttgctgaacaactttcaaaatgttaatgccaagagtcaatttagctctattataccatataggcagagagtttccttctgtggaattattattctgtaattaaacttaatttccccagttttctcttttctaaaatgcttctattaaatatctgctttctcttgtttggagagaaaaagcagacacagtaagctcttaatgtactatttaagtcaggaaatacaacatttctaattttctttgcttgcaaaggtaaatatgtctacagacttagaggggacagatatgttagcagagaaagcagatcggagagagtatattgatcttctaaagaaaatgctgacgattgatgcagataagagaatcacgcctctgaagactcttaaccaccaatttgtgacgatgagtcacctcctggactttcctcacagcagccagtgagtatgggggtcgggctgtgccgctgtgtccgcacagcagccagtgagtatggggtcgggctgtgccgctgtgtccacacagcagccagtgagtatggggtcagctgtgccgctgtgtccacacagcagccagtgagtatggggtcaggtgtgccgctgtgtccacacagcagccagtgagtatggggtagtcgggtgtgccgctgtgtccacacagcagccagtgagtatggggtcaggtgtgccgctgtgtccacacagcagccagtgagtatggggtagtcgggtgtgccgctgtgtccacacagcagccagtgagtatggggtcggctgtgccgctgtgtccacacagcagccagtgagtatggggtagtcgggtgtgccgctgtgtccacacagcagccagtgagtatggggtcgggttgtgccgctgtgtccgcacagcagccagtgagtatggggtcgggtgtgccgctgtgtccacacagcagccagtgagtatgggggtcgggctgtgccgctgtgcctcggtggagttgccatcttatttccagggcgctgccaggtcagcagtcattttgttgctggtaaattgactcactggtgcttttctttctaaaagctgtgggcttagagagaggtgtcgatttttcttcttgttagaacaacccttggttcttctttctgaaaatatttggaaacaaatactttgttccatgtctgttttgaattttttgttttaactccagcattcatttagtgtatttctaatctttttcagcgttaagtcctgtttccagaacatggagatctgcaagcggagggttcacatgtatgacacagtgagtcagatcaagagtcccttcactacacatgtcgctccaaatacaagcacaaatctaaccatgagcttcagcaaccagctcaacacagtgcacaatcaggtacagtgagggactgtgggaactcgagcctaggtggggcagaggcagtaagagagaccagtcctatgctgctatttctgttgcttctttagcattttctgtgtgagggcctgggcaagatggctcatcaggtaaaagtccttgccgtgcaagcctgggggcctcagtttgatcatgaaaagtcatggtagaaaacttaatttccaaaagttgtcctcagactgtagaacacgcatgcccacactcacaggtatcatgcatgtgtgataataatgcaggccagtttcgggctcagtcttctctgttatgaagaaaagaattggcaaacataataaacgaccaaatagatgtacctgcaagccatattcggacagtatttaaatacatgtccttataagacttagtgtacatgggctctgaatattgaattacttgttgctgctagattactaagcttgatcaagtaatttactcttttgcaataggattttatatgtactcatatacataaaataaataaaccttttaaaaaaggtggcattatatttgcttgctaataagaaaagtctctctaaaaatgtaagctcagttttttagtttggtgtactttttaaaaaaacctgtaagtgcttatgagtttcagtggactctcctatgaagcatgctgctgacatagctgagctttgtgtcatcacttcccagacagcaccagcgtaaccatgtgtcactcctcatgtgctgactcaccttcccttcatagtaccactctctgcttgcttatttctggttctggagatggaatctaggcaaacactgtattaccgtattcctgagctgtgtatccctagccctggaaaacttagagagttatttcaaagataactagtattacattttaaagttttgttctgggctgacaagatggccccatcatgaggaagggtgcttgctgccacgcctcacaccctgactgttactcccagaacccatatggtaagaagcgagctctgaccctccctcaagtcgtcctttgacatcatttgcacatggtgcaataaacaaataaatgctttaaaaagataaaaggctataaagctggatgtagtgctgtacaccttattcaggcagagagaagtagacatgtctctgaggtctcagccagcctgtctaacataatgaattctaggccttctagaactacataggaagaccttgttttaaaaaacaaaacaaagtaaacaaaccttttgtttttagtttttattttttaagactagggatatagctcaggtgacagtgcttgctagcatgcatggcccaacattatatcctctgcattgcaaaagcaagtatggtggtacaccttaagtcccatatccagatgatgagacgggaggatcaaaagttcaaatgtcactcttggatagataaggagtttggtgccagcctggactacatgagagtcagcctcaaaagtttttctttaaaaaaaaaaatttgagagctaggagggcagggtgtgtgagtaatggcacatgcctttagtcccagcannnnnnnnnnnnnnnnnnnnnnnnnnnnnnnnnnnnnnnnnnnnnnnnnnnnnnnnnnnnnnnnnnnnnnntgtgtgatcttgctgtttcaggccagtgttctagcttccagctctactgcagcagcagctaccctttctctggctaattcagatgtctcgctgctaaactaccaatcggctttgtacccatcgtcggcagcgccagttcctggagttgcccagcagggtgtttccttacaacctggaaccacccagatctgcactcagacagatccattccagcaaacatttatagtatgcccacctgcttttcagagtaagtacagaaactcttccctctgtggaattagacattggacttacctgctctagaagatctagttgttcagttctgatctttgataagtttaaactctgatgtagatgactgaaattgggagctgccatatagatttttttcccttttcattgattttcttgaccgagttgctgtataatgtgtttgtttccattgaaggaaaatatttgtataagcatatacatgtcagtttatagaatatatacatctttaaattgttataatcagaattgttatgtgttgactttagtgtgactttattataggatatagttaagaatatagaaactaaaaatgtcagtcatacatacagattattgttttttgaactgaaaaattctacaaaaggaagcccttgtagggaaggcacggagccatctgctgaagcctgtgattcttagttttcaaactccatcttccaataagattaattttcatatttccatgtttccttatttttcatattgtttcgtaatccagtctgttcagttctttcttttcccctagaacttgggaaatgtgtgttggaaatgtcttttggtaagctatttggaaggttaaattattttgactcttttctgacaacacacttagctttcccttaggaagtcagtgacagggtggttgtagtggctcagacctgtaatcccagcatgaggactgtggagctagtcaggtgttagagtaagacactgcctccaaaaccaagtaaaagtaaaaacaagaaataagccagacacagataacaaataccatgttttctcttatatgtaattttccttatacgtaatatgtagttttctcttattattagaccctggatttaaatatgcattctgtgacagtgcatgagtgagtgagtgagtgagtgagtgagtatgtgtgtgtgtgtgtgtgtgtgagataaaatcagaagggggattgtggtaggggaagaagagatttgtttgtttgttttttgaggcaaggtttctctgtgtagccctgactgtcctggaattcactctagaccttaaacttagaaatctgcctgcctctgcctctgcctcccaagtgctgggattaaaggcatgcaccaccactgcccagcgggggaagagatcttaaggaaggtggaaatgggctaatggagaacttgtaattggaaagcagaggagggactcttagtccttactgctgtgagcagacaccatgaccaaggcagtccttgtaagatcaacatttaattgtggaatatcatcaaggtgtaaacatggcagtgtccaggcaggcatgacacaggcagagctgagagttatatatcttatctgctgtcctctaagagaagactgaattccaggcagctaggaagtgggtctgatagcccacacccacagtgacacacctacacctacagggtcacaccttcaaatagtgccactccctgggctgagcatatacaatccatcacagggactaactgggagagggaagagaactgcctgccgggagtccggaggagcaggacactaggaaagggaatgaatgagaccaagtgtcatggcatgactgagggtgctatgatgaaacccactgctctgtagacaaacttgaaacccttaattttgaaaaaagagaaagagaagcttggtgtcaatgtgggaataaaccaggatccaggcttctcagagcattttatatagaagcaggtagcctttttatctttttacttaagttacttattgattgtgacttttgtttgtttggtttctgacagagtcggagcaagcggaaggaaatgagggtctgggggaaactgagagctccccgggaggccaggagagcggtagcggtgtaagccagggagagaccacagggggagcgcaggagcagattcacaatccgtaaatgcaaatttagcctaatttaccaaattattttctatatatacctcataggagtagattctatattttgggttgtcacaaactgatcatctatagactgtagcaaattagctatccctcttctcaccctttctaaagtaagttctgtgggaacaattttcaaatgtaagagtccgagattctctgccgattctcagatgatactgagataaaataataaaagaacttttgagttctttacagaacaaaatgtaaactgagacagtacgggaaatgtgggagaactcactttggtataatttgataaatgtaagcttgggagttgagggggaggcgtggaccttccagtttaagaagtctagataacctgagcgcctatagaacagatttaaagtgtttggatgagaaggggtttataataaagtggtaatgatgatacctgaagtccattatcatatgtgccagacagtcctttacaggtatcagtttatccttatgtatggctctaggaggtgggtcatgtcaacccattttataaatgacaaaacctgcttatgccaaaaggccaaaagtaatatagtaatttatggttgaaccattagaacctaggcaatggggttatcgtcacgtatgtattgaaatactccatactgccttttaggattagttgtataaagttgctggttacccaccaacctcagccatgagctgattttgtccaacagtccgtgacttcagagtattcgctcttctatattcttttacaaaatggcttcacttaagagtatcaggcagtgtttaccttcttttcacatttctgtagttctctatatttaaagtactaaattcagaaaaataaaacaaaaataactcctgttctcttagctcaggattccaggacaaatgaatgccctttggtagtcttgtttttatttgtggtagaaagaagcagctagttgtaacttagccacactgctgagcaaatgcagcagtctggcattcataggtcatttctgcaaattcctttccacacttctccagctgagcagtgtggtatccatgtgctcggttgtagctagtctgtaatcctgtccccgtttattttaccactctgggagccatagataagctactacagtgagcattcctcctcccagtgtctgcttcataagtgcctataagttttgggaagctaatatacaataccgtcccagagtcagtcattgtccaaagactgtagacaagagttttgaatgggttagctttcctattggataatagtgccacaggctgcatggctgacaacttttacattttagtatcttcaaatttaatatctttaaattttaattatctccaaaagttttaaatcagattttactattccgtttttgaacttgtctagaatacattttttttttttaatcataaagtactaacagaaaattgaaggactgactggaaatagcagtattacgctcatgtggcactctataggaatgctcagagtaggccaggaagagtggcacacacctgtagtctcagcatttggaagaccaaaacaggaagatcgcagagtcgtaccagttggggctctgctagagtgagggaagagacagaacgggagtaggattgcccatagcttaggagtcttctaattaacatgccgtgtcttcacttagcagaattgcaggcattagcagacaggagggaggctggacagaaatgtgaagtctggtgagagggctggcaggagggtaggaacatagaaatcttcctgggctctatagacttgaccagatgaactgtgtggggccctttcccccagagcaagacaatgccatttacaggaagtgttgtttatgctagaagcacaatcaggtgagataagtaagacagcgctggtattcaagtgatgctcagttctctgttcttgatagatttcactgtgaaagctcgctcttcctcacccattcccctagtgaactgcaaggtaaatgtgacttaagagtggaggttgtctggcttttgcttgtactgataatggggatgaaataagtattttaacagtaagagtttatattcccttaagccagccttccctgcattaaatgccttccactaatttaacttgaagggaatagcctccttttcttaactgtggtatcttttgtgagtggaaaggctttgtcttaactgtctagaattaaacctgagcagtgaagaaaacacacagtaatgacccagcatctgttcagacccagcagagacgtttcactgtcatgttttcttcaccagctggactacaagcaacaacaaagcattctggattccctgtgaggatggataatgctgtgccaattgtaccccaggcgcctgctgctcagccgctgcagatccagtcaggagtactcacacaggtaaaagccggagcagcactattgagaaacaaatattttgtcctgaaaaaaaaaaaaaaaagtggtatttgctttgactataagatctttcttgctcatgattcagacgtcttaaaatgaaatatctctaagaaagcagaatatttattcctgtcctttacaactctcccattgtctctttagacttgtagagatggcgctctgtacattgagaaatgtcatgagagtacagagttttccagatgatcgagaaactgaggtcatagacaaaatcatgaaggatgtgtatagtatacaacattacactttgaattccatgtgtaaatgtttgtgctccacaacaaaccagaaattctgaaatccaaaaacttattttgtgagtagaaggaagatttcttcataagtgaaatgcctgtgttctataggatgttctgaatctggttcaagacctagacctatagcttatacctaagattcctatatctctttttacctgatatcattgacttttggcgtagtgggctaaagccactcacggctgaaaaggaaaggttgtgtttggcatgtgcgtttaggtggtaggaaattagctcattgtcagttataacttggggggatgcaaacccgtctgaacccagataacctgcctcggtgttcattcactcacctgcctgatctacatttcagggaagctgtacaccactaatggtagcaactctccaccctcaagtagccaccatcacgccgcagtatgcggtgccctttaccctgagctgcgcagcaggccggccggcgctggttgaacagactgctgctgtactggtaattccctcacttgattgtgttactaacggagtttctttggtttctttctttttttattttttcctgtttgtttttgttctgttcttctggttttctcattcaaaaaacaaaaccaaaaaacctagcttagtctttgcagagggcatggaagcatgtgccatcttgtggctgtgtccttgctacatctttaatgtctcattgtttcctccccaacatttgctgaagcactgtttgactctgaggatctgtgaggttcttctttgcaagcctggtgtggttaaagctctctgtgtagccgcaggcaagcttcagcactccacctgttttctaccctctcttaccctggtcttatgagatgggagcaaatgaacagccttccatgtggccctgccacaggaatccagatgccaaaacttgaactccctgtcaagctagctgctcctttttgttattgtaatctcctaatactttcgtgtgtatggaaatgtttaaaatggccttaacgtatggctttctcatcccgtgaacttccttctgtgactgtctgaagatagtgcttttgccattcatgatcagtggcacnnnnnnnnnnnnnnnnnnnnnnnnnnnnnnnnnnnnnnnnntgcttttgccattcatgaatcagtggcacctttcatcttccatgtaagggtgttcccattaaatacacttagagcattctgctcatcagaaattaaaagtggacctatttgtagggattgttctgacaaattatgttacaaataaattgcagtacaaagatggaaatatggctgacaaacttgcaagcacagtatctttgtttagaagtcccaaggagagagtcagctcagatagctgagtggtgggtgtgtccagctcagagatggaaacaagacagctggctttgcagtgtattctaggatttgtaacctccagagtgatttaggctgtgttttgttttggtttattttggtgaattagaattatctcaaatccagcatttcattatttgacatttaaaattaggtaagcccctgcaaacctaaatgatacttttgaatctcctggtatttatctttcgcagtggatttaaatttctgttacctctcaagtgttcatgaatggaaacgctttctgaaacatacttgcatggagcttgtttggtttgcagttgtgtcacctgtgggttgtttctcataagcatcaaacctgagtgccagggagtcagacacaattccagcccaccttttaatttgctcacttataatagttttgagattggaaatgtcagttgacctttcacctttgctgctcttcttaagtttgctctagccatttgttaagctttgcatatttttgttcttcctctgtcaaaacagttcgtcgcttggaacgccagatttctgcctcccattggaatgttatttcttgctctgtattaaactacacgctttgtcttgcgcaggtgttggcttatggaaagacgcatggtgtgacttaacatctcttattttctgttctgttctgttctgttttaaattctgcctgtggtagcagacgtgtttgcagtttctctgctcagaaggcttcttgtttggaaccagtatttgtaacaagtggatctgttacttgcagaaatatttttgaaactgttttgatgggcttgcaatttgaaattcatgaaacagagccatatggtaccctagtaggtgaattgcaccacggaactcagatttaaaaaggaaacttgctgttatatgtgttttcagaaagtgccagtttctatatgaagtacagaaaatgaattttttactcagtctatcctaagcaccatcattgtctcttaaaaactagaagtactctattttcctatagtgattagtttggtgttaaaattctactaatgatacataaaacatatgttttgagcaacctttaaaaacaatgtggtgctttaaaaattatttagaaaaatttttgttcattgacttaatttttaattctatcatatagctaaaagtaatgtttttagctgtcttttgctgatatcagcttatttaccaaagcatttagtatttggtcatccatgtctgctatattttattggttgaattgatctgttgtcttacctgattggcattcaaattttagaatttctgttttctaagccagtcttctataggcttttgtgaaaagaatattatttcactagggtttccttgagcctccaggttccttttcttgacagcacagagacccatacctgcagggacctttgtttcttagtaccctgcttgcgggtcaggttctgctggtcgccaaagcatgccagcagcccctttccctttcactgctctggcagccaccagtaagccctctgcattgcctctctctcttttttaatctctgcaagttaacaatctacaaacattttttttttaagatacaactttttctttcatctgaaaaacaaaataaaaagctacgaatgagtcaagtctggatcttttatgtgtttccttgcagcaagcctggcctggaggaacccaacaaattctcctgccttcagcctggcagcagctgcccggggtagctctgcacaactctgtccagcctgctgcagtgattccagaggccatggggagcagccaacagctagctgactggaggcaagcacaagctacccgccctctccctctgcacatgagtggtgggagcctagaaaggaggagtacttggtatgaagaggctaggaagaaaggaaatttattatgtttgaaggcctttgagaaaatgaatcatcattctagaaaaagagtcataagaaaaatagcagatatttttgaaatataaggttctgtgatcaggaatcatgaacttcatatgtaaacaggccttacctgattggaaaggacacagtgagatcttaaagccttacaatcccagcgcctgactgtaaaaagtaaaacatagcggtggttaaatggctttaatacccatttggtccagcatgttagtggttcagggagtcactcttctgtttctttatgttggtacaggaatgcccactctcatggcaaccagtacagcactattatgcagcagccatctttgctgaccaaccatgtgaccttggccactgctcagcctctgaatgttggtgttgcccatgttgtcagacaacaacagtctagttccctcccttcaaagaagaataagcagtctgctccagtttcatccaagtaagtctatgttaggtcctgcgcttaacatggagagttacgtggtctggcattggttgtcatagtataggtattttagtatgaagtagcaagtacctgccaagttgagcatgagctgatcttttcatttgggccgcgtgttctcgatataatcatcttttgtgtctcctgtcactttaggtccaggccacttttataatgttttaatttttgttgtatttactatttgtgtgatgtgaagtaaagtgagtgatttttgtgtggttgtgtgtgtgtgtgtgtgtgtgtgtgtgtgtgtatgtgtgtgtgtgtggtgaatatgccttggcagatatatgtaggtcagagggcaatgtccaagagtcagttctctcctaccatattagtccctgggattgaactcaggctatcaggttagggtgggaagcactgagccttctggctagaaatgttttcattttccttcctactttttatagagtaaaacgtaacctggggacagaggtgcataaacatacaaatttttatctttggaaatatgttcttattggaatagtagccagaatcattaggttttttattagaacttttatagttaaatgtattattgattaggtaaagaagaaccagaaagcaattagaaagtcagaggaagggatgtgcagtcggaatggtgggccaaggcctgctagtcttaacttgtgaactttcccacagatcctctctggaagtcctgccttctcaagtttattctctggttgggagtagtcctcttcgtaccacatcttcttataattccctagttcctgtccaagaccagcatcagccaatcatcattccagatacccccagccctcctgtgagtgtcatcactatccgtagtgacactgatgaagaagaggacaacaaatacaagcccaataggtaagctaggcaaaaggttgtcaggcgttgtctgcctttgttaacatcagcagacctttagtcattgactgatagctgtattcaagggcaattttgactgacaacaaaagacaaagagcagacagaagagagaggtaatttgtaagtatagctctggataagttagtcaaacacagacgttctcataactgagccttgtcaagttctcttcagtgttattcatcaattaactcaggtttgtatggctactctggcttcaattcatgttaagttccaggcatgctcctagccttcagggagcttattctgaaaacagttcgttgtagtgaattaggtagatagattatgtgaagcttacatatcttattctgagaaatcttcccagggagagggaggacaggaccctcatatggtctgaaacctgacgaagcttccttttatctagcgtttttgccaagtatattagttatttttctgttgctgtgtagaacatcttgacaaaaagcaactcagaagcaaaatggtacattttggcttagaggttcagagagcatagacatggccagtctcatggtggggaagccatggaagcaggaatgtgagtctggacggacaggaagcggtcggagcacatttgcttcacattgaagaagcagacaaggaacaggaggtgaagccaggctgtaaaatctcagagcctctccagtgctgtgctttctctagcaaagctccacctccaaaagcttccctaaccttcccaagctttgaccccagctgagaaccaaggcagctgatggggaccctcgtcgttcaaaccacggcactctccttaactaggcagtttactgagagggtaccggaagtttaagaactatgcagcgggccttgattgatctgtgtgatgctctttattgagcttttggtgtcgtgtgaccttttacctacaaaggtaaatgtcgcataggaaagtgaattaagagactttatcaaattataactaactgagctttaaagatttattaatttccaggtattggtggcacatgcctttaattctagtactcaggaggcagaggcaggcagatctataatgagttcaaagccagcctggtctacattacaaatattaggctagccaaaggggctatacagtgagatcttgtcttaaaaaaaaaaaagaaaaaaaatctatgaataaacaaataagcaaataagataaagatttattacttatgctcttgtgtgtatgagtttgggtgcctgtggaagctgaggaggacatggggtcccttgaagctggggtgatagtgctcatgagctgcctgacttaggtgcttagaaactgaactctgaacactggaaagagcaacaggctcttaatgagctgtctccagcctgctgagtgaagtttgaatgaacttagaaaaacaagttagaaagcagttcaggccttttaggtgaacttacaagtcaggttttgaaggtgctcatgaactgatttggggggagagaaaataagtaaaccttttggtgaaagaaagtgacagactcatagcaaaagttacctctgaggtgtggccccttgatttctctgactgaagccaatcctactgaaaaataaggaaagttgaagacgataaactgagagccattatggaatctttttcaaagcagttcagctgggcatgggggtacagtacacacctgttatttcagcatttgggaagcagaggcaggagaacttggggctctaggccatactgggctacatatggccaagactctgcctcaaacaaatgaaaaacaaaaccagacctatagtgagaagtttgcttaaagacagaaacatttgagtctaaggaaacgataaaggagaaagaacagtgcttgaagactgtcactgtcggagctacagtgagaagagctaagaggcagcgggaactgtggactccaagatggttgtaccctaggtctgcgtgctgtctttcctattcattctttgtatgatcttgtataaactcctcgtctatgttttaatttccttatctacaatagggatgaggtaatattgtgcagggttgaaaagattccccagctagtgtgagaaagcagtgcctgatgcagactaatacttagcctctagctgctgtggtaactgtcatcattgttaggagagaccttcagaccaaggaaggcactgcttaaaagggcagttataactgtctgcattttcttctcctcagctcgagcctgaaggcgaggtctaatgtcatcagttatgtcactgtcaatgattctccagactctgactcctccctgagcagcccacatcccacagacactctgagtgctctgcggggcaacagtgggacccttctggagggacctggcagacctgcagcagatggcattggcacccgtactatcattgtgcctcctttgaaaacacagcttggcgactgcactgtagcaacacaggcctcaggtaaggaggatctttgaagttagaattgaattttccttggatgtgcatatatttaatatttagttatattatgctagtggttaaaactaagcatagatatttttaaatagtacttaattcagaaatcagttccctgtaataggaatttttgtttgatgaatttatcttcctacatttatttgcttggattaatatgggaatgaagttgttttgtgtcagcattagtgttttcaatatattcacctctggtgggaaaaattgagaagacatcctttagtagcaggaagcagtttggcttgccagacctgatttggatttaattatgtagagtagaaaggacttgataatactaaagatgactgggagctgaagatggtgagttagtagttaaaagtgcttgctctgctcctcttccagaggacctgaatttgatttctgttacccacatcaggcagcataccactgcctgtataactgcagctctaggggaagcaagaccttctggactctgtgggcatcctcaagcatagacacatacacacatgggtaaaaatcaaataaaaatttttaaatgactttaacatgcccttttagactttcagccatagcagtaatgctttttagtttgatttttacctagttattttcatctactttgttgttggataccgagctcaaggcccttagttttagttgtgtgttagttgagcagtactagggcagtaacaagtcccaatttcctagcagactttacttttacttacaccacttcccacttgcaagcatctctggttgctaggcttgcatggttcttagcatcctgttggaagtttggaggagataaacctttcttaacctctagatgcagagaggcccaggaaaggcagtctgattaggcagctgcttcccattggcaattttattgcaaagggagggagggatgttttttggtgttagaatagccacctgtgtcttacacttaaatagtgttttattataggtcattctacttactgcttataggccatgaaagggttctaatttaagaacacttgtgttaagtcagtgtacttctccgtagagatagtctgctgccttgaagacaaggtagaacataaaagtacaggctccttggggcatgcagggtgttccctgtatctctactgtttccttatatgtaatagacgttagatagttttacttaggttgctatttaaggatctctgtgggtttgtggcaacacagaaaagaggtggataaaaacagtttttgttgttctggtacaaatgtaattgaggaagtaagttgtactgaaacttaactctagcaaatgacagacagaatgtgacctaatgtgatactctaaggttagatcagtgcttctaaaccttgactcctttttaggtctccttagcagtaagaccaagccagtggcctcagtgagtgggcagtcatctggatgctgtatcactcccacggggtaccgggctcagcgagggggagccagcgcggtgcagccactcaaccttagccaggtaagcgctaggggctgctaccttctgtttacgttcttccctgttgttactctttggagaaccctgcttctagctggaccgctgaataaagccaaatgaagctccttttgtgtcaaacctctggtgttctgtggctggcgtcgtacctgcatgtgctacgtctgttcatctgatcagtgagtgtgaggggatgtactgcaccgccatacatgctttgaacctgattctctccctttatcctcaggccataagtaactggagccttacactctttacctgaggcaaggcagagaaagccacttacttaaatcagctggttctaatcctaactgttcctagagcttgggacacgccctgccgtgtgatcctctgatgggatagtgagggcttgtgtgatgtctgtcagaagtgagtatcagaatgagggagagagtggagatcacacgcaggtgcagatggaagttgagttagcgcatgcccttgaggttccatactgagctgaggcgagcttagaggagagaaaaagaaaccagtaagaaaagtcagttaacaaaaccccactgattccaggacaggatgacttaagttactaacctgtagctatggaagaacccccacttcctctcatacttttatactcttgccttcttcttgagctgagttaggatctgttcttccaagaggcagaggcatagttggctcaattagcttccattacctgactgggagattccaggaacaatacatgtgagaacctcaaggcctttggcgccatgaaccagagtgacctcaagattcctcattcccttcttcctccttccagaaccagcagtcatcgtcagcttcaacctcgcaggaaagaagcagcaaccctgctccccgcagacagcaggcatttgtggccccgctctcccaagccccctacgccttccagcatggcagcccactgcactcgacggggcacccacacttggccccagcccctgctcacctgccaagccagcctcacctgtatacgtacgctgcccccacttctgctgctgcattgggctccaccagttccattgctcatctgttctccccccagggttcctcaaggcatgctgcagcttataccacacaccctagcactctggtgcatcaggttcctgtcagtgtcgggcccagcctcctcacttctgccagtgtggcccctgctcagtaccaacaccagtttgccactcagtcctacatcgggtcttcccgaggctcaacaatttacactggatacccgctgagtcctaccaagatcagtcagtattcttacttgtagttgatgagcacgaggagggctccgtggctgcctgctagtagccctgagttcttaatgggctctggagagcacctccattatctcctcttgaaagttcctagccagcagcgcgttctgcggggcccactgaagcagaaggcttttccctggggaacagctctcggtgttgactgcattgttgcagtctcccaagtctgccctgtttttttaattctttattcttgtgacagcatttttggacgttggaagagctcagaagcccatcttctgcagttaccaaggaagaaagatcgttctgaagttaccctctgtcatacatttggtctctttgacttggtttctataaatgtttttaaaatgaagtaaagctcttctttacgaggggaaatgctgacttgaaatcctgtaacagatgagaaagagtcattactttttgtttgcttaaaaaactaaaacacaagacttccttgtcttttattttgaaagcagcttagcaaggctgtgcttatggcgtatggaaacagagtgatttcattttcatgtcgtgctgtccttactgggcagttgttagagttttagtacaacgagtactgaaacctgtgcagctgctgctgagctgctcgcagagcagcactgaacaggcagccagcgctgctgggaaggaaggtgagggtgaggactgtgcccaccaggattcattctaaatgaagaccatgagttcaagtcctcctcctctctctagtttaacttaaattctccttatagaaaagccagtgaggtggtaagtgtatggtggtggtttgcatacaatagtatgcaaaatctctctctagaatgagatactggcactgataaacattgcctaagatttctatgaattttcaataatacacgtctgtgttttcctcatctctcccttctgtttcatgtgacttatttgaggggaaaactaaagaaactaaaaccagataagttgtgtatagcttttatactttaaagtagcttcctttgtatgccaacagcaaattgaatgctctcttactaagacttatgtaataagtgcatgtaggaattgcagaaaatattttaaaagtttattactgaatttaaaaatattttagaagttttgtaatggtggtgttttaatattttgcataattaaatatgtacatattgattagaagaaatataacaatttttcctctaacccaaaatgttatttgtaatcaaatgtgtagtgattacacttgaattgtgtatttagtgtgtatctgatcctccagtgttaccccggagatggattatgtctccattgtatttaaaccaaaatgaactgatacttgttggaatgtatgtgaactaattgcaattctattagagcatattactgtagtgctgagagagcaggggcattgcctgcagagaggagaccttgggattgttttgcacaggtgtgtctggtgaggagttgttcagtgtgtgtcttttccttcctcctctcctctctccccttattgtagtgccttatatgataatgtagtggttaatagagtttacagtgagcttgccttaggatgaccagcaagccccagtgaccccaagctgttcgctgggatttaacagagcaggttgagtagctgtgttgtgtaaatgcgttcgtgttctcagtctccctaccgacagtgacaagtcaaagccgcagctttcctccttaactgccacctctgtcccgttccattttggatcttcagctcagttctcacagaagcattccctaacgtggctctctcactgtgccttgctacctggcttctgtgagagttcaggaagcaggcgagaagagtgacgccagtgctaaatatgcatatttgaaggtttgtgcattacttagggtgggattccttttctctcctccatgtgatatgatagtcctttctgcatagctgtcgttcctggtaaactttgcttggtttttttttttttttgtttgttgtttttttttttaaagcatgtaacagatgtgtttataccaaagagcctgttgtattgcttaatatgtcccatactacgagaagggttttgtagaactactggtgacaagaagctcacagaaaggtttcttaattagtgacgaatatgaaaaagaaagcaaaacctcttgaatctgaacaattcctgaggtttctttgggacaacatgttgttcttggggccctgcacactgtaaaattgtcctagtattcaacccctccatggatttgggtcaagttgaaggtactaggggtggggacattcttgcccatgagggatttgtggggagaaggttaaccctaagctacagatgtggtccacctgaattaaattatatcagagtggtaattctaggattggttctgtgtaggtggtgtcagggaggtgcaggatggagatgggagatttcatggaacccggtcaggaaagctctgaaccaggtggaacaccgaggggctgtcaacgaacttggagtttcttcatcatggggaggaagagtttccagggcagggcaggtagtcagtttagcctgccggcaacgtggtgtgtgttgtcttttctttaatcattatattaagctgtgcgttcagcagtctgttggttgagataaccacgcatcattgtgtagtttgtcactagtgttataccgtttatgtcattctgtgtgtgatctttgtgtttcctttcccccaagcattctgggtttttcctatttaaatacagttctagtttctaggcaaacatttttttttttaaccttttctctataagggacaagatttattgtttttataggaatgagatgcagggaaaaaacaaaccaaccctgtccccacctcctcacctccctaatccaataagcagttattgaagatgggagtcttaaatttatgggaaaagaggatgcctaggagtttgcatcgttacctgagacatctggctagcagtgtgactttacagactttgaggttgtcactctgcaaactgacatttcagattttcctagataacccatctgtgtctgctgaatgtgtatgcgccagacatagttttacattcattctggcctggggcttaacattgactgcttgccctgatggcatggaggagagccctacgaacatagcgctgacctaggtcagcattgcctgaccttggaacagcttaaggctttaaaccttctcttagaacgtgcatttccagtttctcccttcccaggtgagagaggaactggaagggttgcataggcacacaccaggacacttagtcactccagagtccccagttgcaactaggaggtggttaccctgttaaccccaggaagaagaaccccatttcaaacagttccggccattgagagcctgcttttgtggttgctcatccgtcatcatccgctagaggggcttagccaggccagcacagtactggctgtcctattctgcattagtatgcaggaatttactagttgagatggtttgttttaggataggagatgaaattgcctctcggtgacaggaatggccaagcctgctttgtgtttttttttaactgatggatggtgcagcatgtctccacgtttccatggttgtttgttgctaaactttatataatgtgtggtttcaattcaattcagcttgaaaaataatctcactatatgtagcagtacattatatgtacattatatgtaatgttagtatttctgctttgaatccttgatattgcaatggaattcctactttattaaatgtatttgatatgctagttcctgtgtgtggttaaacttttttttctttctcccttttctggttgtgtgcttcctttacaacaagcttctagaaacaggtagttctgagaattactgatctatgtttgtaatgcaggtgtacttagggagtatgtaaaatcatcattttaacaaaagaaatagctatttaaaatttaatactaactatgggaaaagggtccattgtgtaaaacatagtttatctttggattcgttgttgtctttggttttacaaagtagcttgtattttcagtattttctacataatatggtaaaaaagtagagcagttgcaatgcatcaataaaatgggtaaattttctgactgtggctggtttcaattctgtgttaggacatggaggggactgacatgtggcctctttgaagtgcctaagcattctgtttgaacatgagtagaacactgctacattagaacatctttgtacacatttccatactggaaatgaatatagttttgtaggaagtatttccctgactctgaccccttgaaaaggcagatggcttttgagataaactaattaacatcatttcctagcacatgacaccaaacattcaaatcagcacagtgaaaatgaaacttagggaaagatatttttgtctgtctccttaggccctgttagagctgtcacctctttagggacagctctgcggtaatgcacctgctgctcttatggagggggtctgggttccattcccagcacccagtcagacccctcacaagtgatttctaactccagccgcagggtgctggcctgtgcatacccacacagacacataatgaactcttaaaaacaagaagaacctctgatccaatttctcttgattccaaagtgaacaaaattttctcctgaaaagaaactggaatttgtctagattaatcactgcaggcccctttgtaaatgctgcatatttgacttcttctgatgtatgttcctgcctagctcccctgtagctttagctggatagaaaggaggaacatgggctggagagaaggcttagtagttgagtgtactgttctttcagaggagaggggctcagtgctcaggaacaataggcagtgcacaatctcctaaaattcagctctgaagatctgacgccctcgtctggtccccacggatacctgtatcccatgcagatacctgtatacagacacataaaagcatatgtaactgaaaaaccaaattttttttacttaattttaaagaaatgagagatacttacaaatgccctactgaaccataaccaagaaaggcgatcaatagtctgttctctcccagtgataggaaggtcagaatatatttgttttcctttagactatgttgtacatatttttattttcaggtttctcccctaaatccatgaatataaactagcatgtccttgctgcaccctcctatttgggaaatacctggaaagtcatgtcaaggatatttaagtcagctagcttaaaacaaaaacaaaaaaccccacctcccatttctcaacaacctccagttttgtttctattcctttccttgggctaaatcagagatttggtactccatagggagccctgtgatttggcttgcttaggtagagattctcccacacggtgaagtcctcgcctgatttctttgccatgggagatggccccagaatgctcagcacaaggtggcgccaatgagctatagaaagttgacttccctttgccccaacccccatcccctcaaacctcatctcctgtgtttctggcttcactgaacaaggcagaaaatccattctgttatttctggagaagggataggttaatgaagggtgctgggttcttaccgagtcagcactggaagccctctcctaaaacgaatggagtttgctgagttttccggggggtctcggcttcctgcagcttgctcctttttcagaaggcctctgcctccagattgccatctctcccctttccggaggagctcacaagtctaagttgctggtagttaaggcttctggcgactgtgcaaaggggccatctgtgtttgatcaggccaggcgggaaggagggggtgggggttgtaaagagactgaaagcattccagagtagtgagagacaccagagatgggaaggaggaggccccgccccgcccccagagctaacgggctggagggaaagaggccgaatgcacacactcctctggccccacttaaggctgccatggggcccagtgctcctctgctgctcctcttctttttgtcatggacgggaccccttcagggacagcagcaccaccttgtggagtacatggaacgccgactagctgccttagaggtgagggacttgtttctcttctcacccaggatgagtccacatctataggtgcaactagctgtcagggctctgggagtgacaagatcgggttgtgtaagaagtccttaatgacgagtagcctcttaactacagacttttatttccccaacataagacaattgcccagcaaataaacgcaacacggctccctcagattagatggaataagggggcaggggaaatgagagtcagaatcgggctgcatctatgctgctatactgttcaagtttcccaggcaatctgcctgcaacttcctgtccgtttcttccccgcaccccacatctactcccttttggacaatttgaagtctgtagcatcctaatttcctggaggctcagatcactgagaacgcaaggtgaaggactcttattcaggcaaattaagccaggttcctcggatgggatggtaccactgactagtctcctctgctgtgggagcatggctgagctggtccctttcctggccctgactccctggctgggcctctgcttgtctgggagctataaacctgcaacccacccttcctgactccccgatcccttcaggaacggctggcccaatgccaggatcagagtagtcggcatgctgccgagcttcgggacttcaaaaacaagatgttgcctctcctggaggtggcagagaaggagcgggagaccctcagaactgaagcagactccatctcaggaagagtggaccgtcttgaaagggaggtagactatctggagacacagaacccagctttgccctgtgtagagctggatgagaaggtgactggaggtcctggagccaaaggcaagggccgaagaaatgagaaatacgatatggtgacgggtaagtgatctcacagaggtccagacagtttcagaactcccctttcctgcttttttcttcttgtcccaagccaccatagctctatctttcagaatgacacattcattgagagtttctagaggcctgtcctttatcggtactccatctctcaaccctccatgagtggacacatgcatggaaaagtgtgtctctgttccccaggtggcccactctgggggaagttcctgttatacacatctaactcttggcctctgtttccttttgtgctttctcctcttccccaccagactgtagctacacagtcgctcaggtgaggtcaatgaagatcctgaagcggtttggtggttcagctggcctatggaccaaggatccgctggggccagcagagaagatctacgtgttagacggcacccagaacgacacggcttttgtcttcccaaggctgcgtgacttcacccttgccatggctgcccggaaagcttcccgaattcgggtgcccttcccctgggtaggcacggggcagctggtgtacggtggcttcctttattatgctcgaaggcctcctggaggacctggagggggtggtgaattggagaacactctgcagctgatcaaatttcacttggcaaaccgaacagtggtggatagctcagtgttccctgcagagagcctgatacccccctacggcctgacagcagatacatatatcgacctggcagctgatgaggagggcctgtgggctgtctatgccactcgagatgatgacaggcatttgtgtctagccaagttagacccacagacacttgacacagagcagcagtgggacacaccatgtcccagagagaacgcagaggctgcgtttgtcatctgtgggaccctgtacgttgtctataacacccgccctgccagtagggctcgtattcagtgttccttcgatgccagtggtactctcgcccctgaaagggcagcactctcctattttccacgccgatatggtgcccatgccagccttcgctataacccccgtgagcgccagctgtatgcctgggatgatggctatcagattgtctacaaattggagatgaagaagaaggaggaggaagtttaagcagctagccttgtgctcttgattcttatgcccagacatttatattcctgtgagctctcctgcagttcatccttcaaaacgaaggccagtggtggtagctcatataccctaatttctaaaggacaaccaaattctcaagcccctctgttttatgcagaactccagatcctgggtagcattttagaactgaacagcaaacaaacaccctaaatcttcactcctgccttatgtccacaaagtttagttccaaactcagagccctgtcctttggagagggtcaaccccagacagcaggcgacagcattcttgccctcagtatgaccgaagggagagaactcagagacaaagctgccctccctcccttccccctccagtgtaggggagaatggggctttccccacatcactttgtatggtaacagtttgcattaaaaggaaaacccaccattcctctctggtgtgtttggggtagccctctgatcagagttctcgtggctctgccttcttcctcctgccccagtctctgctccttagccacggctgggctgggctggcctcctttagctccctcgggaacttctctagttacacattttactgtggggcactgttggacaaaggcctccccctccacactcatgtgctccacagcagccgcagagaaccagcaatggcactcagcctctgactgctggacactggagcccagccagagccagggcttcccattccacctcttggtggattttgaaccagaaagtgactcttactagctgtggaatctagtgtagaaaccagcgtgcggtatctatgtgtgtctagcctcacctctgaagtggattctgtctctgagcccaagtctccactcccacctccagcactggggcttcctgggtctgggttgcacaatccttggtctgaaccgctccgattttcctgctgccacagcgtctgcggtttgggcagggaggaggggcagtgaccatcccagatgttggtctgtctcaccagctccccaacaaacacatccctactttccttctctccaccctcagctgtgcaccctcccaccccagccctggaaactggagtcctggaaacttaacccctgttggtctaatgtgcacccgacttcaggggggcaatccaggaaggattggaagagcaagaggctttggattccatctctgggaacctgctggtctctgcacgatgtcccttcccaggtctcatctccagggtcaacttccagacaaataaggctagctgatggataaaagtcagtgggggagtttaacctcaggcagcccttctggattatcacccagggaggaagggggacaggaacacagccttctctcccaagtagaaccctccctccttccacccaggatggggtggatcagtcaacactcctccttttgtctgtctttcttctctccacaggcagagctgctcctgacgtaggttggtaaggaagaggaaagaaaggcagcaaagcacctcacaaaagcgctattgtagggagcctgaggcgggtgggggccctctcccattcaattctctcctaatgtggggctggcaacagtaatcaccgcctgtcagcccatagaggggtctgcccacggaacatctggctgcaacgcagggcatatcggagggctgtggaggaggggattctctgtggaggccttgaggagaacaggtccaggggatgacaaggtgtagagtggcgctgtggcgctgtgtgcatgtgtaatgtgcgtgtgcacatctctctgcatggctgtgcggctgagcacctgtgtgagactgggctacccagggagactgcacgtatacaaatgagtggctttgttaggctgtgtacatgcgaccgaaagggattttaggtttgagaaagaccgaggagggcactgaactccgagtgtgttgtgtgactgcaactgcacgtgtatgagcacatggcagtagcttgcccccttcccagtgtggctgcgtgcctagagggtgggcctgggactgtgcctttttgatgcccctaatgaggctggctcaggtgatgtatgtaagcaatatcagtaaaggcaagtatatgggctgtgtctttaataaatggctgcattgtctacagcctgggtccttcaaacaggtgtgtgcttgtgacatctt

SEQ ID NO: 1682 - DNA, 4084 bp, Mus musculus
ctccggccgcagacgggcgcggggacggctccggggggcgggggccggggcccgggccggctcgtgcggggggtatgatgacccggctgcggggccccggatcgcctctcctccgccgcctcctcgcggcggccccgactcgaggctgagaactacacacaccggcggtatggcctcacagctgcaggtgttttcgcccccatcagtgtcgtcgagtgccttctgcagtgcaaagaaactgaaaatagagccctctggctgggatgtttcaggacagagcagcaacgacaaatactatacccacagcaaaaccctcccagctacacaagggcaagccagctcctctcaccaggtagcaaatttcaatcttcctgcttacgaccagggcctccttctcccagctcctgccgtggagcatattgtggtaacagctgctgatagctcaggcagcgccgctacagcaaccttccaaagcagccagaccctgactcacaggagcaacgtttctttgcttgagccatatcaaaaatgtggattgaagagaaagagtgaggaagtggagagcaacggtagcgtgcagatcatagaagaacacccccctctcatgctgcagaacagaaccgtggtgggtgctgctgccacgaccaccactgtgaccaccaagagtagcagttccagcggagaaggggattaccagctggtccagcatgagatcctttgctctatgaccaacagctatgaagtcctggagttcctaggccgggggacatttggacaggtggcaaagtgctggaagcggagcaccaaggaaattgtggccattaagatcttgaagaaccacccctcctatgccagacaaggacagattgaagtgagcatcctttcccgcctaagcagtgaaaatgctgatgagtataactttgtccgttcttatgagtgttttcagcacaagaatcatacctgccttgtgtttgagatgttggagcagaacttgtacgattttctaaagcagaacaagtttagcccactgccactcaagtacataagaccaatcttgcagcaggtggccacagccctgatgaagctgaagagtcttggtctgattcatgctgaccttaaacctgaaaacataatgctagtcgatccagttcgccaaccctaccgagtgaaggtcattgactttggttctgctagtcatgtttccaaagccgtgtgttcaacctacctgcaatcacgctactacaggcaactcctgaaattatccttggattaccattctgtgaagctattgacatgtggtcactgggctgtgtaatagctgagctgttcctgggatggcctctttatcctggtgcttcagaatacgatcagattcgctatatttcacaaacacaaggcctgccagctgagtatcttctcagtgccggaacaaaaacaaccaggttttttaacagagatcctaatttggggtacccactgtggaggcttaagacacctgaagaacatgaattggaaactggaataaagtcaaaagaagctcggaagtacatttttaactgtttagatgacatggctcaggtaaatatgtctacagacttagaggggacagatatgttagcagagaaagcagatcggagagagtatattgatcttctaaagaaaatgctgacgattgatgcagataagagaatcacgcctctgaagactcttaaccaccaatttgtgacgatgagtcacctcctggactttcctcacagcagccacgttaagtcctgtttccagaacatggagatctgcaagcggagggttcacatgtatgacacagtgagtcagatcaagagtcccttcactacacatgtcgctccaaatacaagcacaaatctaaccatgagcttcagcaaccagctcaacacagtgcacaatcaggccagtgttctagcttccagctctactgcagcagcagctaccctttctctggctaattcagatgtctcgctgctaaactaccaatcggctttgtacccatcgtcggcagcgccagttcctggagttgcccagcagggtgtttccttacaacctggaaccacccagatctgcactcagacagatccattccagcaaacatttatagtatgcccacctgcttttcagactggactacaagcaacaacaaagcattctggattccctgtgaggatggataatgctgtgccaattgtaccccaggcgcctgctgctcagccgctgcagatccagtcaggagtactcacacagggaagctgtacaccactaatggtagcaactctccaccctcaagtagccaccatcacgccgcagtatgcggtgccctttaccctgagctgcgcagcaggccggccggcgctggttgaacagactgctgctgtactgcaagcctggcctggaggaacccaacaaattctcctgccttcagcctggcagcagctgcccggggtagctctgcacaactctgtccagcctgctgcagtgattccagaggccatggggagcagccaacagctagctgactggaggaatgcccactctcatggcaaccagtacagcactattatgcagcagccatctttgctgaccaaccatgtgaccttggccactgctcagcctctgaatgttggtgttgcccatgttgtcagacaacaacagtctagttccctcccttcaaagaagaataagcagtctgctccagtttcatccaaatcctctctggaagtcctgccttctcaagtttattctctggttgggagtagtcctcttcgtaccacatcttcttataattccctagttcctgtccaagaccagcatcagccaatcatcattccagatacccccagccctcctgtgagtgtcatcactatccgtagtgacactgatgaagaagaggacaacaaatacaagcccaatagctcgagcctgaaggcgaggtctaatgtcatcagttatgtcactgtcaatgattctccagactctgactcctccctgagcagcccacatcccacagacactctgagtgctctgcggggcaacagtgggacccttctggagggacctggcagacctgcagcagatggcattggcacccgtactatcattgtgcctcctttgaaaacacagcttggcgactgcactgtagcaacacaggcctcaggtctccttagcagtaagaccaagccagtggcctcagtgagtgggcagtcatctggatgctgtatcactcccacggggtaccgggctcagcgagggggagccagcgcggtgcagccactcaaccttagccagaaccagcagtcatcgtcagcttcaacctcgcaggaaagaagcagcaaccctgctccccgcagacagcaggcatttgtggccccgctctcccaagccccctacgccttccagcatggcagcccactgcactcgacggggcacccacacttggccccagcccctgctcacctgccaagccagcctcacctgtatacgtacgctgcccccacttctgctgctgcattgggctccaccagttccattgctcatctgttctccccccagggttcctcaaggcatgctgcagcttataccacacaccctagcactctggtgcatcaggttcctgtcagtgtcgggcccagcctcctcacttctgccagtgtggcccctgctcagtaccaacaccagtttgccactcagtcctacatcgggtcttcccgaggctcaacaatttacactggatacccgctgagtcctaccaagatcagtcagtattcttacttgtagttgatgagcacgaggagggctccgtggctgcctgctagtagccctgagttcttaatgggctctggagagcacctccattatctcctcttgaaagttcctagccagcagcgcgttctgcggggcccactgaagcagaaggcttttccctggggaacagctctcggtgttgactgcattgttgcagtctcccaagtctgccctgtttttttaattctttattcttgtgacagcatttttggacgttggaagagctcagaagcccatcttctgcagttaccaa

SEQ ID NO: 1683 - protein, 869 aa, Mus musculus
SCFQSRVFNLPAITLLQATPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMSHLLDFPHSSHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSAWQQLPGVALHNSVQPAAVIPEAMGSSQQLADWRNAHSHGNQYSTIMQQPSLLTNHVTLATAQPLNVGVAHVVRQQQSSSLPSKKNKQSAPVSSKSSLEVLPSQVYSLVGSSPLRTTSSYNSLVPVQDQHQPIIIPDTPSPPVSVITIRSDTDEEEDNKYKPNSSSLKARSNVISYVTVNDSPDSDSSLSSPHPTDTLSALRGNSGTLLEGPGRPAADGIGTRTIIVPPLKTQLGDCTVATQASGLLSSKTKPVASVSGQSSGCCITPTGYRAQRGGASAVQPLNLSQNQQSSSASTSQERSSNPAPRRQQAFVAPLSQAPYAFQHGSPLHSTGHPHLAPAPAHLPSQPHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 1684 - DNA, 53591 bp, Homo sapiens
cagtggggtgggtgtggaagcttttctgtcgtctccgctgatgttctgtagtcgttaggcttgtaattcgtaatgacggtggagactacgtgagaccagcccacctaatgtatatctgtacaagggagatctagaggtctggcccaaagggaaacttttgctgccaccactttcaaagctttcgttaaaaaaacaaaagggagggggaaggtggagaaacaaccaaaattctggtaaggcccacactgttcacaggtctgtggggaagagtcccctttttgtgcttagcaaccaagacgtggagttccgtctccaggagcgttggtctaacctccagtttgttgtggtgacgagctgtgagcaatggcctgtgtttatgctgggcgagctttctttcctacttggggaggggggttcaggatgggaggatgcgggtagggaagagggggggaaaacccccaagctccagtaagtcttttctttacttaatcactgattctgttgtaggtagactcatttagaggcagtcctagatgctctttcttgtctattagtgacactttgggaattctcagtaattgcatcaacataatactttcagctatagactctctgtcccaatctgtcctttatcttgtttcttagtaactggtgaaaacagcagtgtggcttcccgctcttgatgaaatagggttaaattaagtggctgatgccctcagcaaacctacaattttccttttgtttgtgtaaagctatttttgatctctggtctgtgggttttttttttttttttgtaagattatagagaatgcaaactattactagcttttttcatatggaagcctaaagctttctataaaacattttaaaatctaacaaatcatttgacctaattttcattattcagctggtgattttggatctttacatgtaattatctcagggttctgtgttataatactgttatgatgaagggtggcattgactttaagatactgttcctggcttgaaagatattttagtaaagtacttgcggttggaactggaggcagccaagccagtaaagtatcttagaataaaatggtgaatgagatcttataaatatactggctctggttggcaagtagaacttttgctggtgataccttcatgaatagtttatctctcgacactgtagttttgtggttttttgagcaagttcgttggtaacttgagacttcaaaccaaaccagaacttccttctaaaagaaaaaaaaagaagagataatctcaaagttcacaattctttggaaaataaacttctttcattctgtgcttttgtttttataagcacagctccatcaatgatttgttggtacaaatcagtgagtcataccggccttgtaaagttcttacacttggaacttgtgcagcttgttagttatatattgtaactggtcttgtaatttgaagtaattttgcaaacatgagctgcttgatctgccacctgcatgagtgtataacagcagtctgtattttttaggtctttttaaaaaaaatttactattattcctcccgttatcttcccttcctctccctttgtgccattctgaacacaagtcatcaagattattttcctttaagtaccacttcaacaatcactggtttgtcttttggttccttttgtttttgttcctgatcttccctttagttgttggaacccagctcctaaatgcctaatatattcctgtagtgcataatttggcacttgaaaaatttacatcctgttttcatatttttctttctttttcatgtgttatatcatttcagcaacattttaagttttttgaaggtaaggaaacttacatttcttttagattctttaagggtacctggtacagtgctttcccagagtgcttaaggaaaaagaatgagaagacctttgccagcattgctactcattagcgctgggtaaaactcgtttggcctttttggatctgtttttttttttttttttttttatttgagacaagatctcgccctgtcgcccaggtcggagtgccgtggtgggttcaggctggagtgcagtggtgggttcaagtgattctcatacctctgcctcctaagtagctaggactacaggcactacaggcacgcaccaccatgcctggctaatatttgtatttttagtagagatagggttttgccatgttggccaggctggtctcagactcctgacctcaagtgatccacctgcctcggcctcccaaagtgctgagattacaggcgtgagccaccatgcctggcctggatcgcctttttctcatctcggaattagggggttttagaatctttaaggtcccttttatctgtaagagttccagtacttttttgctagtgtcttctgctccagttaaatatatctccttactctacacggttttttatttttccacatcctttggcatactagcatagcaaaagtcatctcattcttctgaaagagcctcctccatcttccattctccaaactgctgttgccttacttaagtcccgttttccttcagcctttgctggcatattgtttatgtttcatattgatctctgctttgttaattttaactttttcttatcctggaaactcctcaaggtatagttttcttaattctaagctttatagacctatagactgttatgtgcaggtactaaaatgtagtacctttttactaaacacaaagcacttacttttcttttgttctgttgccgtagtcattccaaataaatctaagtgaactattgattttgatacaaagcaacagcctctgccacactgaagaagtgagctttaagcagagactagaagggtaagtaaaagttaggaaaagaaaagcctaagggggaaaatgaagttcagagaggaaacatgttgaaggaactagggccagagaaggcaaggtctattgtgggaacccagagagacttggtagtattggaagagaaagtgcctggggaaaagcgcagatgaaacaaggctgtgcaagtaatcgtggtccagatcttgcaaggcctggtaatccaaattaggaattttggtgtttgtcctaaggttttaagtgggggataggtacactttttttttttcagatgtgcatttttaaaagcttcagttgagaggtgaataatgaattgggagaggggagcttagaaaaggggcttgaggccagcatcgtggctcacacctgtaatcccagcacttttggaggctgaggtaggtggatcactttaggagtctgagaccagcctgagcaacatggtgaaaccctgtctctacaaaaaatacaaaaaaattagctgggcgtggtggcatgtactggtagtcccagttactcgggaggctgaggtaggagggtggattgagccctggaggtccaggctgcagtgaacgaaccatgatcgtgtactgcactccggtctgggtgacagagtctcaaataaaggggggaagttgagagtacaatttggaggaaaccagttaagctgtttaagtatgggattgtgcagtaggggtggagaaaacttaggagagtagagagagatttaggtgttctgttgggaagaattttcttcccaaacttgtctcactttgtttttacagaagatgtactcttatcatctgtaaaaaatatgtatcagagtatgtgatagacaatatgtatacctgtgttcatgtcatctgaggataagtgctggagcaagaaatcaatatatagtacagtttttaggtcatttggctaaccagctgttaaattgtatgaaagaggcaaagataacattgagcaaaagcaacaggaatttattactggtgtgtcaggaaaaaggttactgaggggtaaggacaaatcaatggaaaatgattacctgggttgtcttatccaactgttccattcagggttataatatttggatccttttaataagattatttgcctatagtgcttatagtgtggagcacccagtaaataatgttaaatggatgtgaccatgccagggagtgggaaagttgttaatctgtttttgaaagccttggattctagctattatcttttagcaataagtacaagtaccaatgatcttttgcccatcattgctactttggtattaatgaactgggcaaatttgtcattatattgagatggttaagtccttggaaagtcagatttgaaatgtaaagacttcatttattgctggagtcaagaggcgcagcattttcaggaagtcaaaaataactttttatgccaggtacggtggctcatgcctgtaatctcaatatcgtgggaggccaaggcaggaggaggattgctttagagcaggagtttgacaccagcctgggtgacatagtaagacctcatctctgaaaaaaaaaaaaaaaaaaaaaaaaaatttagccaactgtggcatgtgcctgtagaaattagccaagcgtcctggtgtgtgcctgtagtcctagctacttggatggctgaagcagaggattgcttgagcccaggatttcgaggatacagtgagctgtgatcacaccactgcatttcagcctcactgacagtggtgagaacctgtctcaaaaaaaaaaaaaaaaaaagaatcagctgttttttttttttaaacctttattttaggttcaggggtacatgtgctggtttgttatataggtaatctatatgtcacaggggtttggtgtacagatattttgtcgtccaggtaataagcatagtgcctgacatttattttttctgatcctctcccttctcccaccctccaccctgaagtaggccccagtgtctgtggttggcctctttgtgtccatgtgttctcgttctttagctcccacttttaagtgagaacatgcagtacttggttttctgttctgtgtttgtttaggatagtggccctccagcttcatccatgttgcctgttgctgcaaaggacatggtcttgttcttttttatggctgcatagtattccatggtgtatatgtatcacattttctttagtctaccattgatgggcatttaggttgaatttcatgtctttcctattgtgaatagtgctgcagtgaacatatgcttgtgtctttgtggtagaatgatttatattcctttgggtatttacccagtgatgggattgctggatctaatggtaattctgttttaaattctttgaggaattgccacattgcttttcacaatgggtgaactaatttatactcccatcagcagtataagtgttcccttttcttcacaaccttgccagcatctgttattttttgacttcttaataatattcattctgactggtgtgagatggtatctcattttagttttgatttgcatttctctaatgattagtgatgttgagcaatttttcatatgcttgttgactgcaagtgtgtcaaaaatagctttttaatttattgagttgctattcacattgaattgaaaatatctgtaatttgcctcacagattctgatatatagtaagttttccacagatgttaattctgtttttgttgttgttgttgtttgaaagctctccacctaggaagagaattgcctccccacttgcaaaggcaagtttaatagaacataatatctttatcctgtgtctagaaattgctgttttagctgagtttcagagtagaatataaataagagtctgttggtttttctaggccattgtgattctgtattttcttctcaccttgtgttaattgaggtcagaatgagtctcagccacactgtaagaaccccggtggtctgatactgactttttgtacatcacacccttgctgtggggaagaccagtgaaagaattctgagttgtcctttccccttgggtgaactaaatttgtctttatggataagaactataatcatttaatattaaaacattctgaaaaatatcctagaacttgtacttttttcagtgcccagtgtgaagatctgaaatcataagtaatcttttattatgttttttgggtaaaaagttggcaataatgttactctgccaaatgcaaaattttatagagtatctagttacgaatcctttttttttttgagatggagtctcactctgtcgcccaggctggaatgcaatggcatgatctcagctcactacaacctctgcctcccggattcaagtgattctcctgcctcagcctcctgagtagctgggattacaagtgcgtgtcaccacgcccagctaatttttgtatctttagtagagatggcgttttaccatgttggtcaggttggtctcgaactcctgacctcatgatctgcctgccttggcctcccaaaatgaatacatttttaaaaatttggtatttcatgaattcttttcagtattactttatgacccccctattcctagacagttgctgcaaactgcaaattttctatttagattctttcactaaatacttcaagttacataaaagttgtgtttatgttttttgatagattgttaaaattaggtgaacaatattaacattgttaatggaaaacaaatttagaaaatttgcttccttttgttgttcaacaggttggcttaattttatgataaatacttacacatatattttaataggtgcattttgtaaaggaggtacttggtttcagatttttcttttattatatttggtatttcagtgaagtaggtagaacaagatgatttgtaaattcagcctcacagttaaattgtactgaccttagcttttaatttgtacttttttttctcttcaaagtttatataaattatggaaactcttaaagtaaatctcaactgagttttagaaattgaaggcagaggatttgttctttccagctgactagtccagtgcaggtggtttctagttgtattcaggcacaaagaaatgtacttactgccttttgatgttctgtaacatcctttgtcatgtttccttcctttcttgttgtgtttattcttttatgattagtaatgttatactgtatggattggagtagagacttcccccatgactcaaggaccacacagataaaaaggagggaagacattaaaaaaaaaaaatcaaggatcgagcatttgaaaatactacagttgaatgtgagtggtagggagttgtatttaatagatatgagattggtaggcaggggtcaaataattcatccaacagataattgagtatgtatatattgtcagtctgtataaggctttggtgatagaagagcaagacagagatggtacatgtgccggagcttatactgtagctgggaatgtagcattaaataaatactttcaagttaacaggttgctgtgggaatgcatggtgggggcagggggtgatcgtagggagcgtttctgcatgtgacagaggtgtcagggcagttttcgcagcagaaagtcttcaacatatttagagggcctggaggtgagtggccttccaagaactaaagaaagaaaggcagtgtggctagagtgggggttaggggaggaatcaaagtggggagatgttggaaggcagcaagcagattttggagtgcattttaaggcaggttgagacaggttttttttttgagataggatctagctctgttgcccaggctagagtgcaatggagtaatcacaactcactgtagcctcaatgtcccagactcagatgattttcctgcttcagcctcctgagtagctgggaccacaggcatgtgccacttacacttggctttttttttttttttttcccggtagagatggagtctccccatgttgctctggctggtcttgaactcgtggactcaagtgatccttccaccttgggttcctaaagtgccaggattacaggcgtgagccaccacatctggcctaatttttcttttcttttcttttttttttttgttaatgcttcccaggctgatcttgaactcctgagctcaagtgatcctcctgcctgggcctcccaaagtgcgggaattacaggcttgagcgaccatggccagccaagttgagaatcttggacattatctccaaagcaatgagaaaccccgggagaaggggaagcaagatggttaagaagagagagcagttatctgatttgcattgtttaaaagcaaagatctactgagtggatttaaggagattagtttggaagctactggcagtttgaactagaatggtgccaataagggtagggaaaaagggctgatttgaaatatacttaggaggccaggggcagtggctcacgcctgtaatcccagcactttgggagggtgaggggggtggatcacttgagctcaggagtttgagaccacccaggcaacatggtgaaaacccatctctactaaaaatacaaagaaattaactgggtgtggtcgtgcacgcctctactctcagctacttgggaggctgaggcaggagaattgcttgagccccagaggtgaaggttgcagcgagccaagattgcaccattgcactccagcttgggctacagagtgagactctgtctcaaaaaaaaaaaaaaaaaatatacacacacacacacacacacacacacacacacacacacacacttaggagatggaatggataagatagagattagatgtggaggaataagggagaggaatgagccaggataatagtattaaatatgtggtagacactatcattttacatgtattaaattatttaattctcagaacaaccccatgaggtaggtattgctatcaccattatgtagctgaggaaacagacatccctaattttttttcttttttttgagacagggtgtcattctttcaccctggctggagtgcagtggcacgatcacagctcactgcagcctctacctctgggctcaggtgatcacttctgccttctgagtagctaggactacaggcatgtgccaccatgcctggctaacttttttttctgtttttttttttttttgttgttgttgttgtttgtttgttttagagacggtttcaccatgttgcccaggctggagctccctgatttctggcttgaggcgttggatgtgtgatggcatctcataattaagatagaaaactgaaggtggggtggaggctcgtaagtttaattctgaatgtattgaatatgaggtgtttgtgaaatgtccaagttgcagggttaagtagtcatttggatatagggtttggagttcaaagcgagagaatcctgggttagagatagagattttagtcttttgaagatgactaattttgaggagtaattattaaaaaggggcaaagggtagagcaaggaaagagggattactatagagccccaaggcatatgagatcggatggttgaaaatggagaagataaatatgaaatggcttgtgtgctatgtcagatgtttggactttattctgaaaaaatagctttcagtttaatctgtgggcttattgagctggaagtgtctgtgggatattcagggacagaaagctggactgttcttacatcctttcctcatatttttctgctaactttcctcggttcttcagaatatactctagctttctcatcatcctggttacttttttttttttttttttcaattttagtatttttagagacagggtctcactacattgcctaggctggtctcgaactcctcagctcaggagatcttcctgccttggcctcccaaagtgctggaattaaaggcttgagccactgtgcctggcccatactggttacttttttatcttaaaatgtggtagacaattgaatgcattttatgtatgacctgagcagagtggataatcttcactttgtccagcacgttctgtacactgtttctatgaatataggtcaagattgaattagtttttgagaagaggagaacattattacatcatgtttcttttatcaagtaaaagtgtgtgtgtgtgtttgtgtgttttaaatctaagccttgtatcttttatccttgtggtctaattcttcctttctctcaatataggtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacaggcaagtggcaaatgctgaaaatcgtatcttaggctagagttctgtccttatatttaacatataccccgtaggctacatatagcaatgaatttgtttatagattctgagatagaaataggatatgttttagctcattctatgtgtgtggcattcctatatatgacatttatttctgaaattttatctagcactggaaaaattaactcagtctgattctgaaagttgttactagttgaattatactagcacctggttctttagtattattttacctcattttcccattttatttattttatttatttatttatttatttagagacagaatctcgctctgtcgcccaggctggagtgcagtggcgtgatatcagctcactgcaagccccacctcctgggttcacgccattctcctgcctcagcctcctgagtagctgggaccacaggcacccgccatcacgcccggctaattttttttgtatttttagtagagacggggtttcaccgtgttagccaggatggtctcgatatcctgacctcgtgatccacccgtctcggcctcccaaagcgctgggattacaggcgtgagccaccgtgcccagcctatttatttatttttttaagatggagtttcacttgccacccaggctagagtgcagtggtgtgacattgactcacggcagcctccacctcctggggtcaagtgatttctcctgctactcctgtcctgagtagctgggactacaggcacctgctaccacgcccggctaatttttttgtttttaatagagatggggtttcaccatgttgaccgggctggttttgaactcctgacctcaggtgatccacccgcctcagcctcccaaagtgattagaggcgtgagccaccatgcccagccattttcccattttgaagagtcttgaaatacacaaagatatttacttatttgtaatgaatctgagcatatgttgctgttttttcgaacctcttatcttggcaggtaaaataacgtgggaataactctaggtttaactctagtaacattttattcttttacattttcttctgtagtagcatgaattgaattacatggttgctacaatctcttcctgttttaactttctctaaatactttgaacttaatgggttatcctagaatggccttgacccaagtaccttatactttaatgatatatatttctagattgatacttttaatgtagctaccattttaatatataataattattgggacagtatgtaaatgctgatatatacaattttgtctgtaccataaccaaggcttttaaaatgtgctttttatcagcacccatttacttacttgcctagttattaattttaaggaatctaatatttagttttaatggccatacattaaatacaaatcatgtaagcatccaatcaagaagtgaaataataaaaacatagataacctataaaatatgtttataaggagctatacatgccagatgcctgtaataaaatttgaggaaatagaaattctgaattaagaattttatattatgtgtgaaaataatgtgaggatattttaacccatacaaggactcagaaaaaatgtcatctgcatgtttccttttttaaaaacattgtggtaagatgtttataataggaaatttacaattttaaccatttggtaccactcattgtgttaagtacattcatagtgttgtgtaaccatcactgctgtctgttaagtatattcacaatgttgtgtaaccatcaccactatttccaaatgttttcatcacccaaaacagaaattctaaccattaagcaataactccctattctctcttcttcctaccactggtaatcttgatttgactttctgtctctatgaatttgcctattctagatactgcatgtaagtggaatcatacaatatttgtctttttgtgtctagtttatttcacttagtgtaatgcttttgaggctaatccatgctgtaacatgtatcagaacttcattccttttatggctgtataatattccattgtttgtatataccacattttgtttatgcattcatctgttggtagatatttgggttgttgctacctttaggctgttgtgaataatgctgctatgaacattggtgtacaagtatcctagtccctattttcagttcttttggggatatagctaggagtggaattgctgggtcacatgataattctatgtttaactttttgcagaattaccaaattattttccacagaggctgcactattttacattcctaccagcagtggatgtgcattccaaatttctccacattttctctaacatttgttattttttttatttaaaaatattgtttgtttatttttacagagacaggggctgcctctattgctcatgctggagtacagtggcacgatcatagttcactgtagcctccaactcctggacttgagcagtcctcccacttcagcctcccaagtagctaggactgcagtcacactccaccatacctggctaattactattattttattttttgtggcgacagtgttttgagggtctcattttgttgcccaatctggtctcaaactactggcctcaagccatcctcctgcctcagtctcccaaagttctgggattacaggtgtgaactaccactcctggccttgttttgttttttaaataatagccatgggtttttttttttttttttttttttttttttttggaaatggagtttcactcttgttgcctaggctggagtgcagtggtgcgatctcggctcactgcagcctctgcctcccaggattttcctgcctaaacctcccaagtagctgggattacaggggcctgccaccacacccagttaatttttgtttttttaaaaaaaatggggttttaccatgttggccagggggggctccaactcctgacctcaggggatctgcccaccttggcctcccaaagtgctgggattacaggcatgagccactatgcctggccaataatagtttttttttgttttttttttgttttttttttgagatggagtcttgctctgttgccaggctggagtgcagtggcacaatctcggttcactgcaacctccacctcacaggttcaagcagttctcctagcttggcctcctgagtagctgggaatacaggtgccaccatgcccagctaatttttgtatttttagtagagacagggtttcaccatgttggccgggatggtctcgatctcttgacctcgtgatgaagtgctgggattacaggcatgagccaccgggcccggtcaataatagccattcttatgggtgtgaagtggtatctcattgtggttttgatttgtatttccctaatgattaatgatgttgagcatttgttttattttgttttgttttgagacagagtcccactttgtcacccaggctggggtgcagttgtgcaatcatggcttactgcagccatgacctctcaggctcaagcagtcctcccaccttagcctttcgggtacctgagactacgggcatgcacccccacacctgactagtgttttgtatttttagtagagacggggtttcactgtgttgcccaggctggtctcaaactcataggctcaagtgatatgcccgcctcggcaacccaaagtgctgggattacagacatgagccaccatgcccagcctggcatttttttatgtgcccgacatctgtatatcttctttggagaaatgtctatttaagtcctttcctcatttcttgaattgggctttttgttgttgagttgtatactctatatacttaattttcatctattccttgggttgcctttttacctgttgatagtgtttgacacagaaaagtttttaactttggtgaagtgcagtttgtctactttttctttggttgcttgtgcttttggtgacatatccaagaagtcactgttaagtcgaaatcatacagattttcccctatgttttctgctaagagttttatagttttagctcttatattttggtctttgattctttgttgatttttgtctatggtccaaggtacaaatccagtgtaattctttggcatgtgactattcagttcttcaaacaccatttgctaagaagattgtcctttctgcattgggtggtttgggcacccttgttggaatcatttgaacatatatacaaataattcttatcttctattgctttcccattttcaatgttgggctctctattccattaatctatatatgtctttatgccagtaccacattgttttgattattgtagctttgtagtaagtttgaaatcaggaagtgtgagacctccaactttgttctttttcaagattgttttggctatttggggtctttgagggtccatataaattttaggatgggtttttctattttatacaaaaaccataattgctttttattaaggatagcgatgaatctgtagatgactttgggtagtattgacagcttaatagtaagtcagtccatccttatttctttatatcttttcacagttttataaaactggtattttttacttgaggtaaggtaaataaactcttagagcctttgttttctggttttatgctgccctaggcaaccttggctaactttaagaatgtcatctccatttatttatttatgccttgggagatttaggttccaactacatttgctttttaatgctctcctttgagcagtctcaccaccagccacaccaacataacatatatataacatactctacaggtgcactgaagaattcagcgcagcatcccattttgagtcctcaggagggactaggcagaccacagctgaaggaagagggctgatcagctcttcctttctgtcttgactctgtgcctgcaggtgttctttaactatttgtttgccctgtcaaagacaaagtgcattctcttgtgataacagagtagtttttaaattgaaaaagggagagcaataggagataaaaattatttggctttgttataattggggcatgttaatacaaaataaaatgaattatttggctgcttagctttctgtaatgtgtaattcatttgaataattttcagtgttaggttgctgatctttgtattttttatccttttaatttaagctgtcaattgattcattttggttttgttttttatagaaactaaggttttcaaatcttcaaagttacccttcgacaaagctttctttaaattcactgcaatatagttgttgactataattttaagtggagctaagtttgcctcttaaaaacaggagttcattctgtgtattactgagtaattactctgtatactgaagttcagtgcccagggcttgacagtgtttaggatttaacatgagtgttctgttgtgtcacagtaatacttgataatgagcctaaggcagatggaacagcagctcaggcattccttctttatcactagttttacccgcagtggtcctcttaagcttctttgatgttgctttgttgccatattagagtccattaagtcctcacccttctgtctttcaaaaaacctctgtgaaatctgtttggctggtgaagcattttgactccaaagctagtccttctcttacccacctttttagtttaccttgctttgtctttctgataatatgccagtattatcagctcacataaatttgccaacttgctgtgtccattggccctgggcatggctaaatgattcaggcagtggaaataatatactttactctctggctcactgtaaatgtgcacagactccaagcaaagctcctgtctttcgggcttgagttttagagacaaaggtttgccatgcttacaggctgaatgtttttccctactgaacaaactagccagcctttatttcaagctgaatcactttgttacttacggaaggaaaaggtctagagaaggaaaacgtatcttccatttatcctagacaaacaaataatctaatttcctctggcagtcaaaatatagtttcacctaagccactgatgcaggaagttaggttttatgtaacctctctaattggtaagtaagtaggtttgatgtctctgagataggaagaaagaaacgaaaatgttcatgaaaataatcagagtgatttgtgttaagtgatcctaaccttagcttgctctgggtgccagtgaaattaacctcaacaatgttggttggaagaatttttcaacttaaagaagtttgaagttggggaatcaaaaggcagggattgttgtttctatcacttagctgtaataaccagagcctgtttagtatttgttttttaaggatgggatgtgtcttcaaagaggagacttgccatgttcaaagcacaattaatgccattttcctactgaagtgaacactgccagtttttaacagtttctttcactttcctgtgcttctgtagataaccttttttactgcccagttgttggaatgttacagctggaaagggacctagaagagtaattatctaactctgtttccttattacacaaatgaggtagaaccagagttttacgtgtctgtagagtttatattgagggattaagaaataaggaggccaagaggaaagatgtaatgaaaataattctaataattataatctggattcacagtttaaagtattcagtccttagagataaacctgctctagtgatgccttactgttcagtaaagtagaaaataacttgtctttttgcttcgtagagtttgggtaagtctaacatttataggcccaaataatacaaaacccctccagtgaactaagcagccttactgcttttttgtttgtttttgagacagggtctcaggctggagtgcagtggcgcaatcatggctcactgcagccttgacctcctgggctcaagtgatccttccacctcagcttcctgagtagctagaactgcaggcatgcaccaccatacctggctaattttttaaatttttttggtagagattgggtcttgctgtgttgcctaggctggtctcaaactcctgctcaagtgatcctcctgccttggcttcccaaagtgctgggattataggtgtgaaccgccgtttctggccgtattttttttttttttaaactgctttcctttttttgtttttccttttgctatttgcctttttataaggtagatacggtagagttgctgttttgactgagcttttgctggaagtccttagctgcttttgtcactccaaaagcagggtgagaccaaatgaaaaaactttcagctaatcttcagtttttttttttaattaaatgggacttgggggctgtggaagtgatattttccttaatttcccagaaaactttaagctcgagacagttatcatatattattgctaccttttttatttttttctgagacggagtttcgctcttacgcccagtctggagtgaattgacgtaatcttggctcactgcaacctctgccccccgggttcaagcgattctcctgcctcagcctctggagtagttgggattacaggcgcctgccaccatgcccagctaatttttgtatttttagtagagactgggtttcatcatgttggccaggctggacttgaactcctgacctcaggccatccacgtgccttggccacccacagtgctaggattataggcgtgagccaccgcgcctggcctgttatcgctaccttttaaagaagaaagttatagagtggcctggccattctctgtgacctaccttttggactttaaaatgtctttctagtatggtaggaatagcaaaatcaatatgctgccctccaattgatgctttggaatgttctaaacccagtttttattttggctcattgccagttgtgctccccctgccagctatttttggcattgtcatgaacttggaaattaatgattctgctcactaggagtagaaaattttgttccttttcaattttagaaaagcttttatgttgtttctgggtagtcttactagcttattaatgcgcctgtcaaacttgtgcagtgttgaaaacatgccattatggttgagatttcactgaactctgaaattccatcagtaatatgtgcctctagccacctgcaacaggaatatcacttttgagggttacttcttttcttttcttttttttttttttttgagacagagtcttactctgtcacccaggctggagtgcagtggcactgtgtcagctcactgcaacctccgtctcctgggttcaagcaattctcctgcctcagcctcctgagtagctgggattacaggtgcccgccaccacacctggctgattttttatatttttagtagagatggggtttcaccatgttggccaggctggtctcaaactcctgacttcaggtgatccagcctcctcggcctcccaaagtgcttgtattacaggcatgagccaccgcacccggccagttatttctttggtaaacaaaaccacagttcaaattaaatactacaaaaactgatgatattggtggttccacccatagctgttaaaaagtgtaagcccgaagaggcctgggtcgactgctatttgtatttaaggatcagaaaagctttcaggccctgtggagtccccagatttactgttttctaagggccactatttatgtataaatactaggggaggattttttttttcttctatgcctagtttgcttagatggggagggatattcttatttagggaaattatattctccttgcttaatccttgccttccctcaaccccctgcacatatacacaaaacaacaataagcacatatcacttgaaagtagtttgagaaacctgggtattctgtgaggagacacggccagttagatggttcttcacggaaagatctgttttccatttaactcctgtaacatgaggaatctgaatctggatctggatctggatctggagtgtccttatagattataattccatgacttgtaagaaagaaaggaaattatttggagaagatgatccagtgcctaagagctgaaatcttggatccaaatagcttgggtaccatcctttttcttttgttgagatggagtctcgctctgtcgcccaggctggagtgcagtggcagatctcaactcattgcaacttatgcctcccaagtttaagtaattctcttgcctcagcctctgagtagttgggattacagctgcccgccaccatgcccagctaatttttgtatttttagtagagatggagtttcaccgtgttgaccaggctgttctcgaactcgtgacctcaagcaatccactcaccttggcttcccaaagtgctgggattacaggtgtgagccactgcgctggccaagggcaccatcttttagtagttatgtagccttgggcaagttactttaacctcttagtgccagtttcttcatctgtaaaatggaggtaatacttttattgcatagaatctaacatgccattgattataagatacattatttttgtaccacttaaaaaaggaaaagcgctgccattaaactaaaatataccatcatttgtaagaatcttcttaatttcagaggtgctaacatgtaaaaagatgtgtatcttagaattgatgacatcataataatactttgataggattgttgtaaggattaagtgactcaacatttataaagaacttagaacagtgcatggcacatagtaggcaatatttatgtgtcatttattattattgctattagtgttacctattattttctttttgaacccacttattgcctaattagtcatagtttgacaattgcccttgtattccaccatgtcaaatataaatttacatagatgagtatgtacttttacttattgagaaacagtgtaatatataatatactcaattctggagccagattgcagggattcaaatcctagctctgccacttatttgactgtgactctaggccaataacttaatctttctttttctcagtttcttcttctgtaatggggataataattctattttagatgtgttcgtatatataaacgtctgagttatggattaccttagtcatctctttaaagttccctagcattttatttctcacttggactgttaatgaatatttctaaaaagcacactaagagttcaaagttttaaaataatggtaacataatactgttattatatctaacacctactagtatttaccatgtgccatgcactggtctaaaagctttcatatatttatttaagcttcacaacaactctatgtggtgggaactcttactgtctccattttatagatgaggaacctgaggcacagagagatcaagtaatatacctgcagctattaaatgatggaactaggattcagaccctgacaggctggctctagagagtgtgctgtcaacaccatgtctcttcagaaggcatttctttttcttttttttttttccagaaggcatttctgtcatgaagggttatttattgaccagggctttttttttttttttttggactgtcttgggtctcctaggctggagtgtagtggtgtgatcttggcttactgcaacctctacctcctgggttcaagcgattcttttgtctcaacctcctgagtagctgggattacaggcgcccaccaccacacctgactcatttttgtatttttagtagatttggggtttcaccatattggccaagctggtcttgaacttctgacctcaggtgatccacccgcttcggcttcccaaagtgctgggattacaggcatgagccactgtgcccagttgaccaggccttttaattgattttttttttttatgattgaaatggtgctaggaataataataaaaaaaatctattatcccttatctgtgattgcaaaattcagaaagctctcataaatgaaaatttttctttaagtttggtataaattcatttaattggcaagacctgacttgaaccattgttaagctatttgaagtctttatttagccaacttagtatgactgttccatgttttgttgcagaaatattaatgtgtttgattatagtgcactgccctgaactccactgggattattatataatgtgtactttgtgttctgcattacctttctgaaattcaaaatattctgaattccaaaacacatctggccctgagcttcagatgatggattgtataccaaagattttttttccatttcattgaataaatgttcctttagctaatactaaaacaggacttagtcatgtagttaattttcccaaataatgtttttttttttttaatctgatattttttgtttttgctagagctcctgaaattattcttgggttaccattttgtgaagctattgatatgtggtcactgggctgtgtgatagctgagctgttcctgggatggcctctttatcctggtgcttcagaatatgatcaggtaaaagtgtttatttgaatggaaatagaatgcaaatagttacttgtgaattagattctggagaaagagaagtactaagtactactgaagtatttagataatagggaaagagtagtccaattgctactaaagaactttttaaagaatagtataattttctcttcctgcttcttaggctaaagtatgtttgcaattctataataaaaaaaagaattttattttatattaaggttgatactttgctagatctgtaatgatttattagagacttaactttcattaacttatgtgctttgtgagttaggaaagtagagtaaagatgaggaactggaattttaaaagagaacttctacttactcggagctattataatttacttttacgcatgacacactgaagtactttcttcagactgaaacacttcaggtcccagaagctgtgacatactgggtcgctaagataggatttagaaaggaaatcatctgagttgtagtaatatatgatctgtatctaaaaatagacaaactttaggagatatggtataatttcctaaggaattggtccgttaagggaaaatgttttactatggaagtaaattgtgaattctcatttcttgttattttttcttttttctttttatttgtttgagatggagtcttgctctgtcacccaggctggagtgcagtggcgcgatctcggctcactgcaacctctgcctccctggttcaagcgattctcctgcctcagcctcctgagtagctgggattacaggtgcctgccaccatgaccaactaatttttgtattttttagtagagacggggtttcaccatgttggccaggctggtttcgaactcctgacttcaggtgatccacctgcctcagcctcccaaagtgttgggattacaggtgtgagtcaccgtgcctggccttcttcttattttttaaaaatgttcctgccctttatgatgtaagctccttgagggtagagattgtttcacatcaccagtgtatcctcagctcctaacactgtgtctggtacacagtaagtacaccagtttttttgttgtggtttttaagtttttatttttttagagacagagtcttgctcagtcacccaggctggcatgtaggcctgtcacagcttactgtaacctctagctcctgggcttaagtgatcctcccacctcagcctcccaggtagatgggactataggtgcatgccaccttgcctagctaattcttttattttttgtagagtcggggatcttgctatatcagcctagggtggtctcaaactcccaggctcaagctatcctcctaccttggcctcccaaagtactgggattacaggtgtgagccaccatgcctggcctatattgtcaaatatctttacttgtccgtaaatacacttctaccttgtcatttacaatgtctgcatggtattttggtttccagctacaggatttagaaaggaagttatctgagttgtagtagattccacagatttgaagtattagaagtcaacaggaaaagcaaaaaagattatagccaaaattttcaaaactggatttccttgtaaataatagatacagtagctgtggatggattagtatatataggtatttacagataaatttcagttgtattgattaaagatttgatttcttcctttgcctaaagttaatgatgttttagtgtaaaagcctttaataatttcccttttcactccaaatagttgtttgatggttttgatgtttcagattcgttatatttcacaaacacaaggcttgccagctgaatatcttctcagtgccggaacaaaaacaaccaggtttttcaacagagatcctaatttggggtacccactgtggaggcttaaggtctgtcttccctactatgcttccgactcctgtactccacccctcactccccaattttgaattcaaagtttagttattaaattcttcaggtagagaagggaaaggagagggggaagcattttgaaaaattatttctttgtacctgtttggccttatcctcagttgaaaaacaaaacattaattgctagttcagttggctgaggttattttgtatatgttcaatccacagctgatagaaagtttggagggtagtgctcaccattaagcgatagaactagagacatatagtaatgactgatttttagagaattctcaatgaacatgataaaatcacaaattttctaactgcccacattcaggacttctatattttttcttgaaacaaatacctgctttttacttctgagcctactctgtcaggttcagaaatatctgagtaatttgactaaccctgtgactgtgtgtctgagtctgttgaacagttagcatttgagatatcgatttatttgaaagtagctttaagagaacaatggtagtgtccccttttacctgacattctttaggaactgtgctgtatcattacttgcatgtttatcactgttgaaagggtagctagatatcaaggtcacatctctccactggaagattttctggttgtgaattactttcatgtttgccatctatggttggcaaggtgaccacacttgtctcttgtattctggctttggttttgaataaaatgtgaaaataacatacagatggaatttaaggaggaaaatctttattttatagacacctgaagaacatgaactggagactggaataaaatcaaaagaagctcggaagtacatttttaattgcttagatgacatggctcaggtgagtacggaaagtttcagaaagtcagacatttatttttaatcagagacacttctgttgattatactaaagacaaatttaatgttatctttctagtatttgttttcagtttttataaaaaatgcattaatattccaccatgtagtaaaggaacatttaaatcctaaccaagtatatttttagaattacatatttctctcttgctttacttgtcttgttacatagcagtgttttaaaatattacttatgaaagtttcttgtcccattttctctattaaatacttaagaattatatttattgagcgcctattatgttacgaactctgaacacttcacacttatgtcatttaattttttcaacagtagaagcttttatatttaggtagtaacaatcactattgcttagctacttgttccatttttttttttttttttttttttttgagacagagtctcactctattgcccaggctggagtgcagtggcgtaatctcagctcactgcaacctctgcctcccgggttcaagcgattctcctgcctcagcctcccaagtagctgggattacaggcacgtgccaccatgcccggctaatttttgtattttttttagtagagacggggttttgccatgttggccaggctgggtctcaaactcctgacctcaggtgatccacctgccttggcttcccaaaatgctgggattacaggcatgagccaccgcgcccagcccccaaatttttaatgacaagaaattgtttagctttcttctaccactcaatttagatgaagattttaattaaacagcataaaaagagcttcctcctctgaaaatgattagattttcataaaaagaatttccccaggtttctcttttgattacatatatacacacacacatagtttggagggaaagcagctatgtagtgtcagtgccaaaggttaagtgaagaagtataattctgaattttctttggaaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcagtgagtatggaatattctggggcttttgccatgtggttctttgttgagttaccgccttatcaatggcactatcaaatgagcccgccactttggtgcttataaatctggctcagcagtgcttttctttctcattgaaacatcataagataaaaattagatgtgtatttttcttccctatgattatacaaattcttgatttattttatctgaaagtgattgggaaaaaaagctttgatccatgttcatcttgagttatttgctgtctgtttaaatctcagcattcatttaatgaatctttaatctccttttcagtgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggtattcaataaataattttggaaactcaagcttaagtgggatagaaactagtaagaatacagggcaaggtaaagaaccaatttttgttttggtggtcttgttgcttcttagaaattctccacttgacaaaagttgatggaaaacagggtagactgataatacttaccaggcacaggctaactaaagttaaatataaaggcctaatccatgccctcatatgttcagcatcgtcaaataaatggggtctgactattatgctacttactgctgttagttttactgactttagccaaatgactttctccctgttaggagaaggattttatatctcttgttactgtattgaaaggtttccagtcattaactttaagggtggttttgcatttgtttgctagccagtgatatttgcatttaggtttatttctgaagatgtaagcttcccagtttcttggctgggtctacttttttaatggaagagcctatgagatttggtgggatcttccatccagtaattttttgtgcagaagtagttggggtttgtgtagccacagccaacataggaccattcgtttttttttttttatttgcttatttgaccatataatatgccttcaatttagggactagggaagtttcttaagcagagagttatttcagaggcagttaacattacattttaaaacattattctacgtttttctggataaattctgtatatataaaattattgtgtgtctctacttaatacaagtgtacaaatataatccttttgtttttaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaagtaagtggggaaactcctgtatcatatggtattgtatcagacctacctgctttaggcagctctagttgtttagttctgatctttacaagtttaaactctgtctctgatgaagaaggtaactaaaattgggtaatatcacaaaatggattttctctttttacataggctatttatctaattatgatgctatctgatgcattgtaagagctcactttatgtttccttaattgaattgcctgataccagttttcttgcccattgagtccttgtgtcaatgtcgtacgtcttgtataagcatgtatctgtcaatatgcaaaatctatacaacttgaaaaaatttgttgtaagcagaattgctaaatattggatcttattgcctatatcattctattataaaaattatgttcccaataaaaagtgattttattctaaaatgtaaaaatcatgtttaagaatgtggaaacatcttaaattacttaaggaaagaaaaatcattatttattgaactaaaaaatcctacaggctgaggtgcttgtgtggggcaggcattaagattatcttcttcagcttatgaatcatatagttcctgcaaactcctgtcaacagaggaacagaatagctgaaggaggaggcggagtccctgtgttgcaataagattttaattttcacattcccatccttcttaattttcacattgttgttctgtaatctagtctgtccagtttcttttttctgtatatgggaaatgtgtgtttaatcatttggtaagccatttagaagaatgttactttaaggctaaaatctaatgacacatttgactttcccaagagaaggtcagtgtcagtaccctgtgagaataaaccaggattcaggtatttcatataacactttacatagaagcaggtagcatttttgcctttttacatcaattacttattgaccgtgactctcttgtttgtttggtttctgatagagtcggagcaagcagaaggaaaagaggggctaggggggtcagagagattaccaggaggacaggagagcaatagcgatataagccagggagaaaccacagggagagcagagggacagattcaaaatccgtaaatgcacgtttagcctaacttaccaaattattttctgcatatgcttcataatagtaaattctgtagttgggattgtcgtatgttgagtgattcttccacagagcttagcagattagccacttttttcaccactttttccgaagagtttcattggaacagttttcagatgtgggaccctgaagttttctgctgcttctcagatgatacaagatgaagcagaagaacttttgagttcctttaacaaaacaaaatgtaaactaatgaagttagaggggaaaagtgggataaccctttttagtataattaggtaagctttgaaatttttcctatctaggaagtataaataacctgaggagttattagagcatacttaaaattttccaaatgaaaaaggagttttaaaattaaggtgatgatgatgatgcctgatatgtattactatatgccagataatgttccaagtgcttttacatgtattaatttatcttcactaacaattctaggaggtagggtaatgtcattatccccaatttatagatgagaattttgagcatggttccttcatatgcccaaagtcctataactaattattgcagaaccatgatttgaacccaggcaggggaattcatagcttctgtattttgaggtattatccttattgcccttcagttgccagccatcactagttgctcatttctgtgcaacaatggtcttattccaggttgcccacttttcttggactatctgttcttttacaagatgactatacttacaggaggatagatcctcatcagttaggcaatttattctttccatacttacctgattctttatttaaaggactatgttcaataaaacaaaataataacaaaaaatgaaactataatccctcttaggtcaggaaccggggagaaccttccaacagtgttgccttttgttaattctttttttccacttttgggctcagcctaaagtacaatagcaatctaatacattagagtcacatttgtaggtcagtactataaatactactttccatactgtcctggttggccaaaatagataacacattttgcttagtggtaactattattctgtaattttgtcacctttcgctttatcaccctgggggctatagatgagcttctgaagtgaacatttcctcctaaattttaccaatttgtaggaggctattattatacaataccaatgtcttgtagttaggcatgtatccatgtcctactataggcaaaaattttgtgtggcttagccttcttattggataacattgcctacggaagcatggctggcaactttttaatcttgatatatgaatttgttactttttatttttatataaaaaaagatattgttagtgttttaattctgattttactatgccctcttattttgtacgttgctggattgtatttttcttcatgacaacttgttattaaattactcataaattactgaagtggaaaattagaagactgacttgctgaaaacagcagtgttaggtctatgagttatgctcatttgatacctccatagtaatattaagagaaattagttggtgatagttgagaaaatgtcacctaagtagtctttaattaaaatctttatatcctcacttaacaaaattgcagacattagtgaattggaaatataatagcaacttaaattctttatgttgcaagtttcgataaagtacagaagcaactgaaggctctcaagtcttgacaaaaagaattgtctttagttgtgcttttccccaggaggtctatttgtaggaaagatttattcaacatttgttctaagagcataatgaataaaaagataaagaagacatggttattgttataaaggcactgttacaaagaagaattcttgattttcctagctgtccattaactacaaaagagccctattagatgtcaatgacaagagtagatttctaaaataagttgaagcaagtttctataaaccagaatgtctgcttttaaaatattcttatcctaggcataatttttttcagttcatgcctggttaaggataaaatatatgactgatttatggactaggttatattttttgaggaatggggaaaagcattctaaataagaaggtaacttagattataaattattgagcttttcgtaatctttcttatctaattcactaaaagttatacttaagcctttgcttttaaagattagaattttaaaaacaagttttttttccacctagtggattaaaaagtgaataatgctgggcacagtggctcacacctgtaatcccggcactttgggaggccaagatgggcagatcatgaggtcaggagttcgagaccagcctggccaacatggtgaaaccccgtctctactgaaaatataaaaattagacgggcgtggtggcgcactcctgtagtcgcagctacttgggaggctgtggcagaagaatcgcttgaacttgggagcagagtttgcagtgagcccagatagcatcactgcactccagcctgggtgacagagcgagactccatctcaaaaaaaaaaaaaaaaaaaaaaaaaaaatgaaagtgaatttaatttactaagtgaagatttttttgtttttgcctgtactcttaatggagatgggatgaatattgtgttttaaattttgtagcataaaaaaaatttagaattcttttaaaccatccctcactatatcaaacatctttccattaacctaacctgaggggaagtctcccttttcttaacttccaagacttctatgaatgaaacttctttgtcttaagtgtctaggattaaaacctgaacagtggattatttgaacagagaagctgaaaacaaaataatcttaaaacagtactcccagaccttgcaaaactatttaactgtgatgctgttttcaatagctggactacaagcaacaacaaagcattctggattccctgtgaggatggataatgctgtaccgattgtaccccaggcaccagctgctcagccactacagattcagtcaggagttctcacgcaggtaaaagctagagcaatgtggatactcagtattgctaaacactattgagattcagatattttgtcctagaaaatggtatttcctttgactataagatctttcttggtcatgattcagtggacttaaaatgaaacatctctatggaacaatatactaattcctaacactattgcaactctgccattgtcttccttagacttgcagggaaaaaatatccagacattcttgagaaatggtcttctgagtaagtttactctaattttgcggggtgaagcgtttttttttgttgttgtttgttttttaaatgttggagctcatataaagataagtatatatgtagcattttgattctaaaatataagcttccacttttgcaccctttgtgtcccttttgctcactcttttagaatttcatcacagttgagaggctggatcacatcaggatgcctcttcacatattacattccttcattccgtgtgtttaaccagattgtagaaagctttaaaactttatacttgctatggaacattcgactaagatgatagagaaaattgtaaagtatttaaatagcaacaaacagtatattttatattttatatataaatgtttgtggcctatgacacataggaaattctcaaatccaaaaactctattttgtgaacaggaggaagaattcttaataaatgtctctgtttcatagaactgatcccctgaatctagcccaaggaggattcctatacttctttgttttaggccattggcatttgactttgtgggccaatgccatacaaagttgaagggggaaagttgtgtttggtatatgcattttagatgctatcaaattactgttcattgtcagtaataacttggggggaatgagaacccttctgaatccagatatcctgcctccgtgtttgtttcactcacctgcctaatctacgtttcagggaagctgtacaccactaatggtagcaactctccaccctcaagtagccaccatcacaccgcagtatgcggtgccctttactctgagctgcgcagccggccggccggcgctggttgaacagactgccgctgtactggtaattcccctcacttgattgtgttactaacggagtttctttggtttctttcttttttgttttttcctgtttgtttttgttctgtttttttctggtttatttttcaaaaaaattttttagcttagtctttgcagagggcatggaagcatgtgccatcttgtggctgtgttcttgctacatcttttaatgtctcattgttttcctccccaacatttgctgtagcactgtctgactgatggttatgtggctctgtaaggagccagatcccttgattcttctttgccagcctagtgtgataaaagctctcgatgtagcctcagaagagcttcaacactgttacttgttttctgccttttaccctctgatccttgagaatgaaggaaatggcctttaatttggctcagctacaggtacccggatggccaaaattgagctcgttggcaagatagctttctcctttttttgctgttttaaggttctaaaacttttctgcatgtggaaatgcttaagatgctcttaatttattgctttctcagttgatactaaccatccttctatggacacatgaagatagctctttttgccactcatgatcagtggcagcttatatcttacatttaaagatattccctttagaatgtagatcatattgtaggtcatattgttggttgaaattaaaagtggacacatttttaggagttttgggaggaattaattattttacaaataggtctttatacaaaggttgaaagtatggccaacaaactatgcaaatacaatatctttgttattaaaagtcatggggaatagttacttaatgtagctgcaattgtagtactgggcttagagatagaaaaaacaaccaagactttgaggtgtgtttcaggatttgtaaccttaagagtgattttttggatgtgttttggtttatatggggagttagaattgtttattggatatccagcattttctcatttgaaatttaaaattaggtaagcatccaaaaacctgaaaggcactattgaatcctgttatttctctgttttcaaagttgctttaaatttcttttgttgtttcttaagtattcatgtgagtgaaaacacttccagaaacatactttggttggaatttggttttcattttaaaagtctttgtcacttccagattaattttcttgtaagcagaaaacctgagtgtgagggagtcagatatatttccaacttgattgatccaagccaatggttttaactcactcatctgtagtttcgaggttggaatgttagttgacacttctcctttgctgcttctcttaagtttgcactagccatttgctaagctttgcatatttttgttcttcctctgtcaaaacagttcgtcgcttggaacgccagatttctgcctcacattggaatgttatttcttgctttgtattaaactacatgctttgtcttgtgcaggtgttggcttatggaaagacgcatggtgtgacttaacatacttcttttattttttgttttgttttattttgttttaaattctgcttatggtagcagacgtgtttgcagtttctctgctttgaaggcttcttgtttggaaccagtatttgtaacaagtagatctgttacttgcagaaatatttttaaaacagtgtgttgatggccttgcaatttgaaattcaagaaacagaaccatatgtacccaagcattgtaggtaattgtactgcagaattcaagtttaaaaaggaaacttccaaatccgttcccattttttttttcaaaaaatgccagaatttctgtgaggaagaagtacagaaaacatttgttgctcagtttattgcaagtgacatggcttttttaaaactagaaatcatgtattttcttgtagtgattagtttttatgtggaaatattcctgcaaatgatacataaaaacatattttaggtaactattagaaacaaagtatgatgctttctgcttctaaaacatcttactttttgccttattttgaaattccattatgtggctataaatgatgaagttagctttttcttgctggcataagattttttccccaaaaggattaggcctttggtcatccacatctggctccattttccaaatactacccttttaaaaaagggaacagttctgccttttgttttatgggttgaattgatctgataccttatctgattggcagtcagattaaaaaattttaatctccagggagtcctcttaactctttctagggatttattttagaattgttgcaaaaatgaaactccagcatttaaccagctcttatctctgaactctcagactccttttctctacagtataatagaagctcttaaccgcagggatcttcttttctttaatacccgggtggtcaggttatgggggtgagcaagagaaagcagtatgttttctttccccattcataagacttgtagcttgagcccctctgacctttcttttttaatctctgcaagttaacaatctacaagcaacttcttttaagatatgaatttttctttctttaaaaaaacagaagaaaaagccaagaatgaatcaagtctggatgttttttatgtgtgtttccttacagcaggcgtggcctggagggactcagcaaattctcctgccttcaacttggcaacagttgcctggggtagctctacacaactctgtccagcccacagcaatgattccagaggccatggggagtggacagcagctagctgactggaggcaagtgtcctgtgttactctgggagatttgtaagggccgatcccatagggtgggagcacttggtaataaggagagagactagtaagaaaataaaggaaaatttgacactgttggaatcctttaagaacccatatcaggctaggagatggtgttataagaaaactttgaatataggaaagcagtaggttctgaaggtcaggaatcatttcttctagattttttaaagagagtcttaagtgattagaaaccatacagtgagatcctaaagccttgtaatctaggtccccaactttatcttttataatgaaaattctttttttctaatgtttaatttttgtgattacatactaggtatatatatttatggggtacatgagatgttttgacacaggcatgtaatgtgaaataagcacatcatggaaaagggggtgtccatcccctcaagcatttatcctttgagttacaaataatccaattacactctttaagtcatttaaaaatgtacaattaagttattactgactataatcacctattgcgctatcaaatagtagttcttattcttttttttttttttttgtacccattaaccatccctacctccccactagccctccactactcttaccagcctctggtaaccatcctactctctatgtccatgaattaaattgttttgatttttagatcccataaataagtgagaacatgtggtttgtctttctgtgtctggcttatttcacttaacatgatgatcttgagttccatccatgttgttgcaaatgacaacgtgtactttttgtggctgagtagtactccattgtgtatatgtaccatattttctttatccattcatctgttgatggacacttaggctgcttccaaatcttactgtgaacagtgctgcaacataggagtgcaggtatctctttgatatactgatttcctttcttttgggtatatacccagcagtgggattgctggatcatatggtagctcaatttttagtttttacaggaacctccaaactgttctccataatagttgtactaacttacattcctaccaacagtgtacaattgttcccttttttccatatccttggcagtgtttattattgcttgtcttttggatataagccattttaactggggtgagataatatctcattgcagttttgatctgcatttctctaatgatcagagatgttgagcaccttttcatatgcctgtttgtcatttgtaagtcatcttttggaaaatgtctattcaattcttttgcccattttttgatcgtattattagatttttttccatagagttgtttgagctgcttacgtattctggttattaatcccttatcagatggtaggtgctcaactttaaaaaaataaaatgcagctgcattttggctaattgcttttgatgtctgtttggtcctgattcttcagtggttttggaattcactcttctctttctttctgttggtacaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtgagtctgtgttacagctgatagttaaaactgtgccagtttgagagatatgttgccttgcatttggaatattgtatagacatataatatagatatgaagcagcaagtagctgccaaattgaggaagagcaaatcatttcatctgggcatgtacaccaggtgtgtcctggttttatgatggtcctttgtctctgctgccactttgaatctagggcattttatgatgtttttattttactttacagagtgaaatttaatcctgggataaagggcttataaaagtaaaatgtcttttgtattttggtgttcttgtccctggaaactcttgccagcatggtgcttattttcactggaacttatatagttaaatgtatttgcttaatgattatgtaaaaaggaatcaatgagtaaattggaaagcagtctggggaaaagatacacaatttggaaggccaaggactgaatcatctttccatgtgaacttttcctacaggtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtaggtaagataagtgaatggttcctggctctattggttttagactgttggcctcaggcaagtgggcccagtttggcctgtgaaagaaaggaccggtggggcatggtggctcacgcctgtaatcccagcactttgggaggttgaggccagcagatcacctgaggtgaggagttcaagaccagcctggccaacatggcacaaccctgtctctactaaaaatacaaaaattagcagggcgtggtggcacatgtttgtatcccagctactcgggaggctgaggcaggagaatcacttgaacccaggaggcggaggttacagtgagctgagatcgtgccactgtactccagcctgagtgacagagcaagactgcatcccctcccgcccccacccaaaaaaaagggccgaagaaaaaggtgttttggaagcatagccttcgatggggcttttggtgttgggcatacggaagagggaatgacctcttgcttttacctgagaaggtaggattcacacatgaaagtaacttaggagactttacagagtcatgcagaaatgaagtttaagtgaacttggaagagaaaatttagaatgaatttagagcctgttagttcaaaaggaccaattgtaagatggtagaggcaacatacaggaggtgttagaggtgtggactctgaagtcattctgtcctgggtctgaatcctgtcttcaccactcatcacttcttgtgtgaccctgggcaagttcctcatctccctattccttagtttcctcatctgcaaaatggggtttatagtacctacttcataggattgttgtaaggattcagtgagatgtatgtggagcatgagagtagtgcctgatacataagtacccagaagtttactgctgctaatattactattattattaccatctttatcatcattgttatcatgggagaaccagagacagatcatctaagaaacattgcttaaaagggtggttgaagctcggcatggtggctcatgcctgcaatcctagcactttgggaggccaaagcgggaagatcacttgagcccaggaatttgagaccagcctgcgaaacatagtgacatctcatcactacaaaagataaaaacagttgggcatggtggtacacacctgtagtcccagctactcgggaggctaagatgggaggatagcttgagcccaggaggttgaggtcgcagcgagctgtgatcactccactgcactccagcctgggtgacagaacaagacgctgtcacacacacaaaaaagaacaattcaattttcatgtatttttcttttcctcagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtcagtgttatcttcacagcttgagttgaattctcctttgatgtgtgaatgcttaaatattttgccataatccacttatatcagtggtagagaccagtggtgtagacattcttaaagagtccttaattcagaaatcagttccctgcacaatgtgaaattatttttggccatcactttatcttcctgtgtttattttgcttggattaatatacaaatgagattgtagtctcagaaacacattcagtgctgatgggagaaagcagacaagacgtgtgatattgcaagaagaattagcaggcaattaggtttgccacagatgatttgaatttggcaattgagatgtagacaggacttgataatattgaaaatgactgcaaaagtgttttggaaaacagttatattctttagatttttttctcacccagtgtcatagcagtgatgcttttgatggttttattaccaacccaattacttccatcatctttgccctgttagatactggacttaagctccctggtttagttattgtgttagttgggtaatagcagttgcagtaacaaatcctagatttttgtagcataacatagtagaattttacttctctctcatataatttcttggtacaagtgtttgattcctgagcatccagtcagaaggagaaagaaagtttgaaggaggcacacacatgtcttaacctctttaggctggaaataagtggaaatagtgaatgcttctcacatggccccacctagatgcaagtgagcccaggcaatgtagtcttgttaaggcagctgcttttcagtgacaacttcataccaaggaaggggttggtgaagtttaggtgtcaacataaacctgggccatacttgtataaattatgttttattatgtattatcttactgccatagacataaacagggttgtaatttgagggtattgtgttatgcctctgtgtgattcttttcagaagtagacagttgtcccattgcagacaagagagagagcttcctgatgccaggctactgaatagaattattagtacctccgtgtgctcttgggtccagagaatataggctatcacatgagacactgaataaatgctctggttttcctaatgggaacacagaagcaagcaaaatttcacattcagctgtcctgtaatttctaagaatttgaagacagtaagtgtccaacaagatagaattttgccttcttttaaaccctcttgccactttaatatcctaagaattaccaatagctttctcagcttcacattatcatttctgtgcttgtttaatcccttcctacataaaactataaactcttggagagagggatggtgtcttagcatatttgtatttccagtcgttccttgtatataacaagagattatagttaaaatatttataatatttatttaagtgaacattttgaggatcctatgtggagatttgtgccaagacagaaaagaaatgggtgataacaggttattttcttctgatgtaaatagaattgagaccttaatgcttgcaaactacatacagatgtggactaattaatatgatgccatctgaggttagctcagtgatgtctactcataactattaagcctggtgcttttttaggtctcctgagcaataagactaagccagtcgcttcagtgagtgggcagtcatctggatgctgtatcacccccacagggtatcgagctcaacgcggggggaccagtgcagcacaaccactcaatcttagccaggtaagtgctatgggctactgccttctgtttgggccctgcactgttgttactttctggagaaccctgcttctggctggatgctgaataaagccaaatgaagccccttttgtgtcaaacaattttgtgttctatggcttacgtcgtaccgcatatgctgtgtctcttcattcactctgtaagtgtgttcaggatgtacattctaggttttccatcagacctccctaagtctaccctggaaggttagagaaacgtctgggatttagaaagagcctggggtgctttaaccatgtctgtgataggcatatgctttgagaccagattctctttatcccccaggccataagtaagctgatccttacattgtttacttgagtcaagagattgtgaaaagctcattggccaccaaattcaactggttctaggtcctacttgttgctggagtctgcgatttgggacttccccactctccgaacacccccagccccaacctacccttctgcttctctcattactttattctatttgtgttcactcttagaagctaaaattcgagtgcttgtatgatgtccaccagtagtgagaaagtgtcagtatgagggtatgtgagagagagcacatgcaagtgaaaatgtaagtttgagttagtgcatgtattttagtttccacatttcaagaggggtatgaagaacttagaggacgaaaacaaaagaaagcaatggtaagaaataaaggctaggaaaaattcaaatttactgacgccagaatagggtgagttgagtcaccagttattaacttgcaggagtggggaaccctatgatctcttgattctccctcttcctgtcatacttacaagcaaaatgctgttacctgagccagattaggatctatcttgctaagaggcagaaggaggggtggctgatttctgacagcattcaatgccagtgtgggagattatgtgctatacccattcgaaaacagtacaagtcagaacctgagctcttaacttggcctttggtgccctgagctggagtgacctcaggattcctcacttcttccttctttcttccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttagccctgtgggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaattttctgacttatgtggctgtttttgacttctgttataggatataaaggggatcaataaatgacatctttgaaagtggctaagcatattgtatttgaacatcagtagagtactagagacaatttcattcttcacacaaatctccatactggaaatgaatagggtttggcagggaatacttcccaagaatgcagtgtccagggtccttacttcacatcatctggatctgaccctttgaaagaggtagaagacttctgagaccggctaattaagctttgtttcctcatatgttttgccagatagcagtagcagaatgaaaagatgagtaaccacaggaagctgctatttttcccctcctttcaaactgtactgttagagtcatggtcctttttacagaaggaacctctcatcagattctgttgattctaaagtgaatagaatttctcccgataaagaaataggggtttgtttcgattaatgactgcaggtctctgagtaaatgctctatttgattttttttttcggcccgtgtgtctaccttatggcccaagtctaccttatggtggccattaattcattttgggctcctgcagccttagttgggatatagaaatgagaaacactcagaaatacccttttggaccacaaccaagagaaataaccaatagtcttttctcccagtggtaaggaagtcagaatacattgatctagactgcaacaacatatatatatatatcagattccgcccccccgcaatacatgaatgtatagtaaattagtgtgaactcactgaacactcctcagttttggtgagagactatatctggcctctttcaagcaaaggaaagccatgtaaaacagcgctgctgtcagccttaacttccagacgatcgagttaatttactaacttctcagtgacctgttttttttttttttttaatctcagttatattttcttccttgggctaaatcagatatttgcatagcccccaaagtagtaattggatagtcttgggggaaatatgcatttcagtggtgaaaacccctgtaaattcaatatatttggcttttgtggaaaattttcctcatggggtgaagtctaagccttagtttctgtattaatcatgagagatgacaccagctgcttagcacaaggtggcgccaatgagctttagaataagttgggcttgaccacttgggccattgttttcctgcttcctcccttcaagcctcacctccccagctcccagcttctactgaacaaggctgaaaacaacccactctattgcagggaaagggaaagattaatgaaaaatgtcagtttcttaagtcagcactggtgaaactttcctaaaacaggaatggcgtttgctgagttttctctggggtctctgctttctgcagctagcttccctgcttgactgcctagaaggcctctgctttcgggtttccatctctttcccctccagaggagcctacagcctaggcgggaggtggttaaggcttctggctgctgtgcaatggggccatctgtgtttgatcaatcctggcggaaaggagggggtgggggttgtaaagagaactgaaagcattccagagtagtgagagagacccagagatcaggagagaaggcaccgcccccaccccgcctccaaagctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggtgagggacccctttctcttctagccccgcctagaaggattccagggctattggttcaaccagtttgttagggatctggggataacaagaaagggctctgttagagtctacagaaaattctctcttaataagaggaccttcggaatgacaagccctcctcttaccccacatagaacaattccaaagcaaatcgacttttgcgttttacctctgggattagatagaataagggggcagagtggaaacgagagccaaaattgtggggctgcatctccagagaaggtgatgattctgttgaagttggaggttcccggggaatctataacttcctgtctttttaacaggttgagatccgtagcattttagtgtccgagaggataattgctaagggagcagagacctcttcacaccttcatgcgcttagacctgcctagaggctcagatggctcagtggcactgctcacagagaacacaggctggaggacatggagtcggggtaggggcctaggtgaatctcagctaggctctttgcacatttagcacctctgcacatctggtttccttttctgcaggagtggaaggggatattgaagcctggctgagtttgctctttttttcccattcctgactcccgagttgggcctctccctgcctgggagttgtaaccctgcagcctccctcctgatcccccatcccttcaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacaggtaaataatctgaaagcaggcccctaactcttctcagaaccgatattcttccttccttgcttcttactctttttttcgctttgtcccagtccattgtggctctgtcttctggaatctgttttagggaaacctctgtaatgccaggtctattaaggagaggttctggggatccaggccgctgtggtacccgctctttctcaattctccctaagattggaggcaaccgctgggcaaatgctcactattctccagatcacccaccctgggggagttcctgctggaggcatctaattcttgcctctatttccttttcctgtgcttttctcatcagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccactgctcctctcctgtgtttgtttggggtagccctcagatcaaacttccccctgaccatccagtttctccctcccaacccatccccactccttgagccatattaaagacttggcggggctccctttgctgaggaagagtttactgtgaggcgcctgggggaggtggcagaatcccgccactttaggaggctggacgaaaggcctccttccacacccaccgccatccacagcagccaatccacagcagccatcctagaacctcagtggcaccgtgcctctggctgtgagacactggggcccagggcagagattccagttccgattctcagaggattttgaactacaaaatgcatgttagttgcattgcattctagtgtggaaaccagagccctgaatgcctgtgtttttagtaagaactgaagtctcccctctaaagtggactctgccccgcaccccagacctccactcccacctccagcgttgtgctcctgcagggccaggttgcacaatcattcttggtctggaccgctctgattttcctgctgccacggcgtctgcggtttgtgcagggaggaggggcagtgaccgtgtcccagatgttggccttacacggtctgcagcctattcttgctttccttttctccactctcatcaccctcacctacccactccagccctgaacctggctgaagcccgtcaggacttctggaaacttaaccctctctggcccataccctggcctctggcgttggattgcagagcgtaatgtggggaagagggaagggagaagggagaggaggaggaaggctccaggctttggactccagtctccaggaatctgctgatttctgcaccaggcccccaccccagcctcaccctcactgctgcatgctcagctcgcaggggcaaggctggctgatgggcaggatccactgctttcatgaggagtccacctcaggcatgcctgggggtcctcttggttatttgctctagccaagtgcgggaagggggcacagccttctccccaaagcacagccctccttcccgccccaggtggggtggctcagtcagggccctgtgagcctccctttatcttcttttcttttctcctcaggcagagctgctccagacgtaggttgatgaggatggggaaagaaagacagtgaagcacctcagaaaggcgctattatagggagaccggggcgggcaggggctctctcccattgaattctctcctaatgtggggctggcaacagtaatcaccacctgtcagcccacggaagggtctgcccacagaacagctggctgcggcacacgtggtgcacagggaggggttgagggggaagggcattctgagcacaggcctggagaatggggtctgggccacacggctggcagagcagtgtggggactgtgggtgccccatgtggaaggggagcttgtctgctccctagcgtgactgtgtgtgtgtgtgtgtgtgttgggggtgggaggtgcctgtgtgtggcagaggtgcttgtctgctccctagtgtgactgcgtatgtgtacgtgtatgtgtatatgtgcctgcatgtggcaggggagcttgtctgctagcttgtgtggctgtatgagtgtgtgataggaggctgtagggtcaggccgtgtctctggagttaccttgttagagcaccaaacaccaggagcggctctgatgcccttgatgagagcata

SEQ ID NO: 1685 - DNA, 4020 bp, Homo sapiens
gtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacaggcaagtggcaaatgctgaaaatcctcctgaaattattcttgggttaccattttgtgaagctattgatatgtggtcactgggctgtgtgatagctgagctgttcctgggatggcctctttatcctggtgcttcagaatatgatcagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggcaagtgtcctgtgttactctgggagatttgaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgaca

SEQ ID NO: 1686 - protein, 1187 aa, Homo sapiens
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQKCGLKRKSEEVDSNGSVQIIEEHPPLMLQNRTVVGAAATTTTVTTKSSSSSGEGDYQLVQHEILCSMTNSYEVLEFLGRGTFGQVAKCWKRSTKEIVAIKILKNHPSYARQGQIEVSILSRLSSENADEYNFVRSYECFQHKNHTCLVFEMLEQNLYDFLKQNKFSPLPLKYIRPILQQVATALMKLKSLGLIHADLKPENIMLVDPVRQPYRVKVIDFGSASHVSKAVCSTYLQSRYYRQVANAENPPEIILGLPFCEAIDMWSLGCVIAELFLGWPLYPGASEYDQTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRQVSCVTLGDLNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 1687 - DNA, 56587 bp, Mus musculus
  misc_feature (1)...(56587): n = A,T,C or G
tacacacacacacacacacacacacacacactgctgagctaccacaaaaagaaaagaaggtcaaaacgaagtgaaaacatgaaccttggaaagtcagcagatggccaagccacccctctgcccagagtttctgttaacagtttccatggcttggggtttgtgacgttaagcctgaaaccctagactaaaatagtctgttaggatgccccacccaaacctgccccatcccaggagctatagtctcaagattcgaaataaactcactgtgcaaaagagggcaaggaaacacctgtgtttaatttggtgtgggtgtgaagggaatcttcccaggaacacgatcacaggctagtggctatgctgtctgaatcagcgaggtgccagtgtctagagatgatctgcagaaggccagggacatccccacgggggaacaaaactccagctgagaactcagaactgtcttacaacctactgggaaatcgagcaacattaccttgtttcttaattaatgttttacaccacacagtagggccagtacagatggtgccaagtatgacaatctaccccaaggacccacatggtggaggagagaagccacactcacaagctggcctctggactccacctatgtatggtgatgtgccacactgatacaaactcacattaaacagacagacaaatgtaacaaaaatttaaagtaagtaataaattgtagtctcccctccctcagcctgaaacctgcttgctcaggggtggagcttcccgctcaatcgttctgccacgcccactgctggaacctgcctctttgctgttcggagccgtgcacgtggtcaccctgctattggactccaagattaattggcgggaatcgggccccttcccctgctttataactgcgtgtggaacagtaaaattgagctttgatcagaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataggcagaaaacttcacaggtgacaaagcagtatgaccagggctcaggggttacagttaggagacaccggaagtccacctctgcctgctccttcccgtttcggttgagctggcagtgccctgtctcagctgctgtcagtcttcattggcccatcttcctgattttcttctttttcccagggactggaagcacatctttaccttactcacaaagaaggaaataaacagtcccaccctctgctccaccactctcccagccaaccttcttgaaagtcaatcactgtgacttcctgccatccactgggccctccccagcccttctaaaaaggtcctaacccaggcgttagtgcccgagcaaccaggtcaccaaacccagtgaactgctacttaccaactattgctgaggcactaagcaatgtgaggtcctcctccagaaattctctccagaaattctctgtctctggggcacagctttctgtaaataaattattcttaatatatatgtagcagtaaattgatctggtagctgtatatctttacctttcattagtccacaataattacaaagataaatcagtatttgcttaaaactgtacctcaatagctgagcagttaaattatctaccttagacttctatgctcctctggctgactcccagtcccaatccatgatccatgttattgatctggctctttgggcttcaggtgtgttcccatgatttctctatagaccccttccttatggctccaaatcctccatcctccttgatgatcctccctctcttcctctctccttcctctggttgctggacatcctgccctgttgtttattctacccaaccattgggtgatcagcatttattgacaaggtagagaataaatggtaagaactgtttacagaaacttcagacaggagattcttagtataagcattacaatgccttgcttggattgaaaccagatatgatggcagagaaatcagcatttgaataacacaagggtaaactatacatagtgtacagaaacattattcctacagctttcttctaagtttcctcttacctttttgatcacttcctcccatgcttctttaagtgtttgctatggtttatatggacgtcctctgtcttagtttcttttccttcaaccaaatacaacaccctgacaaacacacccgaaagaagacagggttggttttggctcacagttcaggagtacaattcattaggactgagaaggaatgagcctaaggtagctcaggttacagacagccgggaagcaaagatggctgccactcctcagttcgctttctccaatctgtacatcccaggacccctccctgcacagggaatggttctgcccaaggttaagatgggtcttcctttatcaattcacctaggcaagccaatcctacaaacgcatgcccagagcctagagaagccctcacagaagttgtctcttaggtgattccagatcctgtcaggttgacaagtagcagtgaccatcacattccctcaagattcacttggaaaggcttgttcctatgctcagggctactgggaggtggaatttactgagggtcttcagatctgcctggaaagggataatgagacccctatctcttcccttcttcctgtccttccttgagtgaagtgaataatcttcctctatcataggctttcaccaagacaagctttaccacaggcccaaagcaatgggacctgctagtcaaggaagcatcaacactgttagacaaaacaaaccattctcaaggaacaaaatacccatggaaggagttacagagacaaagtttggagataagacagaaggatggaccatccagagactgccccacccggggatccatcccatatacaaccaccaaacccagacactattgcatatgccagcaagattttgctgacaggaccctgatatagctgtctcttgttagactatgccagtgcctggcaaatacagaagtggatgcccacagtcatctattggatggaacacagggcccctaatgaaggagctagaaaaagtacccaaggagctaaaggggtttgcagccctataggaacaacaacaatatgaactaaccagtaccccccagagatgtgtctctagttgcatatgtagcagaggatggcctagtcagccatcaatgggaagagaggcccttggtcttgcgaagatcatatgtcccagtacaggggaatgccagggccaggaagcaggagtgggtggattggggagcagggctgggggagagtatgggggctccgcagatagcatttgaaatgtaaatggagaaaatatctaataaaaaaacccattctctttattagttgcttaccacaggcatctggtatagtgatgtaaatcttactagaggtgtctcttcacccactcaggatgctgttctaaactccatctgagctgtatttcttcctacacaattgacactgtgcccctaaggacctgccttctttaaggatctatcacttgctcatcctaatttgtggtgtattttccacgggtgtaaaactctctggaccaccaacttgcaaaacagtaacttgtagatgttgagagaaaaactacaatgtgaataataaacattcctgtatgttaaaaaggtgacaaccctatgttttcaataagattgaagaaaggtgaccaattagattaatcattaaaaatactttttattgaacaaggtgacattcacctttaatcccagcacttgggacacagaggcaggcacctgtgattttaagaccagtttggtctacaaagcaagtttcaccacaccagtcagggccacagagggagactctgtcagaagaagaagaagaagaagaagaagaagaagaagaagaagaaacaaaatataataatctttaaacaatataataataaatacgtttaaaaatagataaatctgtgaatgagacgtttaattcgggagtttagagaatcgcagagtggtgcacatctgtaattctagtcctctgtgagagcaggtgatcacaagttcatggccaagtaggatcatgtcataagaccctgtccaacaagcaaacaaacaaacaaacaaacaaaaaacactaccaaaatattaagaggatttatgctgaactctctgttgtatggctggcaatatataacttatattcataaatgcataaactcataaaagaaaatactaacccttccaatcccaacaagggaagaattttcatagttctatttgacaaataggattaaacacaactaaaaagatcctgcacagcaaagaaagtggaaaccagaatgaagatggaaccttcagaataggaaaatatttatctttccaccagattggagagttatagctagaatactcaaagaattccaaaaattaaacaaaagaaaccccaaatcacttcattaggaagtgagccaatgaactgactagactgttaaaaaacaagaactagaaatggccaataaacacttagaataatacaataaataatggagaaggtgttcagcatccttagccagcagggaaatggaaatgaaagcgtcttcaagattgcatctcaaccctaatcagagtgactgtcatcaaggaaacgcatgacaacaaatgctggcgaggatgtgggggaagggagcacttttgtgctgctattgtgaaccaggcaggtcaacatactccagaagtacctgcgtgttcatatttaatactgcactattcccaacagccaagaagtggaagcagcctagatgtttaccagcatatgaatggataaagaaatgtgctttacatgaacacgaattctatgaaattttgcagccataggaaaaaaatgaaatcatgacatttgcagaaaaataattgtatctggaaaacgttgtgtaaagcaaaataggccagattcaaagagataaatgccatgttttccttcgtatgtggagcctagatttaagagtaagtgtatgcatatatgagtgtgtgtgtgtgtggtgtgatgtgtgtgtgtgtgtgtgtggtgtgtgatgtgtgtggaaggtgatatgtgtgatgtgtgtatgtggtgtggggtgtgtgtgtgtgtatgtgtgtgattgtgtaggggggtgatgtgtgtgtgtggtgtgggatgtgtgtgtgtgtgtgtgtgtgtggtgtgggatgtgtatgtatgtggtgagtgtgtgtgtgtgtgtgtgtgtgtgtgtgtgtgtgtgtggtgtgggatgtgtgtgtgtgtggtgtgggatgtgtgtgtatgtggtgtgtgtgtgtgtgtgtnnnnnnnnnnnnnnnnnnnnnnnnnnnnnnnnnnnnngggaagtgagaactaggtaatggaatatattaataagaaagcagaaagaaagacttagaggacaaaaaagaataaagggagccatttggaaggggggcagagcgaggatgacagaggagggaaagaataagaacaaagtatattgacacaaaatgtatgaagacaccatgctgaaacccactgttaaatcaacaaaagtagatctgtgttatatcaaaagagaggaattgtcagtagcatcttaccttgatgtttaatggttgttcatttaaaactatatgctattttagtcaatggtactctaaaaataattttgaggatatctcggtccctaagaagctaattaacacttggagtcttacagatctcaagagaaaaaaagtaattcattttgaccgccatgcagtcatttttgtccagacaaaatgaaaaagaaagttaaaaagttataaaaagaaagttcagagaaaaaaatctttgaagcatgaaaatgctttattttagatttacctgaaaatatgtgtttaaggagaagagggaaaactgtaaaactcctcctgttcaagaagagcttgttcgtgtgctttcagaaagatgacagtgggtggcagatcacactggcaagcagtttctactgcaagtattgaagcgagcattgtaacaattttctttaagacatttaatatttgatgtcaccaaaagtgacattaaaaaatgtccaaacttagaagaaatgatttttcatatccatttgaatgtgtgaggataaatgccgtacaatgtcaattatgtgagagcaaggttgccctccaatgtggggccagactgcctataaggaagcacagcaccttccttccatgcctggcattaccctcctaacctcagcagggtttggctagttcccaaacgctgtcaaatggtagacctaaaatctacatattttcaaagacttattttaacgggggaaaaaaaacataagcaaatatttggactttaatgtcacctatgctaaaaagattggggtaaaacacttgtaaagcaaaatgaataagaggtttacaagcaggacagctagccagacagtggtggcacacacatttaaccccagaactagggaggcagagacaagcagatctctgtgagttgaaggccagtgtggtctacagagttcctagacaaccagggctacacagagaaaccctgtcttgaaacaaacaaaaactagaaacacagtcgaacagctgtacatataagtaaggagacgaaaacaggatgtttattgggaaatctacatgatggtgatatggtgtttgctgcctgatattttgagcttgttttatatctagaaatactaataataaaatgttgcaggggacgaagaagagaaaatattttccataatcatttttttgtacatgtagtgctgtagcacagtagcgctggcaatcagtttaaaggttaatgtccttgttgtgacatttaatgtatccattacttgaatataataatgtatcttaaaattaggtaggatgctcttagccatgatgacataggatacacacacatactaaaatctgaagtcgatctggagaagtggcgggtggttaagaaacatgcttcctgcacttccactggacctggattctgttcctaccatcttatcaggtgacttccaagcacctataactccagcttttgaggatctgacagtctcttccagcctctgtggctacctgcacacacacacacacacacacacacacacacacacacacacacacgcactcacactcacacgagggtggggggggtggtctaaaaactagagtcaacagtagcttcggaattggagtaatgtcatctatagcctagagttttttcaacatcctgctttgttgtcctcagtgttgggtctgtcctagcctggtatcaaggatacaacttcaagcaaaagtctatgcccaacaacaatgagaagagagagcaacaggttcccaggagccaccgctcccatcccattagcttcaacacctgtctgcttattttctgaactacaagggtaaaggattgccttaagttggggagtagtggctcacccttatcttaagccagccctgcaaagcagcctaagacctaactttgtgaaggggaacttttatgattaatttcaatcaaaaatttgatgagctctagaatcagctgggagacacaagtgaggtagcttggttaggttaattggggtgagacctgcccactgcaggtggcaccattccctaggttgaaatcctgctccaaaaccaagcatttataactctctgattcttgacattgaatacaatgtggccagctcaagttcctgctgcggtaacggtaacttccatcgcttgaactgtgagctggttcctcctttgctgctttatcacagcaacaggaaaagttactaagctaagggttcagtacatactgcagatctaaaagtgtcacgttaggcatgcaatgaaacatttctagtaaatgcacaagggttacaggatgagagaacaatggatttattatatatcataataggaattctgtttccagagactacagaatatataatctgtaaatattacagacataaaattcaacaatgtaacacaacagtataatattactgttccctcagttgatttactgaatgcctactggatagtagagaccacttattaatttagttcctctttcaaagcaaaaccaaggtgagagagagctataagtgtaactgaaaccagggcttcgcctccgcatacttaatgacttcatctttgtctccagttcactgttactaccagaagcagcactttcatttgccttctcagtttcataaataaaattcactagcttttcaaagatggaaatatgcctgactgtaacacggaagaaattgaatgaatggttggtgaggtcctggctaccttatatcataacctcatgtgcctcactgatctcactgtacatttattaactccttaatcttcacaactcttttgaagcaggttgtacaatctccatactgagatgggaaagagaggccccaagataatggggtaatgtgtcacattagtcaagtgcctgccctctgtgatttgttttggtgagctcctgactcccctcaccttggccatctctctgactcctgctcccaggctaggttgtacttcctctgcttcctcccctgaccccctgctctctctactggcacctttttgtttgtttggttttggttttttgagacagggtttctctgtatagccctggctatcctggaactcactctgtagaccaggctggcctcaaactcagaaatctgcctgcctctgcctcccaagagctgggattaaaggcgtgaacaaccactgcccagctactgacacctattttacaaattaggatcaggtccagtcttcttgaaaagccttccttagtcaaggcagaagcagtctcttgcccagctcctagcccacccacctcaccttgttccaaaaatttgcttacagatctgtgccctccagtaaagatgtgatagcaagcctggcattcttctggtgtccccagggcttgctactatgcctggcctataattggcacttagagtgttgctaaattaatgcacaagctccctgattttacactttcctgtctcccccgtgccgtctgacaccacatattgtagacacttagtcaactgaagtgaatgcccgattcttcaccagtcgcctagcttaataaaaacaaagcaaaacagaactcgctccctttccctgatctacacatctcagtctagaccctaagaatctggacttctttcaaggcccccgatctatcaaacctagcaggatgtgagtgagaggtctgactccctttccctgatctggtgggctggactgggcagggtgggaagcagtgtcagggcccagggcctccgcctggcgcgcctactcccagttcttgcctattaaggtaacagtcctctaggaacgcagcggcaggagggagggtccccagcagcggcctccgcccgcggcctgggcgcttgcaggactctgcttaactgcagccctggacactctgcctggcgcctcaccacagagtctctaccggcttcaccgatcctattagctttaccatctgaagtcacctccctaggtttccatagacacgcaggataacttcaaccatcatcgagggcctcaagggagtctgggcacccggcactgattaaatggaccccgcgttccgggtgggcgcacatatgctcggatagctacaggagcccaagcccaccagcgtggacgaaggtggtgctacctccaagggccggagcgggtgcgtgggaccgggatctccaccccagggcgccccagccacagccagctggccgctcgcgaccaaatccccgcccgcagaccacgcccacaggtcacgcccctcccaacccgccccgcccctccaccggcgcccgccgctcccggggctcggcgcgggcctggggaatcgggagcccgccgccggggtcgcagcatggggcgttttcgcgggggcctgcggtgcatcaagtatctgctgctcggcttcaacctgctgttctgggtgagacccgaaccggcgggccggttagggggccagggtccccggggaggtgaccgcaatagagttgggccataggagagggcaggatgttcagaggcgctaagcagacaaagagggaggggacatatggagggggataggacatagagaagcttgagctaccagaggtgatgagaagaggagacacggtgcgatgctcccccgaaagaagccatcatcttcggcggcatcgcccggcgggtggcgccaggtgcggggatctagcgggccccaatattccgagggctgggggcctggcggcccgtgctccctgcatcctgctgtgtacacacacccacttctcgcgctgccttctctggggaacccggcggcccggccaaggctctgggagggaaatccctaccgtagggctgcctggggtggcgccccaaccaagagtgtgcggacacgccgcctggctctggtggtttgttgggaaaataacggacagtagagaaaattgaaagagtggggaagatcgtccttttcttgggcattggcgggggggggggtcttctgggtgggcagtggtgggtgctcttttacgaggggttggaaaatggagggattttggaagagcagcaacatccccctagggtccctgcgtacaaccagtactcttgaaatgatctcattcaactttgcagggtggtgtagacctggcagcattccctgggtagagatgcatagagacagccagagagagtgccatggccccagtctactgtgttagcagggcatagttagaggtgtaccatccctggaatactctctcccgagccctggaaaacggtcagaggcccattctgcacagtccctattggccttccagtaacagaatgccagccagtgtagctgctcagatagaccctgagggaagacacgagtctcgcttcaggggatgtgggtaactgcaggagcagagatgctttgggatgctttgaaaccactggactggccgcgatggttgtcccatctgctctgaggaggctggatggacgataagtaataaattattgaacgatgggcctcacttgtgactaccaacccatcagccctgaagcctgggtgactccagcaactctaagctcttcagagactgcgtggccatgaccaacactggctagcaatggacagtctggaggcagtacctggggacatcccctgtattttaaaaatacatatagactttgtacaacttggcttttacacccatcacactccaggaagaagactttctgagcgcccttgtgctgtattgtttgtttgtttgtttgtttgtttgtttgtttataagtctggcttaatttcgaaggctgttaattataggtgccatgttgcagtgacacccgttactctcactgcttacaacatactttgtgtgagccagggagggaagtctctcaggctgggtttagtgcttattttgtgccagcttctccagacttatcaaacctttgcagtgggttagggacagtgcgcatgtgcaagcagggcatccccatcttcatagacgaagacgtgggggatcagataggtcccacagctgttgagtggcagagacaggactcaaaggctgcctcctccatcttcatcctgtgggaggttcagtcacccagctgtcctcagaatgtggctcctgggtcaacagcatcagggctccctggggaattttcagaaacatatattttcactcagcccggctcgctgaatcagacagtgttggggaggagcccagcaagctattctagaaggcatccaggtaatctgaacccacgggcatgtttcagaatcaccatcaaacaactactagatagatgctgttcccaaagctgctactacagctaagagaacagcccacagagaacaacaaaaacaaagtaaggcagggtgaccaagtgacaagcttcacacccgggtcacaagcgcagggatgaagtagcactccagtgaagtctgagtgcctgtcactgagattggagatggccttttctatatgtgatctaagtacagagttcagaaaagcaatcccagtaccagcgaggaccctaaacaacttcatctgagagatatcggagctcaacctgggagaacggaggtgggcagagggaagccaccagatgaggagcagagcaaaggattgtgagccatccgagaggcaaagccagggggggtctgagggcagagatccaaagcatggtgtgcttagatgagggggcttgccagagtcagtgtgctctccctccatgccagagtcagtgtgctctccctccatgccagagccagcgtgctttccctccaggattgccttcccatctgttcaattagatggacagagttgtgctgaggacgtgtgtgatgtatcctaagccagccttatatagtaggggcttgaagttatttgttattcttgttattaactgtctggcatacaggaagtgttcagtaactagtatctgtctttctcctggtgtcctgactgttggcaaacagtatctgtgtatgccaagtgacttgcatgtgacttctttggtggacagctatacactatcctctcaactcagacttggcttttttcccccactaacattgcccactccctgagagcagggattttttttttctgttatttttacattcatttccctggcccctagaatggtgcccaacacaggtactgagtaactaactctctatagtggattaatgaatcctcaggttagatacctgggatttaaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgccctggtttctaacaggttttgttttattttgcttgctttttttctgattggggagctttcccaggaaggaagccctcagctgggacttgagtatcttcacaaacccatagatgtcttcccttttgaggtctagggtccccgccccccccagtgacagtccttcctgtcctgccagaagttggccaggaggcaggcacggaggctgtagagtgtgttttgtggtctgagagtcagatttggaacctcatcctggcagttggcttgccagtcctctcagctgcgcctctggttttccaaaccgtcaatcagacctttgagaaccagcacaggaagccaagctggactcacctcgggttatgaatgctttaaaacctaaagtaaagcccagtccttagccttactgtattaatggagggcgtctgccctgtgtctgccaggtctgacttcaggatctaccatcacaatactcggtatagtcccgactgcgttgaaatcacctgtttttccttcccctctgttgcatagcaatataaacaaaacactacaacccacccagacacatatgttggttggaagaaaagcttaggcactgtttattccttgatttgttgttgtctgctcagcgttttcctatcattgtgctctctgggctgctcagggttgcctccaacaggaagcaaggctgttcctgcttgaaagttacatgccatatatggcatgtgggaaggtgctgtcctttcttcctcaccatgattaatgcaatgttgggttttcacttggtggtgcctactaggtgattctgaaaagacttgcctctttggctggagagcgaatgctatttggctcacagcttatggttcctgctctgccccacacatttcaaacatttcaaaagtggcagagcagccacttgttagaaaagatggtgcaggaggagggggaagagcctctggcgtctctaggacagcctgcttgtccattcataacctgctctgctgatttctattgaagtgggaagacagatgctttggcagcctctcctactgtgcaccagaaggacctagagacggtgggcagagcagagtgcacagcatggccagtctggagaggccagagctgtagtcttagtgttgtggttgaccccaggctcgtgtatgcagtacggccattcaaacctagaaaactaaagagtgaacgttggattgtggtaccaacctgccggagtttattcccagttctgtaggtctcacaaccctggggactgggttcagctgtttggcctctttgagcctgcatcttctcttttgtaaaatgagcatagtaaagtagtatgcaagtcaccttgtgagctttatgtacataaagcccgccaatacatgtacagtcagaatccagtgtgcacaaagcatatgcttaataatctaagttctgttagtgatggtggagttcaaacaatagagacgcaggcgggaagacaggacttataattcaggaggctcctcaaggaaacagggaacaaacatgtgccctacattcagccagtcaaaataactagtcttatggcttctgaaagtcatggagtgttccctctatgatccattcactcagccagcaagtgctaggtgcttgctatagcctgacttcctgaactgtggttgaaagattaaaaatccctttacctagccaccatgttgtctttgataatagctcatctcctgtctggtctttgcccttcgaaggcattgactgttataagctggcatcctctcttctggtcccttagcatctgaaagattcaacagggttctagataaaagttcacatggagaactgctaggtgcctgccatgcttctgtgctaccaagggaaggagatggcacaggctttgatggtctgggcctctcctagtataatgtgaatgttaatacatgagaccctattcaattatctattcagactaagtaggtctaggtctgtacctataacaagctgcctggtgaggctggcacaggtgctctaaagacactttgaggacccttgtctgagatgcagtctcaagagctcaaagacccttgtttcaagatggcagggtgactcttctagttaccatattatcattattgtcttaaggattcttctacactaatccttggtagtcctagaatcactgtcacaagatgcatctcatagtgttattctagaccaccctgtctggagtatctctggaaaacctctatcctctggtcttcacactgacagaaccttcacaacaggcttgttctccttgttaaagcaaaggtggaaatgcggcaggagtgtccagcaggcgggagcaaactttacagatgtatgggaggatgttggcctgcctttctcaccatctccagctttcagtatgagagaaatcaacaaggcaaattaacatgcatatgaagttttggtttacaaaatgcttccacatacatgatctcatctgataatgaatcgttagtggcctctgtcttcacagtctttatatttttaattttcacaataatttaattagccccattttacaagcatggaagctgaaaggtgcagtagctagaatgcccaaggttttctcctttcccacgttttcacattatcaatgtattgggatgtggagtacaacttataaggaaatctatcagaggatggggagatggctcagtgggtcagagcagttgctgcatatgcataagaacccaagctccaatccccagtgcctctgttaaaagctgagcatgctccaggaacccagcactgtgtggggtagagacagggagatcactggagcttccaagctgctgtcctagctccagattctatgagaggctttgcctcagaggaataagacagaaataatagcacacctatgtgatcctttgaccttggcatgtataggcaccaggtacacatgcattcacatacacacattcacatacacacaccaaaagaaatgaaaacccactagactcagactcctacctataaccctagcatgtagaaggctgaggcagaaggattacctagttcgtggttaagtaagaccctttctaaacaaaaccaaaccaaacttctgctggcgtgaaaaatacatcgcctatgattagcttgtagccagtgtcaggttcagtcttgaagcattctagaaatactggaacaaaaaggtgcataaaacactccaacctgaggctgaaacaggagaaaggtaaggaccgtgactgacccacttaaggcaggtgaaaataagaaagaaattgagagaggtgagggttttgttttgtttttttcaagaaaccattttaaaaattaatttcaggatcagaagcttgaaggacaatgaccttgcccaagtgtaagcctagcagtacggtactgctcctgtcaacacagcctcgtgtcagcccttcagccctcaccacagccctgggaagcagtaactgctctcccccaagttccaccaagaaaagggagacacagagacttgtccaggccacaaaagtggccagcagcagagctgggtctccagtcaaggctcagcatctttgtccttagcctttctgagtccccagactaacagggagctgggatgaacctgtaagtgacttctacacctgctcatccaacatggtggccatgctactgaatacacagagctgtctaggcttaaaatgaaataaaatgaaatattcttgccctcaataccacctaccaaatttcaagtattcagtagccattagtactgagtggctacaatacaggacagcacagatggcaaatgtctataacactgagaacaccccgcccccgtgtgtgtgtgtgtgagtgctgcacacctggtattgaataggaggtgacagccgtaagctgtggggcaagagacagggaaggttgtgtggaaaacttcatgatgcatccttcatcctggataatccttagtaatctcaaagcaggttgtaagaatattaatattaagaaaatgtctagagaatgacaaccgaggtcttgtggtgtccagtatagttcatccaaggggacttcctggcaacgaagtgtgtctgcttgtcccggtatgaatctacacacaacatttactttcagctaccatttctcactagcaccatgggaaagtgggtaaagagtactaacactggtcgctattgaagggtcctggttattgaaactagggggatggctcaacagtgaaaagagcacgatgttcttacagacggccctctggttcccaatgtccactgtagtaaagtcatgactgcttggaattccagtctgacactcacttctggcctctgtgggcacctacctgcactcgtgtgcacaagagcacatattcatactagagcgtgtgctcacgtgtacacatatacaaacagacatacacagttaaaaattacatagatcttaaaaaaaaacaatcctacttatttttccaatgtcatcctctcaacctccttgaatatgaacacataagaatcagttaatataatttaatgtctcccctcagcctatataaagctcaatatagtcgagatatgacatccgtcaccagggttcctaagatcagtttgtgcatgcagagggcaagacaagaggtgcaggcccagctccagggaggaaatccagagacttagaaaagacagcttacccctgggtgagaaaaggcagccagtgggtggtgggtttaactcaaggctgcagctggctagagttaggctttccttctggggctctgtgatcttcactgataaagccttctgttccctggcattagctggaggcctgtgactttgttttgctggatagggaaagctgggaagccatcttctttctccaaattcttgctcctccctaatctcctcttcccctgtactttctaccagaaggcattgtgtccgtgcactgaataaacacgcgcagcccacactgtccacagatttactatgttctcagcgccctcttttccacccagcttctttccccacgttcttctcttgccctgaaactccagcccccccccgctcccccagccccagcacttgtaatccacctcccaacaagctcatctggctcgcaggacttcacttcagaacaacttcaacacacagaaaaaggcgtgcttgtcacaaatacacagtcaagtgttctttccagagaacaaaacacttctcatcctatcaaagtttgaattgcagcacggagaataaacactgagtcaccatgaagcaagctcacagggtggctcagtgggcaaagaggcttgctactaagctccatcccagactcccacatgggggaagatgagagccagctctccccaccatatgcagtgcacacatgtgcccatacgtacacacatgcacaccaagtaaatgaatggggggggggaggataaaaatatgctctcacctgaaggaagcacaaacatccttatgaaggaatagaaggcaaatcacactggcgaagcagaagccacagccacttccaaacagccttatcagcatctgttgtcacagcagtccttcctcctagtctccacctggtcctaataccaaggacagggtaactgggtccctgtgaggccgtttggtatgaatgccatatgctattcagcccttgtagttttttctggttaaaaaaacaatccttgctcttgacaaagttaccatctgaatcctggccttgctttctctatgtaatgcaatgaaagtcttgggagccggttttccactttgagcaaattagtgtcatcttccaaagcaaatgagcttgtgacatctgcctgccacaaagctgaggcataatggggcctcaatcagatcaggaatcatgagggctcattatgagtccatctaggacgtgcgttgccaccgtgagcaagtattagctcgaatgcatttaacagaggctccagaatagaagcctcattttcaactttgtgtggcttcatcccaaaatggagacttgaaatgagctgggtttgtgtgtgcacagccttcgctgtggtgacgcaaggacatagggctggttttgtttgtctttcactgaagggcagcatgtctatctgagttgttgtagccatccgaagtgtgacaaccttgcccaggtaaaggtgcagcagatttactctttgtgaccatgggtggttctcgacacacatccctgaggcttaggaaacctgatagcccatgcaggtgtggtgctttctttttctgtggggtagtgtttgctgagcacctccaacctagtttcctagtgctgattaccaacacacacatacccaccaagagtcctagcttggtccaagaactgtcatactgacggtagnnnnnnnnnnnnnnnnnnnngcatctctgctccccctgccccaccttatcaggctctgataggcagagggaaacccttagcagtcaacaactgcaagttgttgctgctctcacagagctcaggcctttaaaacccagaaatatttaaatagcaatagctatgtgagctatgaaacgacacgcatatctaggccaggacaggcttccccaagggaagtgacctgagagctgagagggaggaggagtcagccttctgtgggcagcgcacacagaagaagagcgttctggctcatgaaacagaaaaaacagatgtccccacatgaggaaagacagggagcctgactcaggcactccaggcctcttcattgtctcccacctgggtgtaagcactcgtgcttggcttgaactcctgctggggattcttatggccaagaaagcattctctctactggggctcatcagcagagctgagtagggtcacacataggcttcttgtcatgctggggactgtgtccaggaagggaaggcggggcatgctgggaaacctgcatagggagaagtgtctgtgttctgcatctcagcactacggcagctggatgaacctttctggtttgcaattcataacgggggggggagggagagagagagagagagagagagagagagagagagagagagagagagagagagaagtcaaccagggcagtaaaatacaatggaaatgcacgagctgctttgcctcaagctgaaggacttgtgttctgcagagagatgttatctgagagaaactttctgtctatctgctttgcttcaaaatacggtgaatctgtcttccatcccttttgcccctgagtttgagaccataaacttcttctctgaagacatctggatagttttctgtatccagcaaactctctagatcattggtagctgttgaaataacttgcccacaaatgtctgtggctgtcctgttcggtgatagcttctgggccccatctgtccttgcggtgttccagtccccttcccccttttgatttatgcatattgatgccattggttcacttgtgttcctcaaaccttccctatcttataacattttcttccttccttttgattttcttgttcccatctaagacagagtctcactatgcagctctagctggtccagaattcactctgtagaccaggctggtttcttactcacagaggtccccctgcctctgcctctgcttcccatgtgctgacattaatggtgtgcgccaccaccaccttggttggttttagtgttcttaattaatttgttcttagtaattaccagggaggctcagtcactccattgcatgagaattccatcccagggccagtgaggtgccacagcaggtgaggatgtttgctgccaagtctcatgatctgagttcagtcccagggaccacacggtggcaggagactatagactcctttgtctacacattgtcctttgacgtctgacacgtgctgtggtatgtgcatgttctccacccatacaaaatgagcaaaggactataagaagaaaagtccatttctgcagaagtgatggtgtttttcttaccattctgctagggacacggcaagcaatacctgccctagaagcagagcggccctcggcagtgtccctcgctactgtgattctcactgcccttccgggtctccttgctgctccttagcatcctctctgaggttctcctgagcatccatctgtggctgctcactgtatctggctgccaagcagcattcagctcctgctcactcccatccagagagttgagttcctgtctcccctccctcggggcctgaagtaggattcccatgatgattcaggctaagcagaagccacgagccatggctgcccccacactcctgtgatgatgatgtaatgtgctccccaacactggcctctttctcagcatagcacaaaggtaaggggtggctctttcccctgtgcagttccttctgcctcaagctttcccatcccatgaaattctttgctgctccatgaaattcaactcattcttcaaggcatatatcagaatggggatgaccgccacccaccagtgccctgtgccctcccttggtaatgcgcgctccttcccttcggcacacttcctgcatcttatcgcatgcctcactttaggtgattgtcttccaagtctcccacatggagcacagtacctggcctggctcggactatggttggttgttactaaatgtgcatggaagaagagaaagaagtgaagagagataaaagtgggggcaagaagggaatgaagaaggggcactttctcatttcttgcttatttcagttttccctgagtatagatacagaatggctaagtacaaactgggtcgaaattaaaagcattgtggcataggggacatagtgcctactgagttaaagcttaggtctaaagaggccctgagtgctggggcaagcatctcctgctgtagggaatgcgcacagtaaccgagaaccacatgcctggcagggggcttccttcctctgctctcactggaatggggttagttagtgtgattttctcacccccttgagcagtttccagtgtgcagctcaccaaccacaaggacagccaacatggcgtctcatgagcctgagaggccttgagttttcagaagggccaaagagctacacggtggctgccacgcctccttccaaagcagagactgttctggccctggaaagctcctcacccacacatccctaacatgcccacagcattctgggaggattccctgccacacagtgatgacattcagctaagccgtagtttccttgacccagagaggaaagccgtgtatgtgtggtttggggttgggggaatggatgagcaagcgtggattttttttcccccattgcccagtggctctaaattgcaacctctcttttcattttccattatgcctcaaacacatgtgtgccagaactggatggatggattctgtctgggaggatgatccagacagcaataaattagagtttgtgttcagagattccaaaaatgtggtctcgtggtagggtgtccctgacaccagtcacctcctccatagtctgtgtggtggctcctggtttgggcccagggcctctgtcaatagatcttgctttgtgtttggaaacatttgtgtctttccattaaggcaccagagagacggggaagcagggaagcttgtgaggttcactgcgcagcctcatcccgggcagcccaggcgttcctagggacaagtgtgaccaaagacatcactcctctctgtacacagcagccagagccccaaagctggcaccttcccgaattaagcacagaacaagaagattccccattttccatatgggacataaaaaccagtatgcaatgcccagtatgcaatgccttctcaaaagcgatggttcttaagcctagaagatgaatgcataattaatgtagagcccttagaagacagaagaaaaaacgtcacctgtaattccatccttcaaagataaatactattatgccgtagcatgatttcatctcaggtttccatgccagcctgctctttttttaaaaaaaaaatgtaaaaagtctttcaaaagacagctgagcctgtctttttttttttttttttttagctgccccatgaattatccaattagtgtcctctctgaggactggaaacctttagttattccccttgggagtagccagctggtagaactcagccacccactccccctcaccaaaggcaggcctgcatagttctgaagaagccaaccacacagggaattggccttgggaaacgaaatgaagaggtggaaagtcctcatacatacagccaggtaaccttccaaggtcagcaccgggtctctcacaagctgccctaaccctgagtgcattttcccttcttacacctctggtctgcatttcctccttggcttctggctgccagggtgggtgctctcctcttcacagataagagcagatcctcactgtctggtaaaaggctagggctgccccacagtaactggaagagttggcagaagcggggtggtattttcttcatctccgctgattttcccatagtgctttgcactcacaaagtaccctgtaaataagtgttaattgactgatacagtgatatccatccgagtggtgtttgtggggagagcaccttggctggggcctatgggcctgtgggtctgtgggcctgtggttaggacagtcctgtgactgacatacttagacatgtcagcttagacatgaagcctgtaacagccttcagcctcaggagaggaagcccagtgatgactcttccagccgccagcctgcctagccactgcctgcgccagccactcagcctctccatgagccacacagcacacagaccaggccttttcagaaacatatttttttccgttttcactttccatgggaaactcaaaatagcaacaacaannnnnnnnnnnnnnnnnnnnaaaaaaaaaaaaaaaaaaaaaaaaccctccttccctgcctgcaaaaccatgcttggtcaggggcagggtattggttaccatgtagcaatcaagaagagggggtcacaggagtttctgagcagacttgggattgcatcatggatatttgcatgcatataaatgcataattgggaattgcatcagcaagtgtaggtgggcccccaaggctggtgcaggtttgtttgtttttctaatttagaaggtggcttcccccaggtcttagagttcatcttgctcttggtgacttccctgagacagtggccactcactaagatgttggtgaggaaatccagaatatacccagcaagagacaataatgaaaggggtagatgcctggcagggagaatgttggaacagtgattttcacacacacacacacacacacacacacacacacacacacgagatgggggccgggggagaactttcattccatgggtaccaaataaccacaggaaaccccaagggcacagcaaacctgtgattggactcaggatatcccagagctggtcagtcatattagtgcccccgaggggcaccgagttcatgcttttacctctaagcctgctttctttcctggcaagatatgaagagtaggcaagaggggggcaaccctctcagcctgggcattgcatacctgcagcttccatccagcctatgtacacatccccctccatagtcaactctgctgtttatcttccagctagccggatcagccgttattgcatttggactatggtttcgatttggaggtaccatgaaggatttatcatcagaggacaagtccccagagtatttctatgtgggtgagtgacttcagtttccctaaaggttgggtatgagggacaggagaaaggcaaaagccactgtctaagtctctggacctatacacttctactggtattgggggatgtgcctctgtggccccttcctcctctctccaggatagaagaaggccccaggaaaactgatttgtttatttaaagaggtatcaaggaaatgtaactaaagtttatcttaaagggttagggaacacccttccttcctggagtggttcatcagtccattcaagctgtcgtgggggacccccaataagtcattattttactttgtgatctgatgttttaacatggaaacaactcaaaatgaagaaataacttcaaagttttggggtgctaatctcaaaacttctgtcagtaaagacttctgagagaagggaagactcccatcatggggacaggagagacttgtccctggagaaggggaacaggcagagcggcagcagccataccttctgccaagaaatagggtgacatagataaagctggcgctgttctcaggggcttcggtccctctattaaccctgccctgctctcctatggtggttctagcactgtcttcatcagtacaatccaaaggaggaaacagaaattccacttcaccagtcctcttccggaagtctcctgttgcagcctattgaccagacttgcattgtatatttatgcctaagagaagagacagcaaaggctatagctctaattcttggcccttagtttccttgtgcctggtgctttgttcctacaaaaaccctgtcctccaacttctgagcactgactgtgtccatgttgtgtttacaatcactggccatgggctaacagcaaggggagatgttgctgaggaaccaaggccgggtacacccacactcatgccacagcaccgagaagaaggattcaggctctacttgtggactcttttactggttttgctctgctaggtaactcatccattctcagtctgcttagcttaagggtgtttaggccaacaagctgcgggctacacaagcagtttgatgcctggcactagcattaggctgggaagtgtaagggggtcggtagaaatgaaagaagcatgttttactggagttagaagcctacagcttctggcagccatttaatcatagcagggaggagacagaaagaaagatgagcgaagatggccacggactggattctgacagcatcactgtagtctcttcgatgagtactagcctggattttcagtcatgtgtctcactaaatttccattagattcaagtccggtggagtgggtttctatggatggtcaccatagaaagattcctgacaaacatgtcacaaacataacatgaaaaggcgtctctgtgtctcaggccctgtccatccacttggcttagcttagagagcaaagccggaatgttagagtagagcagctgaccctcctgctcaccacagggagctctgcgattggtaaacacccagccctggctttcggcacagtggtcaaataccaacagaacactttagcttgactaagtttgttcaacatttctgacttaagagatcacaaggtatttttaggttaaatccaaaactgtacctgtgaaactttacttacacctcaaaccagcaacacagatggagctactcctggatctcttgcctctccagccctgtaggaccaccctccctcccactgggtgggaggctccttagctcactgatctgacctgaagagggaaacagtctcatgtagaccaggctggaatggaacttaatagctaaacccttgatcctcctgcctccacttctgaagcactaggctctcaggtgtgggccactaagcctaaatgttctgtgtatttttctttagaatgtgtttctgagtcatcagctcatacccattgcccttcggttaaagatgtcctaaacaggcttagcatgctcaagtggttcttcaagacaccaagccacagccaagtgcaatggtacctgcccgtggccccagcttcttgggaatcaaggaggatcgcaggcaagggaagaagagagggggagccatccactcagcctagagcgaggaagcctccagaaagacacagagcatagctctggggaggcagcaggcaggcttttggggattgacccatgtttgcaaagatgctctcccttttcgaattcttcttttccctccatgataatggagtttctctctgtctcaatgctctgtaccaagtgtccaaggcagacagagtggtaggcattagccaaagcagggagacacgaatgcggggaaatgaggacatggaaggaggtagtcagaccaactgctgcctgctgcctccatttgtgtccctctgggtcaaggccaaggcctagcagctgacccagggtctctgtgtcccttggttgcctaggtgaggaaggaagaggctggcaagagcggggctggcagggagaaaacctgggttacttggagtttcctagaccttctccgttccagtttctctcagggaactcaagcccctgctccttcctaattccaacaacctgcccctctgattacctgtcctggcccctccccatgttttggaagggtgaatgcctcggggtcttccaggatcatagagtggggaatggtcctctctgcctcaggaagctggagcacatgagctcatgtctgtgagccgaggatgtgagcaggtttctccactgggggtgcccacacaaacaggagccacttggctctgcagtcccagcctggctacatctgcctttccctcttcgattcagagtcccggagtctgactttgattgtggctgaggttgtgtggaaggaaagtgttccgttgctaaccattcaggggctggcttgcctttataaacactctgactcactctggtaatatttttttaacttcatatctgataccatgctagctggataacagagactaccatgtctggacagtttctccaaagccattctacaagaatcagaataggtaattatgccagaattgcagatcacaaccctgaaggagagaggggacttaaccatacccagtctcagcagcccagagctctggaccctagcctgttcttttatgggaaacacccaggaagcagcaattttagaaatctcaggaactcttctaccatttatacatggcagatttctaggtaagaaactcactgttctgtgtctctactggaaatgtagcctgggagtttggggttcacactttggctggattccagttcacactttggctggattccagtttacctgttatagctttgcagctttcattagctgcgcctctggttctttagatgtggactgtgaacgtgcataagtgcagggccaactcagctagaggtgagttatgaacaaatactaactctcagtactcacggaccgaggggatgctgaggaaaagccatctcatgagggaagacagcatgcgagaggagcagttgggatgggcttagaccagctatcacacggaccttccatcaagtgggttcttgacccgtgtcaagtgcagagtacaggcatcacctggagagggctaggccatcaggaagtggtacttcccaccagtgacatggatggaatgagacacgtaacgcacctggaatactaactgctatctggtagctcctgcggctgttatttagaaagcatctaaccctttcccatgagctcagactcatatagattctcctaaacacatagatacagccaacccatagaattggttcacatccattggttcagcatctacaaatccaagaaaccccaggtcaaagttttttttttttttaatgcatctcttctgaacatggacagaccttttcatgccattaatccctaaatagtaagcccaacaactctagaacatttgtgttgtgctagatatggtaagtaatccagagatgatttagaggatgtagggggttgtgggtgaattatgtgtaaatatgatgcatttcatgagtggctccatgcatccactggttagtatgtgaggggtcctgggactaaaccccatggagactgagtgatgatggctgtaattatgtgcgtccaagggaaactggaaggaaaacttttgcacacacacacacacacacacacacacacatatcaaaaaaaaattagatgaaaaaccaatcattagcaggttacataagaccatctgctgtcaagatcactggcagtggcgaacatgccaatatatccactcccaagaaggattttagaagagtttgtgctgatgagccttgaacaggccctcctgatcatttgttagctgaagcaatgcctctagaagggtctgaactctgaggaggaggagagatggactcattagggaagtaggcatccctgggtaagctgctgctggtagcatctcactggcttcaccaagcccagtcattaacaataaaacccaatttcaaaggactctccgttttcaaatcaagaaaaatagggacttagaaaacataagagacttattaagtaggtcacatgtttgtcttgtgtgctctttgggagagaggactctatggaagccattttggaattaaaatgtagttataagctaattgatccatcagcagctctttttaaaaccagactttaaataaggtatccttggaagccttggggcttacactgtacagattcagacagccagatttggcaagcccagggaattcgttacatgtcgaagtttcctgtgattctctccagctccacagagagtctcattttgaacccagaggacgggcgcatcctttcatgcaaacagaggcttgctacggagaggcctcaggagcaggagctgctgagatgcttaggttgttttgtccatactggggtgttgcgtagtgtttgagtgagcacatctcctgattgttgccagagagacctagtgaactgtacccactggagagaccctctgacctaagttctcgggcccctataccctgcgagcctgtcttttcacaacatccctttcctatctcagaccttcttgggatatgaggccacatcccacttggctgacattggggagcacagcctaatacatgttcattgcaatgggacctcaggctgtgtgtctaagcaccgatgcttggagggatgaggcagtcactctgggactttgaatttatttcactgaccactggagaaatatatactgactggaggttctcacctgaagatttgtagacctgcagtcttcagaaaactataggaacctacaaaggtccaattcacactagaacaaggcatggtcaccagctgcctggagtgtagtatataatagatgagaatttagggagctggtccataggctgtgaccccaactctttcttcacactggatccaacagcagttgtagtagtagtgaccggaggcaatgacattgtaatcaagaagtcagtgtgttaacatggctctcccttgagacgttatggaaaagtgctgataggatgttgttattgctgctgcctctattgctactaccaccccttattcaactacctctgtaaggagtatagggtgggaatcaggactcttgcctctgacctcgtgtaaaatcgcagggatgtcctctttacccaaccaggctgctttgaggaaccaaggagatgatagaaacgaaagagctttgaaaactgacaacattggacaagatggtgttcaggcagtggagccaacaacactgttgtagttaaatggtatcagttctcttgtaaccacatccattccccatgaaatgatcctcttagagaaagggattgatggagctgaaatggcaggaaatgtggggtccctccagactgcacagccaacccttccccacttaggaacccacaggtagcttgaggcccttttggtctgggctgactggactggatggtgcaggaagcagtgttgatagcttgcagccccatctaggtctgttcacagatagacctgcccacaaaccagctgtgagcaacccagaggagcccccaggaagtgcctgaatgccagagtcaggggttccccacaggggtgggacccaagtgccccaccaccaccacttccgggtgaataaaaatggtttctgggtgactcatctgactaaaatgcaaaaggaaaaaaaaaaaaaaaacagagaccattagccttactcccagtgagtcaagtgccaggcccaaccctagcattgtgctaacctcttatctcaggatgggagaaggaaatcaggaggcctggcccaggcctcccagattgccatcattcctctgtgaggaaaatcctcctggggcttgacttaggaagtgagagctccaaaacctaaagtaaggctcttgctgttgcttagggggcagaacagcttcttggggggagcagcaacttgtggccttgggacaataacttgattctctggggcccagtgcctctgtctacaaaagaaggtaacagtgtggttcagtacttcacagctatcttgagagctgctccaataaacctgcccttggtgactgtaacagcgcctgacaggaccagcctgtcccacacgtagcaattgtattaaaattctcacaaggatagctaactcctggttcaaacatgttactgctgatgatattgtgggtgtctattaccttattgttctcccccgtgggttgttgattttgatttttgttttgtaacatgccctcctgtgtgtccaatatctgtggcactgccctcaaaaggaggaaaaaattcacaccaaactgatgatagtgtgtcctatgctcctgtccttacccacatcctggctctgtcccctcccctccactccctcccctgttacccagcagccactcttgcctcccacacccttgggttcaagtccttcagtggtggggataacccttaggtccagaggacaacgggttctggggctcaagaaaaggcttgggcttgtgtcccagctgtgaggccagcttctgattatcctggatgcagtatcattggctatgtggggatggtagtgcttcctctgcacaaaggtgcacagcccaggatgaagtgtttggacttgaggaggcaggtggcagccattcattgcaacagctctgagcagcaggtagaggcggcctcttcccctcactgactgtgttctcagacaggttgcctggcttccttcaggttcagtttcctgatatgtctactgttatgaaagtagataggattactttgctgggtgagcgggtatgtatgaagtgtagacaataagtgtcaccagtatgggtggcagcagagtgttctacagagatgaaagccagagcctagctggtgtgggctgctgcacggggcttggttgccctgtcttcagtcaggctctgaatgctctccctggcctctcatccacagggctgtatgtgctggttggtgctggggccctgatgatgactgtgggtttcttcgggtgctgtggagccatgcgtgagtcacagtgtgtgctcggatcagtaagtagggtttacagggtgggcacggggtggattggcagacttccctggaaggagccaggagacccagctcctctaggacataaagccttggcactggatcctctctggtgtctgttttctccatctcctgcatgagaataatattatctttgttcctgcctcgtatggaaaatgtgaaaacaatgaggtcatcagaggaaagacatttggggaagagtgcttcagaattgattgttccttaagaaataatatttcactgtggatggggcagcttaaagatcctcacagccaggaaagaactgttatctacaaggaaagcatttctggttaagatcaatgacttagccaaacatccctctggtgccttattttaacccccagcttctgtttgaaaatgcaacaacaaaagcagtctctgctacctgctgctcggatgatgctctaaacactcaaggaggtgaggggcatcagagagatggctctggacttctcacagggggcctgaagcagggtgttctgaccctctcatttcccattcccagcagtctttgggttctccgtgtctgtctgatgcttctcatctatggctgtgtgaaatgtctgtttcctctcccagatgttctttctttctctaaataaagctgaaaaagctgtcttgtgtaccacagagctgagtttgttttatcacagagctgagggtgcaaatgggctaaataaattgaaagggtactaaattaatgacagtagtgttttctctccacagttttttacctgtctgttggtgatatttgctgctgaagtaaccactggagtatttgcatttataggcaaggatgtagtaagtaaaacctagaagtttttgtggttattaaggcagctttcttatggcaaatgatatagaatacccatcccaaaatgttaagaaacaaaataaccccccaagttatgtaagtggaaccttgaacctggtagtgtacagagctcataacgtatattagcagtttctagttcatgtataaactagtctatgtttgtttgtttaggatttccagtttaagattgttcctagttcaaaatgaggcaggcactaggttacagacaaaagaatggggcaaagaagaaggaaaaagaacccaccttctcatccttggcctaggcagggcctgccctgttatgagaagctaaatcctggactgctgcatgcacgtagcagtcctcagaacccagaagaggtcatgaggagagtccacagggcgttgagaccttttggaaggataagaaggttggggggcagagccttgagagggtcatatttccagtgaactcatgtgctgtctatactgggtgtgtgagcttaagtgtaaaactgataagcatgaaaactgagtgactgcactctatgggacattcttaacacagctccttgtacccagaggttacaagtctcaggttagctccacatagagctcaagcctgtggatttaggggtcatatgtctttgcactggaaaaagcatccactaagccgtgtgggacatctaaatgcagaacatcttccttgacagtagacacatgcctgcgagttggcagggaaccgtgtggtcatggagtccacctcatgtggctcaccaggatctcctacatgggcctagttgacagtgaagccctcctacaaataaccactcccaaaaggtggctctaatgttataaaacattcttggtcagtttatccttccattttcagaagcatctcaggacctcttgaatttgtgttttgctctatatgtgcagaggccttttaaaatacagaggagtgtgcggggaatcagcgttgccaaaggacacagaggaggggagtttctttgtaagatgaaaatgtctgcaacttcccactcaccgtgccctggtgtttttccaggctatacgacatgtacagagcatgtatgaggaggcctacagcgactaccttaaagacagggcaagaggaaatggaactctcattaccttccactcagcagtgagtaacttcttctctggcatcacattttctattggctatgcatgagccaggctctctaatcacctacattaaaataaaaataaataaaataaatggaaacagtagcctttgattttaactctgatgagagccatagtttgtgctttgtgtagacctttggctagaaagaggccttctacagattcacaagagaccaaaaagcatgagcaggacactgagaaagccacccaaatgtgtgtccattcttctcagaggtgacattgtggtgagacagaagcaagcatggtgactgtcttagttagggtttccattgctgtgaagagacaccatgaccaagtcaattcttataaaggacaatatttaatttgggctggtttacaggttctgaggttcaatccattatcatcatggcagaaagcaaggcagacatggtactggaggagctaaaagttctgcatcttgttctgaaggcaaacaggagaagactgacttctagaaagacaggaggagggtctcaaagcccgcccccacagtgacacacttcttccaacaaagtcacacctactccaacaaagccacacctcctaatagtgccacttgctgggccaagcatattcaaaccaccgcagtgatcttcaagccaggaaacctcagctccaggatgtctcttagcagctttgtgacactgagtgagttagtcagacctctctgatatctcttagttcactcctcatctataaaatggaggtcattgggagacaactatatttccttctagagtgttccatgggaatgtgctagagtactgtgcttagagctacatatagtcaagaaaggcttatagaggaaatgagccagaccaaggtcgttctgttttcttaagcactgcattttggagaagtcactttgaacttctgggccacatgtttcccggtacctggctctatatgacaagagtgtcttagaaggttccccagagagggcaagcagcacaaagatccctttgtcctaagcagccagccctgaggcagggtgcctatttgtcagccagcagtcatgcctgctcttctggccttggctttcccatggctcccatcctctcatctcagatagtccctggctaatgagcccttcccaaaactcataaagcttttgctcgtcagcaggtttctggacttcagtgtgatagagctggcatgggaggtcctgctcctacctcccagctcttcatggtgggcaccatcagttagctccttgccctaccctgccccaagtcacttcatagcataaaactgttgcagctttggagaagtcgtgtttctgggttgctagcacaatcctgtgattcttcctttgctctccagaaatagcagtttgggcctcagagctgctctgcggctttggcactgccagccagcaatgacacagagccctggggctagcactcctgcctcctgtgtcctaaaacctcttcttgctctctagtttcagtgctgtggaaaagaaagctctgagcaagtccagcccacgtgtccaaaggagctcccaggccacaaggtaagctgtttgttccagggtcccttccccagcccctacctgacggaggtttttgaatgttagtagaggcagggaggctcaggccttcttcccagggattctaggaggtcccaccgcttcccagtggaccctgagccttacccatgccatacgaaataaacagcaactctggcaggttcctcatactctgggaatgatgggtcacctgccagtgactatgccatgtgctgaaggtatatgaagtgagttcaccaggacaagagttctgtgttcttcacatctttctgggacagcacagcactgataaatttaactctgtcggggattctataagtgaaagagacaagagagtccctccctcagtggcttcatagctggtaatatgcaaaaagtctgtccagggaaacacggagatacagcagaattaggaaagcttgtgtggaaggatatgagtccttgacaaagggaggtcaagaaggcagccgggagaaggtcatgctgtgggagaacaggaacccagaggaactaacgtttctgggaaagacaagctggaggtttgagaaagccatcactctcagcagactgagaagcaatatggcgtttgccttgaaaaaaatcctctctccaggagggactctttcaattctgaggtgtagctaagggccttagatactcctgtgaaaccagaagtctggcctttgtgctgttagcttagagagccatggaaaggggttggattttcattttatcgagttttctgtgatggcaatgagaaagattgacggatgatgaatatcctgaagttgaggtgacccctttgaaaagacttcgctactccttgccacccacatgatgttaactgagaaagttggacggagtggagaagagaaggcagcattggagatcagagaccatgagaagccatcactgggttctggcttctccacctgcacagaagacggtgtcgttcactgaattaatgattggaggacagataaccagttacagagaaaagaaacactatgtgggctttttgagtgtcttaaagggtctgttttaattacacatatatggagaagaaagatgtagatgtgctatggatgtagctacccaaggaggccagagaagtcagattcccctgaaactgtaactacaggcagctgtgcactgcctgacaagggtgctgggaaccagactcaggtctgctactcttaaccaggggcctttctctagctcctaattcagtgttttcaacgttgtggtttggaaaatccgacatgtggcttaagagagacattaagagtatcgatggcttcttagagctggggatgtgcatttgactcaggagattctgaagaaaagaaaagcgtgaataaaagtctaagaaacaatgccatttaagactggacagaagggggagcaggcaaacagagacactgggaggaggaggaggaggaggagtcagactcgagggaagagctgcagaggagactggctcagtgtttactgattctgcctgtcaggcactgtggatacaaagatgaatgagtcaaggtcccaccaacaaggaacctactgtctaatgggagatggaaacactagcgttgacacagtgcacagtgggggtatggacagagtttgcgtggtgctccaagagcccaggagaggcatggaggggacaccagccaaagggttgtggggtagagacagagtatggtgtggatgacagctcagctgcatctgccaccaccaccctgagcagtaattgtggagtgtcagccaagtacaagaaaaatgagttcacaaaatatgaaatgcagatgactattaaacgcgtgaaaagcatgggcaatcagaagctatctgaaatgaaagcaactttaaatgacaagaccccattgtttaacattggccttttactaataacacaatatgggtgagaaagatgtgaaatgagcattttataaaagctggcataatggtcctaaagattagtgcaatcatgtaacccagagccttaaatgaactcaggctctttcatctagaaactcagagtttattctaaagaaagggaattttttaatgtgtgcaggagctggggagatagctcagctgataaactgtttaccacactagcatgaggacctgggtttaatcctttgtaccgcagagaaatctgggtgtggtagaactgcctgcgattccagtgctgggaaagtgaaggcaaatgatcactggggctcgatggtcagccatcctaccctaattggtgaaccccaagttccgtgagagaccaagtatcaaaagacaagattggcagcccctgtggcaaacacacacacaaaggaaaaaaatggaggaaaatgcagatagaaatttttgtgcagtggtatttattacaagacatatacattaatgaccaaatactgatttcctaacaggcaacagcaggatattgcttaaattatgatcctttcatagaatatgttttatggccactaggaatcccaatttcagaagtatttaatataaggccatatttttagtctcttctgttaagtgtgagagcacacagatcactatgaaagtgaaccgagtgtggggggtcggtccttttatgcacaaagaatcatcaacagtattagttttgatcgtagcagaggacagatgtttcttattttcttgttattaatgtctattttccaaatctcaatgactctgcattcccttgtgaataaggaaagccagtacatgttttataatttgtttttcacaaaagaagccgtctgtgaatggaaagacaggctgctggcagagctggaggcggggcagcagcaggagacaggttgctttgcttgctttagattgaaaatactgagtgagctagtgagcctggtgtcacttggaaacgttaatggagataacacggctgagtgcatgggaaggaagggaagagggtggctggcaggcttcctgagagagtgagacccagagccagagaaggagctaaccttccacagagcagaccgatgctttggctctgaggagaggaagttggaaaggaattcttgtaccttttcacactctctcactaccttcaacagagcctggcacagagggaaggcagtcccgagtcctggtgaagggggaaaggctggaagggctgcggatggactgtggctttctttggcatgccaggaactgctgtctccagcagtgctccaggctctcagcagaatgcattatcgttcctctgggggtctgcatcctctccaccaggcccctgagagcagaggaagctatatcttactgctccacacccaccaacgcactccagtggcttagatgagatctgcagaatcactaaatataaggggaggcatgagagtggttaccatttgctaactaacgtatgcggatgtcagaggatgctaaagatttgtgtgccctgaggatgcatctgggctgagagtacctctgtgtaggaagtctccaagtggaagtgtttgtcactgggaagctagtaatggttacagacagtcccctctgcctcctgcccagcttacctcaccttcctacccttccccgcctccccaatccctgaatgttcttccaacccctgattcacagatttcctaagggtcaaaggttggaaccacagcccagctgacactggaggaaatgctcttctgactcccaagacctggttttcctaaggattggttttccctaatttaatttgaccccatgcagacttttagtctcttaataagttatgtataccttacatagtcaaatacatcaagtgtataaaattccttttaaattgtaaatgacaaagaggaggttataatttagagaatatcgcattttatctttctttactgaaagtaagaaaaggcttaagttttggaatgccgagggggtggggggggggggagttgactagaaagttttgtagcaccatacttcagagctctgaagcagacctttggcctaaatagataatcttacccaaaaagagagacttgtgtttgcccgacactgtgtttctgcttcacagctgtcaggctgacgttacccatgagggatggtttgcacgtgagcagaagcttacacgcattaacttacagacccagatagcaaagggaaggattgggtcatgggatgtgtcacacaatcagtttttatggatggcttttttttttttctaaacagaattgcatcgacaaaattgaaaccgtaatcagtgctaaactgcaactcattggaattgttggtattgggattgcaggtctcacggtaagaaagttctagaatgtcttctttttttttaccttctaagaagcagtaaacccttacatagtatttctcttccaattggagatggctgtatctcataatgggtaaagacttttgttcacagtacatctcctaagaacaaagttaatgacatacatcagtagtaactatataaaatatgacacaaattccagtatccacccaattatgaccttgaatttgtcactgaaacaacttcccatgtaagcctgccgccataaccttggtaagtaatctcaattcacagtaacagaacagcaagtctcttcatctgagcactggcaggctgcatagggcaagcactggtatcacacaaactggattcacctcctggctccactactttcttataagccctggggttgaaggagagcgtcttaatttcccctaagcttctatagttgtagaatataaattttaaacataccagccttacaggattatgaaggtcaagtgggatactgcctataacctattgttacaaatattaattggcataaaatctgaatgtgttgcatttaataagtaccatctttctctatacttttattctgggcaaacctggaattcaagcaaagggagttatcacctgtaaaggagagaagcatgctctagcatcagccgttggtggctcagtcctttaacagcacaaaagaagagagtatgggagagagactggggacaaagctgctgttagagtgctttcctggcatttacaaagtccttgactcagttcccagtactgcacacacctgtggtccagccacttaggagatggtggcaaaaggatcagaagtttaaggtcatctcctgctatgtagtaagtttgagacatgcctgggcttgctgcatgagaccttgttttaaaaaatataaaaataaaaataaatgcatatgggaagaattggtagccctggacaggtacggtgagaatggcaaggaaggccatcaggtccacataattgaaggtttgttgtgctcttctgagaggcagaatatcaggcactgtgtttgttagggttctcttactgtgaagaaacaccatgaccatgataactcttataaaggacaacatttaattggggctggcttacagtttcagaggcttagtccattatcatcatggtcagaagcacagcagtaagcaggcagtcatggtgctggagaaggagagagttctacatcttgatctgcagacagcaggaaactgggtaccatattgggtgtagcttgagcatatttgagacctcaaaacctgcctacatagtgatgcacttcctccaacacggccacacctcctaatagtgccacttcttatgggcaagcattcaaacacatgaatatgtgagggccaaacctattcaaaccaccaaaggcatcttctaggcctgaaggacctgtgatgcagaatggatgaggaaagattagaaagagatgagagtgaagccagagcctagcgaagaaatgattactgaatttgagcaatggtagctagtgttaagatagaattttcttgctagtctatgtgtggattatctcatagtctaaaaggcagggctacaaggattttgaagaaatctacaactggtagttcttagggaatacccaaggacttttcccattctttatatccagaacacagggtgtggcaatgacagaaatactatgctgggccctccaaattcagggatatctcacagaccctccccaacaagctctggggctaacctcagcgcaattctacagctctctagtgatgagcccgaagtagcatcttagtcagagttactattgctgtgacaaagcaccatggccaaagctacttggaaagggaagggtttatttggcttacacttccacatcactattcatccttgaaggaaatcaggagaactcaaacagggtaggaacctgagtctggagctgacgcagagccatggaggggtgctgcctcctggctggcttatcgtggcttgctcagcctgctttcttatatcccccagggatagcactacccataatagtctgggccttcctctatcaaccactaattaagaaaatgacctacagccatatcttatggggccattttctcaattgaggctccttcctttcagatgaccctagcttgtgtcaagatgacataaaactagtcagcacagcaatttgaaaacattccacaaaatggaggtatcaagtagactgtactaacagttgtatagcatggaagcagccagccctgactcatgaccacagcgatctgagagtgaaggagtctctcagaaggaacccctcagactatacccaggatgggtggggggcatgcgaacctgttgccatggaaaaggagaactgctcttgcttgtctgtcttgagtcttgagttcctccaggagtttcctccagaggtcttgctccataaggtgagactgcagtgtaatcacttacccgaaggcccactgggtatctccctgccacacactgctattgggatcaggggctgacggcctgacatccttgctggctgagtccatatctccatctgcctctgccctcctagaataactcctgccttgatgcatcaaacatcctcagctcctcagctctcttagatggggctgaggagagatccagaggcatggcaccacattctcaaagcacacattaccagtcattattgagaaatcacagacagggctcctctggctgtgggcttgtagaggtgactgggaaccttctggtattctcttcaaaccacagggacagtggttccatccaggtactcggcatctcaaagaactatccaagagacagaagaagtcaggaatattatagctcaatcgcttttagaactactggcagttttttgtttttgtttttgttttttgttttttggatttttttgctttgttttggttttggttttggttttggcttgtttggttggttggtttttggtttttcgagacagggtttctctgtgtagccctggttttcttggaactcactctgtagaccaggctgacctcaaactcagaaatctacctgcctctgcctcccaagtgctgggattaaaggcgtgcatcaccactgaccggcagaactattgagttaaacagccacatatcatttgtgtaggaatggaccaagaatgaagggaaactgtttgacagggctccatggctataggaatgaaagcttttctgacacttagaccataagcacttttacgtaagaaattaagaactattttctgagtgagtaaaatagatctgagattcatcttaaatgtaaaattcaaaaaccagaaacatatcagtctttcataactgttaagaaccataagccagaaacagacagacagacagacgtgtctgttaggaaggtaacataggagctcggcaaagcggacacagacgtcttgcttagttgccatccttaagaaacatatgaaaatgtcatttacagccagtgttgttggtcagtaacttgaactaagcagtgccacagtgtgctgatttttatcgaatccacatgtgaaagttgctaatgagcggttctttctgttgcagatctttggcatgatattcagcatggtgctttgctgtgcaatacggaactcacgcgatgtgatctgatgatacttcatcaggaaaattgcaatctagagttgtcgtgctaattatcacaagagctctctcggctcgtttttaatattcaggatattagaagctaaaataattttctgtcaactgtatatttgcacatgtatgtaagtctgactcattactgatttgccccttgagtgaatgtctgtttctggtatatgcattgcacatactgatatctgtttcctgggaaaccctagttcttgtatgcaagaataacctatttaagtaccagaaaaaaaagcaatgagagatttttaaaactcggctattcaggaaatgtaataatgggtccatttctcagattttagccatgaaaattagatacataaagagaatgcaggatttctagttaatggaagcaataagatagaagaattgaagggccatagattgactgtgtctgagttgagtgtaaagatttcttgaaatatatatatatacatatattctccccagaatccagtaaaccacagttttagaactaaacacatctgtaaaagtaaatatagcatggaaaaatctaattcaaaaaagtcatgttttcttagcatttaaaaacagaaagcctctctctggaaagagaagtcacgcagacagacaagcatgtgccccagaaaagtgagtgctttaaagactaaaactaacaactttgaagggggagaaacactgctataggatgacatgcaaacgttgttttctccctcttctctgccaactctgctttgaactagtgaaggcctcgccttcccacaaggcctttccttcaccctccttactgtttttttcagatgtggtgacagaggaaagcaggcactgtgcagcgtgacagtgggggactctggctggcactgtctgtacctctggaatacctcatgacttgagtttacatactttcctaatatttttccatttttcttatttatctgtgcagagaattctttatagattaagaacatagttttattctttaaaataaataaatcgccccataactcagatattatgttatgagtaccctgtctaaaccaatataaacaccttcttcaatatgtatgcatacaacaaaggcaagttaatggatcaaaagtactttcgtgcatacagctgcagcacaactatattctttctcagcgaacccctgtggggatgaatagatgctcaggttctttgggagcctgagtgattgattttaagtggggaaacccaggcactgctcggccttttggcagcaagtgggaaaccccacagcagggtcgaaattgatgtatttgtcataatggaacagcgtataaaggagtcttaggattatattgaccacataaaagtgaaggcatgaggaattctggaaaccgtcaggctagcttctatgtccgctaagaacctaagactttggtatgtgctagaacaaagtgccatgcttcaggaaacttttaccaagtgttttgctgaggacacacaactcctgggatgtctcacccacagagcgccacctctctctttttcagatattcttgctactgctactagctttggagaaaaaaactgagggagttaaaagtataactgtgtatgactactttacctatgtatgcaaaagtatttaaaaaaaaaatcactctgtgatgtttataccccagtggttgacaaatgccagctttttaagcaaacaaagagtgatcagtccttcttatagctttagtttatctgtcttcctgaagacagagaacaggctcaagtgtgtactcaggttcctccagctcagagttatttcccgttcctcagaagtgagtttcattccctgggtgagtgaataagtttaaggaaaaccacagtaactatagacagaagagtaaaataattttttaatgcagaagaataagtctagaaacccatgtcctgtgtgattacctctctgagggtgaagctttccaaagaatgtgctgggtaaaattagagaattccatctttgagtaaagatggatatatatctttatgtgaatggataaagctatatctatagagatatataacccctatgtcctgaacttatacatatcttaaatacatatctcttaaggctaaagacatatgtaatttaatacatgtgtacccgtttgaaactatggagataaatgtttgtatacatacacatgtacatgtatatacatttacagttatttctgtttacctgaactaatttgagatcagacccaaacattttaagttattttaaattaaattttctatgtacttacactgcttgatttatcttaaaatcttagtgtatcttcttaacaagttcacattttcttatttaaatgtgttacctaccaatttacccaaacagtatagtaaaaacaaaccggtaatcctttcatgctgttgttgtgcagtgggttcaaaagcaacacccctagggttctaattacatatagttgcgtttcagctaacaccagttcacccaaattgtttctccttcctccagaaaaacttggttacctatggcttagcctttcgagttaatcctgggtccagtgtggttctcctgtaccaacagccatcgtttccctctgaggaatctaaccgatgtagctgggtgagaatgagacccagagaaagatgataataatctcaataataatcaataaagaagatagcatgttctcccttctgaaataagttttccgaatattcaaagggtatttgctctcttgtcataggtgaaggtggtttctatggcccagaggcaagccactagtactccccacagcccagctttcaaggccccactggcatgctcttgaacaccaagcccgtttccccacacccaggaaagagcaatttatgtctcttgagggtagaaccagcgtaagctcatctgaatcaagttggtttttgtgtggattttaaagactaaagatttcctactttctttaaatatcctccccccccctttttttttttactataaaaggtattttgtatatagatgtcttttaaaagtgaaaatactacagcaatacaaaatgttattgtttggtgtccttataacaagcaagggattcacagttcagacgctgccccctggaaacagggaagacacagcaagtacaagtaacatgccctgtgcttcccagagcttggctgcagaaatgtggagttaatacaacaggaacctttttgtgtgttttgtggtgtttatcctgtatattttgtgatttcttttactcctattaaacaacaaaaaaaaattagttaaagaaatttaaattgcatgttaattattaaataagtcaataaccaatatataagtacttacaatacagaggaactactgaatattagctgttataattatgttgatactctgacaaagaggtctctgggataaatcattttccaaaaatcatgcaaaactgaagattgttccacatgatcccaattagctttaaaaacatttgttgaactcattaataaccttcaatacattctccgattctgtcttattcaaaagctatatagtactcacaactgacatcagtatatttttctctgtgcctgctcttcataatatgtattctacatagtgtcagagattgtatttgtttgtttaattttttactgtttgaggctactgtcttagtgatttgatgagcccttaggataatattgacctggcaagtggagtttgggaaagcaggcctctattgctataagcaaatgctaatcattagccaagagtgggcccactcaaactggaaagagtagtcaggagagagacttccttgatgttggcaattctgacctgaatcctgaaaaaaaaaaaatcttacacactggccaaggtagagagaaaataaaaagtgtggttttgtgttctaaggaaaacacacaagaagactctgaaatagcacatgagaacattttaggagggcctgtctcaaactaacaattaacgagaaccctggtaactggtaatccgtgttttatacaagttttatttttgtcctaaagtaatgaagaaaattttaaacagtgagttattaactaaactttcaagtattaagacttttaaagataactaggatgaagaatgagattagatgacaaaggctagtcataaagtttttaactgatgcgatagactcacaccctcacagggtgtcacaacagagataggaagtgaagcatgagagaagaacctggacgaatacccaggcttctgacctggtggctgcgagagagatacacaggaggagaagcagatggtaacagtgtgagcggagatgcctacaggacatcaagaggaaatctgaagctggagactcagcagataaaaaaaaaaaaaagtacttattaccaagcctgagttcaaccctaaaccccatgtagtagaaggagagactagactccacaagttgtcctctgacctccacaaatacatcatggagcacacacaccaagagaggagaggagggagggggaggggagagagagagagagagagagaataaccctttttattttgttttttttttttttaatcttcattgagaaagttaagtttaagaaattagagcacttgttgctcctacagaggacccagatttggttcaacatggtggatcacaatcaagagatccaatgccttcttctgacctgtgggtaccaggcatatacatgctgcatatacatttattcacataaaataaataaatctaaattttttaaactagagatctctatgctagtaagttaaaatcctgcaagagtcatttagttgcccacatatttcttaacctcagacttgcaaatcaatactctctgcgctacctgtgttccttcagtagctgacaactgacatttaacctcacctctagtttgacagtaaagggaagctacaatttccttaaaggagaagccagcttcagataacggaaatggatacatccaaggaccaatcaatacaaacgcaagcttttacttagcagtgtccaaagaaccaacaggacagacatataaagccactatagatcagtcttttcttcaaagtttagaatcttcatacctagagcagctttaatttccccccaaaaaacagttcaaacctacattactatcaccagttaacgactataacatagattttgagtcatctttgagaaagaagattcaaacgaaaatgcatttaaaaaaaaaaactgggttaagcatcgtggtacacacctgtcatctcagcacttgggaggcaaagacaagaggaccacaatcttgaagccagctgggctacatagcatgttcaaggccagcctagactgaggcttcatctcaaagtaaaatggaaagaagttggtttcatcctcaacatgagaaattataaatgttgtagctctgtacagccctttggaagcacagaggtcaagacaagagttgtctgtatgttggagcagcaactagccaccatcaccctaactgaaactgcttcaaaggagaacaggagcagaaaccaagagaatgtgaagtaaacgagttcgtggctgctatggtgggctttaaaaaaaaaaactcaaggtgtgtgaggaagatcatagatgcttcccactaagaagaatcaaagacgagggaaaaacgcatgagaagcagcaagaaaagatgcccacctgaggggtggtattgggaccgactgaaacttgagccactgagccagccaaagcttttcaagtacaagtgtctagagaggatagtagggcttctttaagggtgatgctggcttcagattaaactcatgtgtaatcagggagtctgtttctcccctttgggctttcttattcccctctggcctggctcttttctcacatgttgtctgtttctcagagatgccaaagatggccactaatagtttcaaactcccaatctaccaaccccaaaaccaagcaatcctttctaacaagtgaaatcaagatctgggaatgactcctaaggggagggattgtagtcaactatatggccagctcataacctgactaccacgcccaactccatcagccccacgcagagcactgagaccaggagagaatcggcattcacctaccagaaggagggacgtgtttactaagcagccatgacagtggataaaggagagctgaagaaactgacaccagattgtcttaaaagacagaaaaggagaaattaactacagcacacaagaaagaaacatcattggaaaaataggctagagaggaagttacctcaatctttgtgttcagtttagacttgctactcttacattttaaagacacttttacatatatatatatatatatatatatatttaggatttcctattattaatagtaccatgctatgctgttaacctgcaatacattcattctggtacattctacttattctcaacgaatttgaccattaaagactgctgcagctgtgaccccaaatccttgagttatgaaagagctctttatattccaggcaagtaagaaaggtctttttttttttcctcttggagcactgagtttcaaagttccttggtgagaacggactcctttcaactttgcaggggatttaatgactacacctgaggaccgttcctgtgtttacctttctcccacattgcaagccatgattcttcctcttcccactttggagcctctctatgcattctccttgtgttaacccaaaaggacacaaaggtccctcaagacagagctcccatattgtcaagtgtatggactcagctaaggtgaattgttccgcagctcaacccctgagctccagcctaacgggttttgtgttttcgactgccccactttcacgtgtgcatctcccaatagacttccttcagtgatttctctcatgcagcccctcgaggctcttgtgctggtgacagtgcaggctggctataccatgttctgagctggcccccatccctgcagattcaggaaatttattaaagtaattcaaaaaacttaaactagaatctgccaaagctgggctgtctctaagcaacttcgtcgttctaaagctcacatcttctgacaaaagccaccttcagcatgcctgagaatcatttgagggtaatgccagctaggtttgaactttaaaatttttacacatctgtcaagggcctatatttgataaacaatcttaaataataatgtgcttattggtgacatgagaacactgggtcctggcctaaggcttaatggtcctgcaagtgtcagctttagattgtaaggtaaaagtagtgtagattcctggctcctgtaaggaagtgcacagttattccctcatccttggcaaagcgtaggtttggctctactctatctgcaccaccaccaccaccgcctcccctgtcgctctgtcagcctgcaggcactcacaaaacacccagctgagcttgaccaatggctatgcagcacagccactctaaatggcccgacctacaagtagttttcaacttcggggtgacaattcatggccgaataaaagatagtctttttgaggttgagcccacaggacatacttaaagttcagctcttgagaaggaacacctaaggatggaaaagaaaaataacccactgctaagcctatttacccaaagcaatgcctcactatgaatgagggcaaaggttaaaacaatgcaatccactccgttggatctcttagccctctctcttctaccccaagacctgtggtgattgtactagcgtttcgtgatagccaaagccccagagcacaagttgctttcagtataaatgctggaaagtatctcttattacttgagggactataaaggatttaggcttccacatgtaaaatgatcgtggcctcttttcgaggctttatacgctgaccttctggggtatacctttcaccggtcagttggcccaccgaagtaattaaattaaagagagcgtcggagcccatgctctcagctgagttttggcggagttttatgaagagggcttgagtgacgaagataaagttttctgtgccagatttcatatgttgtccttgtctcaccactgcactccagccctgatgctagcctctgaagggacaatgtttctagtaccctgatgccattgttcctccagcttctgatgacagtcctttcttcctggaactctgcagtagtctcacatttgctttctaggtcaagacagaccccctattgtctgtaaggagatctcagggctggcttgcagcagcagctagtgtttctgctttccattttacttctgctctgctctgctctgctctgctctgctctgctctgctctgctctgctctgctctgctctgctctgccctgtgtggaaaccatgacagcctcttccatacacctctgcttctaaagcttcgtaagctctctaatgcctgtgcggctgtacctatggattaaatggcaggcaagacgtctcaatggtattttattcgttctattccaggtaaacacatttaaccagattgcactgctattgaagttaaacagaaaatccccccagatagaaagactgcggcttggtgcagtagttggttctgacagcctcgtgtatgcagtcactgttgtcagtattacacttgccacacttgcagcttacggcgacagggaaggagaaataaggagtaacatggtgcgggcatcctggtatttccaccgttctgtagatgaagtctctgtatgtacagacatcctgagagagtgcatatttgggaagaaacagtttgccattgatatcctgtggaaagaaaagagatcttaacatgataaactccacacaactttagatagtgtaatagaaagaccacaacttactgatatccctttgtatcagtgatgatcaataaaggactcctgagctctgttacccacacatctacaattaacccatcagatacaaaaaaaaaaaaaaaaaaaaaaaaaaaaaaccaaaaaaaacacaaaaaaacaaaagccactttgttctcatctgcctttgatgaggacaaactcttcagagtagactgttacaaatgcacctgtactttcctttctgagtagagtcacaccattataattctgaaaacagtgtttggcttcccaaagaggacattatgatttatccccacttcctttctaaatattaacagacaactttaggcctatataatttacagctaaaagaaatgcattgaacaacatacccgtgtcatacaatacccagcacagatggtggtgttgatggtcaggcagtaggcacactctctcctatccacgtacattgtatactcagtgggaatacaaaaggatgctgcttgcccacaagcaagagcaaaaagcacggagaggaggacggcagcactcatgctgaatcagagagaaacatcaaagagctcagtacagtgtcctctccacgctcagaggcatgtctgtgcatatgtaaacacacagccaataacaagaacaggtaaaatatactgactggttacttatccctgggccctgcgtaaggtgcttttgcatatccagtcctctcaaacctcctcatatacgatcagatgcagctacgaccgtgtacacccataatacaggagctcacatcttagaagtctgcctacacatgccattgggctcccctgggaagtgacaggcgaatctgcaacatcactcagaaaactgacagctttctgctaactaagtgtgaaataattcatccaacagagctataataaaaggacttgtctttataagaagtaaattaattagtattctttaggaaggactttcccagaaatcaaagttcctaaaaatgttggttcaatcaataactcagttggttcatataattaaagagggaaagaaaccaaaaaaatcataagcaaactttgctaccacccagcaaatatgattttctctataactctacctgttgattgtcaaggaggctgaaaacttaagttaaaattgtgactggtgtgaactaataacacgagctacacggtcttttctgaatccttaggatattctgttagagtttttaaattttcacattgaaacaaaagatcattttatacagaagttgtatggcattcattatttaaaaacatagagagagctgggaaaattagtgtgacacatttagagtaatccaggcaagaattcagctccttcgtgggttgttcgattcattagcagcgggctgtatgggaggcagcagagggcccgctgagcagacccggcagctcagagagcctgtctgatacagaagctgttccgtatcagttaagcattgtaatgatctggggatgttatgacttattttggtgatagagggtaatcaaatttcagacttttagatgtaggttgatcaccattaagatgaaggagacttttgactcccttttactaatattgttcaactagctaggtatgtttggattgtttttcttctcaactatcattgttagtaaatatataaatgtataacatatatatatatatatatatatatccaccactgaagcaatattgatatctataagcatatggctgtttgtttattttattaaatgatcactattcgctggctggcaagaaggctcagaagtaaaagcacttgcagctctgcctgatagcctgagttcaattcctggacatacgtgacagacggagagaacagactcctccctggaagtcgtcctctgacctcttcatgcatgctacagtgctctccccaaataaatgggggaaaaaagcattttatttaattatcaaagaagtatcaaggttcaatctgccggttgtgtcagcaacagttttaagctgcgtgctttaaattctctacttactgaagccttgtgcagtctgtctcaggtaaccagaattttgtttccaataaatatataaacaaaaattatttacataagttactaaggatgaattctaaatgtctacttctatagctatttcaaccaatctcctattcctagcaccagaagtgccgaaattggatacacatgtatgtactgagcctctggagtaagcactagacattgtattgatatagtccttccagttcaggaggagcctgataagcacagatgtaaaacttcaggttgttctaagttctctgaaagttcaagccatgactctgataccccccagctagcaaagatttccttacatttgttacgtcatagacaaggaagtgaagtaaccgtataggaaaatgtatttgatagaaaactctgttaagaaggcattacatttgtaagcatcccttgcagtattttttaaacgtttgcattagaagggaaagcctaagaattcctggttatcttgttttatgctcccacaggggctggaaccgagactcacacacacagagccccagattcagctctataactaggacacactttccctgctgaaatcataggaattcctttctcagggaatctgattttggtcaagtgtttcataaaatacaagctccctctatagcattcagttggttctgttactttaatgatgcaagtctagaggattctctgaagaatcttgaaaatagcaaccaggtaagtgcgcgagaacactggcccttgctgctcatttactcccccgttggcttcacagatgtccactggttttcaccacagaaaacaacttctagatccacaattctatgtgaaatagcatatgtggtacctatagtcagaatattggctcggaacataaggaacagaaatctcccatgggaaatgggtaaacgcatgtaatcttatttacccacctgcaggataaaaacagatgaacatatctgaccctttgaaaccttgtaagactgggctccaagaatggctcaggcctaagatcaagtgctgctcttacaaggatctgagtgcagttcccaacacccacgtcaggcagctcacagtcccgtgtgtctccagctccaggggttggaggtggatgcttctggcctacacaggcaccctcagacacaacacaacaacacacacacatgcatacccatttttaaagtaataaaatctcctttaaattttttaatgatagaaattgtatggtaatttttctcattgttgtcctagtcaagagtgacactgttggaagacttccttttataattacagaagtttaagctaacaaacgcaaagcattaaagccgacttgatcaccagccacggttcttctagaacgctgcgaagacacaggatatgaatggttcctttttttttttttttttactatttttttttttattttttttttaattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttactccttgggtactttctctagctcctccattg

SEQ ID NO: 1688 - DNA, 742 bp, Mus musculus
ggaatcgggagcccgccgccggggtcgcagcatggggcgttttcgcgggggcctgcggtgcatcaagtatctgctgctcggcttcaacctgctgttctggctagccggatcagccgttattgcatttggactatggtttcgatttggaggtaccatgaaggatttatcatcagaggacaagtccccagagtatttctatgtggggctgtatgtgctggttggtgctggggccctgatgatgactgtgggtttcttcgggtgctgtggagccatgcgtgagtcacagtgtgtgctcggatcattttttacctgtctgttggtgatatttgctgctgaagtaaccactggagtatttgcatttataggcaaggatgtagctatacgacatgtacagagcatgtatgaggaggcctacagcgactaccttaaagacagggcaagaggaaatggaactctcattaccttccactcagcatttcagtgctgtggaaaagaaagctctgagcaagtccagcccacgtgtccaaaggagctcccaggccacaagaattgcatcgacaaaattgaaaccgtaatcagtgctaaactgcaactcattggaattgttggtattgggattgcaggtctcacgaaaaacttggttacctatggcttagcctttcgagttaatcctgggtccagtgtggttctcctgtaccaacagccatcgtttccctctgaggaatctaaccgatgtagctgg

SEQ ID NO: 1689 - protein, 247 aa, Mus musculus
ESGARRRGRSMGRFRGGLRCIKYLLLGFNLLFWLAGSAVIAFGLWFRFGGTMKDLSSEDKSPEYFYVGLYVLVGAGALMMTVGFFGCCGAMRESQCVLGSFFTCLLVIFAAEVTTGVFAFIGKDVAIRHVQSMYEEAYSDYLKDRARGNGTLITFHSAFQCCGKESSEQVQPTCPKELPGHKNCIDKIETVISAKLQLIGIVGIGIAGLTKNLVTYGLAFRVNPGSSVVLLYQQPSFPSEESNRCSW

SEQ ID NO: 1690 - DNA, 58952 bp, Homo sapiens
  misc_feature (1)...(58952): n = A,T,C or G
aaacccagcagtcaaaaactgctcgtgtttgcttatcaaaaccaaagttacgatagcaggcacaccgggcttccttttctagcagtagggcagatttgatatcctgaactaccttctcgactgaaactaagaccctggataaaatatgtaagaatgtaaaaataaaaccacatcgttgagctagcacaaaaggaagagaatctacaaaggccaaaatgaagtgaaagcaagaactcgaagtaagcaggcaccaaagccaccttttgccctgggtttcggtttcgacagctgcaaccgcttggggtttgtgaagtaaagcctaaaatgccattaatatagacagtgtattaggagacctcacccaaacctggtacctcctcccaaaggatacaccctcaagggaagagtagacaagaaataaacccatcatgcaaaagacgacaaagaaatgtatacgttttggacttggtgttggagtggggaaaatctcccctgagaccttgtcaccacaagccagccttcaaatggatttgttgtctgaattaacactatggtactgccttgagatgatttgcagaaggcaaagaaaatcctctctggaggaataaaatctcaactaaggactcaaagaattcccacaaatttccaaggaaagtaagcagtttacagctttaaaaaaatcacataatacacaaggaacaagacactaaaatcaatacgtagaaaagtccacaggcagcaaagtctgatcacagagagttcagatactagggttatgagacatataatacaaaatggtactacaactccacccttgcttattttccttgtttccaaatgcaagcccccatcagtgtctggttctcagtcccattctatttctgcagaaacactgctctcgcttttcttctccttcaacctctctctccccaggcaccttcccccaggactatgaacacatttaaatcttccccattaagaaaggaaggaagaaaaggaaaaagaaaagaagcttgcttccactcatcttgctgcaccactcacaactaagcctcttgaaagagcaattgttcagaatggtattgcctaggttgtcttccagggtttctatactttggggttttacatttaagtatttaatccatcttgagttgatttttgtatatgttgtaaggaaggggtccagttttaatcttctgcatatggctagccagttctcccagcaccatttattgaatagggagtcttttccctattgcttgtttttgtcaggtttgtcaaagatcagatagttgcaggtgtgcagcctctattctctattctgttccatttgtctatgtgtctactgttgtaccaatactgtgctgttttggttactgtagccctatagtatagttggaagtccggtaatgtgatgcctccagcttagttatttttggttagggctgtctagactatttgggctcttttttggttccatatgaattttaaaataattttcatagtcctgtggagaatgtcaatggtagtttaataggaatagcattgaatctataaattgttttgggcagtatggccattttaacaatgttgactcttcccgtccatgaacatggaaggttttctatttgtttgtgtcatctctgctttctttgagcagtgttttatagttctccttgtagagctctttcacctcctttgttagctgtattcctaggtattttattttttgtgtgtggcaattgtgaacaggattgcatttctgatttggctctcggcttgactgttgtcagtttatagaaaagttagtgatttttgcccgggtgtggtggcttatgcctgtagtctcagcactttgggaagccaaggcgggtggatcatgaggtcaggagtttgagagcagcctgaccaacatggtgaaaccccatctctactaaaaatacaaaaaaaaaattagccatgcgtggtggcgcgtgcctgtaatcccagctgcttgggagcctgagggaggagaattgcttgaatctgggaggtggagtttgcagtgagccgaggtcgtgccattgcactccagcctgggtgacagagcaagactccatctaaaaaataataataataaagaaaagaaaagttagtgatttctgcatattgattttgtatcctgacacttggctgaagttgtttatcagcttaaggagcttttgggctgagacaatgggattttgtatatataggataatgttgtctgcaaacaggaatagtttgacttcctctgttcctatctagatgccctttatttttttcctcttgcctgattgctctggccaggccttccaatattatgttgaatagaagtggtgagagaaggcatccttgtcttgtgccggttttcaacaggaatgcttccagctttttcccattcagtatgattttggctgtgggtttgtcatggatggctcttattatttggaggtatgttccttcaatacccagtttcaatacctacagaatgggagaaaatgtttgcaaactatgtgtctgacaaaggtctcatatccagcatctataaagaagttaaacaaatttacaagaaaaaaacaaacaaccccattaaaaagtgagtaaaggacacgaacagacagttttcaaaagaagacatacatgcagccgacaagcatatgaaaaaatacttaacatcactgatcatgagagaagtgcaaatcaaaaccacaatgacataccatctcacaccagtcagaatggttattattaagaagtcaaaaaataacacatgctggcaaggttgcagagaaaaaagaacatttatatactgtcggtgggagtgtaaattagttcaaccatcatggaaggcaatgtggtgattcttcaaagaactaaaaacaggaatatcatttgacccagcaatctcactactgggtatatcccgagggaatataaatcattctattataaagacacaagcaagcgtatgttcattgtagcactcttcacaatagcaaagacatacaatcaacctaaatgtccatcaatggtggactggataaagaaaatgtggtacatacacaccatggaatactatgcagccataaaaagaacaagattatgtcccttgcagggacatggatggagctggagggcattatccttagcaaactaatgcaggaagaggaaaccaaataccacatgttctcaattataagctaaatgatgagaacacatggacacacaggggagaacaacacactctggggcctataggaaggtggaaggtgggaggagggagaggatcaggaaaaataactaatggatactgggcttaatacctgggtgacaaaacaatctgtacaaataaacccaaggcacaagtttacctgtatcacaaatctgcacgtgtacccatgaacttaaaataaaagttaaaaaaaaagcacatttctcacttaaaaaagagaacaattgttatgacttcctcaccgctcattccctcctaagttgtggcccagcttacccagtccacccctactcttctgcagtggctgttactgaggttgtcagtgtcctaaggtactaggtcaccacatgcaatgctctcttctctcacctcctgctgctgaggcattttgcactgtggacactgcctccatcgagaaactcctcactcagcttctgtgacgccacttttttctgatttttctcctatgtctctggtcatttcttaccagtctcctttaagtgtcacatctcttctgcccacatcttaaaatgttgttgctctaaagtttctgttctcaacccttttcacactcttcctgggcatatcatccattctcatggcttaagacagccatatatctctgaggcatgcatgtcctggggatacaagaactctttccagaggtgctccaacatgaacagttttaagagaatcagtttcccactcattaacttccaggtgtattccttcctagaatcaatctgcctgggaatatgcctacaatcaagatatcttccacaagctaccgctcacccactctgaattgggtatatttccccaggttgtagaaatctcttggtcaccaatttgcaaacttgctgtaggtgctgagaaagtagataactataatatgggtaataaatgcctttgtaagttagaagggttccaactctatgctttcaataaaattgaagaaagggccagatgaggtggctcacacctgtaatcccagcactttgggaggctgaggcagggggatcacttgaaaccagcctaggcaacatggtgaaaccccatttctaccaaaaaaaaaatacaaaaattagccaggtgtggtggtacatggctcccagctacttgggaggctgaggtgggaggatcacttaagcctgggaggcagagaggttgcagtgagttttgtcatgccactgcactccagcctgggtaacagagtgagactctttctcaaaaaaaaaaaaaaattataataaaaaaaaaattgaagaaaggccaaatggaattttcagctgatttaatcattaaaaatagtttaatagcaagagtgggagcaagggcgggaggtgccatgttcttttaaacaaccagatctcacagtgaactcagagcaagaactcactcattatagggagaatgccatccagccatttatgagggatccactcccatgatccatacctcccactaggtcccccctccaacactgggaattaccatatcagcatgtatcagtgtgtgaattggggcacataattcagagggggtttaaagaattgattgtcattgctataaaaacatcttccatctttatctacttatttgtctaaacagagtttttcaacattaatatcaaaacaatgaaaaatattaagggaatttatggtcagctttgtggttctagcaataatattcgttcatggatatatgaactagtagaaaaaaaaataccaaccccatcaatatcattaagagatgcatttccagcaatattttacctttaagtttagtgactgtttatttaaaactatattttaaatttagtatacaattttaaccacttggataccaaaaataattttaacagtaacttaatctagaagaagtttgtccaacccgtggcggatggttttgaatgctgcccaacaaaaatgcataaactttcttaaaacattatgagtattttgtgattttttatctcatcagctatcattaatgctagtgtattttatgtgtgtcccaagacaattattcttctaatgtggcccaagtaagccaaaagattggacacctccgatctagaagaacttagttaacatttacagccttatggtctcaggggaaaagtttaatttcttttaataaacatagtaaattttgttcagacaagtataaaagggcattcaagaaaaatcattcaagcataaacatgcattaatttaggatgacattttgtaaaacggaaatacaagttcaaggagcaaaaggaaagattaaaattttcaccctattaaagaggagcttgctcatgtatttttaattatttatttatttatttatttttgagacatggtctcattctgccacctaggatggagtgcaatggtgcaaactcagctcacaacagcctagacctcccacgctcaagtgaccctcccacttcagcctctggagtagctgggactacagcgagcaccaccacaccctgctaatttttttcatttgttttgtagagatagagcctcactatgttgctcaggtggtctcaaactcctggactcaagtgatcctcctgccttggcctctcaaagtgctgagattacaggcgtgagccatcattcctggccttgtttatgtattttttaatcgatgataataggtagcagatcatactggcattcagtttctactggatgtattaaaatgagtaatgtggccatttgattttaaaagtcaatatttaagacacaccagaaatgacatctctgaaaatattcaaacttataataaataattttacctgtaacttaaaaatgtgtgagggtaatactatacaatgccatttatatgaaggtttaaaacaggcaagtgtaatctatagtgaaagaaaatcagaacagtgtttgcctttaggagggatgtgggcatagattgactgggaagggttatatgaaagcctgaaagcttcctggggtgacagtaatattctatatcttaataggattcggggttagaaaggcaaaagcattgtcaagaattattaaataatatacttaaaatgtgtacatttcattggggtaaattttagaaaaatagtaaatagatatttgaactctaggtaatgttatgcatgctcaagagtttaggagtgaaacatactgcctacaatttatttggaaataaataaaaaaaaatagattgagaaatggacagatgtatagataagtaatgcaaccaaagcaaaatgtttattgtagcatctagatggtgagtatatggtgctccttgcccaactatttcaaattttttgtacgtttgaaaatattcataataaaatattgggaaaaaatgcaagagaaaatatttttgtaactattttagggcatgtgtgggcaacagttttaagaccactggcttctatttatcaccatttgctgaagaatctttaccctaaacttaccatccaaacctttctccagaatccaatcatatttccacatcatctggatttcccaccatatctaaaactcagcagatccaaaaatgaatgtattgtcttccctctaccagtcaggaatatctttagctacatgtaacaacacaaagtcaaacaaaaagagggttatttttcctatataataagaaatgtggagttaggtagctgctggtattggttcagcagttccacaatgtcctagctggaaggtctgcaattgtcttgccctttcttcatagtcacaaaatgttctagcacttcaagcatcatgtctgagttcaagacaggaaaaagagaaaagggagcaatgccagtgacagtttaaaggctaacttccttattatgtcatttaatgtagccctgtactttcttatagtaatatacccttgaaaatgtatgggatgcctttcaggcacaatacatacatatatgttgatgatggcaattcctcatgttggaagtgggaccttgtgtgaggtattggatcggagtggatccttcatgaatggctggatgccatcctccctataatgagtgagttcttgctctgagttcacatgtgatatctgattgtttaaaagagtgtggaactccccacttcttttgctcccactctcgctgtgtacacactggctccctgtgaccttccaccacaactgaaagcttcctgaggcctcaccagaagcagatgtcagcactatgcttcctgtacagcctgcataactgtgagccaattaaatctcttttctttagagattacccagtctcaggtactactttgtagcaacacaagaatggactaacacacatgcgtccacacacatacacatacatgtacacaaaaacctaaacctcaattggcttcagaaatggctaactcagttatggcgtaatatcacctatgactctggttttttcaacttcctgctttgctgttttcaatgttggatctctcctcaggctggtatgaagatggatatagcaactctatgtataccatccagatccaacagcttcaagaggaagaagaccatctggcccctcagtagacaccactcccatcccattagtcaggatgcttgtcaatttgtttcctgaactaactacaagggaaatgggattaccttcgcctattcctctcaagggtcagcttcccttaagacatacaactttgtgaaagggcgactgggcaagtctatactaaagatctgaaactgttatgttggacaggcaaccaccatctgtctctaatacatgtgtgctaaaatcgtagcatgaaaaaaacaaacaatagatatatatgttacaataggggttctcttccctctatataatctctagacatattttgtcttagagatgtaaaattcaacgatatatttaaagtataatatcattgttcattcagttgatttattgaacgccttctatgtaccagacactactctttaacttagttcttttcctttatactaaaacagaggtgacagatatagaactataagtgtttgattgaagctaatgattcacttctctctgcatacctaatgacttccatctttgtctttatttcattgttggagacatgtttattactagaatcagcactttcatttttctgtctttgactcgtttttataaatgagtcgatattcaaacaaatgtccaaagacacagaggtaggcaaagatggcaacatggtagaaactgaatggttgactgataagagtgtgatacaataatactaacccttatgcagtacttaatctgtgccaggcactgttctaggcacttcacaaatactaactcatttatcttcacaactctatgaggggagtactattacctccatgttgcacgtggggacactcggggccgatgacagtttggcacattggtcagccgactgaaagctgtgatttggcctcctgccttcctgactcactccgcccccaccaggcttcactcgggctaactgcggttctcagaactcccttggaggccttgttctctccagccctgtgcttttgcgcatgctgtcttcctggactgatcttttccgcctgagctccgtcttctagaccagatcaggcccctctccttagcaatgccttttctggttaaggcagtcaggccaggcacacctgtctagcacccagcccttctctcctcaccctatttgcttacagatctgtctccaacaccagagactgtggttctgggcctggctgtctcctcattgttgagtccctggggcttgctactatgtctggcctataataggcactcaaagttttgctgaatttatgcataagctctccgaattttgctttcttgtctcccccatactgtctgacaccacatattgtagacacttagtcaatggaagtgggagtctgattttcctgccaacagcctaacttaataaaaacaaagcaaaacaaaaaccgcccccttcccctttctcccatctccacatcataattaagatcccgaaaatttgggatccttccaagccctccgatcagtggaacccggcaggacatgagaagtcagactccctccactggccggctgggttgagggcagcccacaggactcagggcgccgcctcccgcaccctctctcagttcttgcctattaaggtaagagtcccccgaggaggggggaggggccggagggagggtcccctagaagctgcttgtgtgcttgctccgcgccgcggagccgcagccctggacactcagtcaggtgccccgcgacgggtcctgccagcttcggggcaacctccgaccccacttagctcttctacccgaggtcaccttcctagatttccatagccacgagaccaagtgcttatccctcaagcatcgcccgggcctcaaaccggtctccgcacagggcgctgattaaatgggtccccagtccccggtgggcgctcccgccctgcaggtgctccgatagccggcggcggtgcgcccactggagggaaggaaggtggtccctgggtccgggagaagagcgaacgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggggcctgcggtgcatcaagtacctgctgcttggcttcaacctgctcttctgggtgagaccaggagccgggagggccggtcagggcagggggccgggtggcgggcgcggggccagggtccccgagctgctgactgcggcgtccgagtcgcgctcgtggggagggctgggtgctcaaacgcggaggcgaggagaaggcaaacaaagagggaggggagggatggaagggagagaacgggaagacagaaggttgatcaatgagaaatggtgagaaggggagagacaccgtgtggctctttcctggaaggaacccccacctgccttggtttttatctcccagctagtgaccccaggtgcggggacccagcctctcctcacctccggaggacttggggccctggcggtccctgttcccctccagcctcccgtgcacacacccccttttcactctgcctaccagctggaaccagggcctggccagggtgatgggagagaaacccctgccctggggctgcctggggtggtgctccattcgagtgtgtggacactgtacctggctgtgatggttttgtttaggaaattggagataggagtgaaaattgtggtgggggggcgtcgtcctttttctgggcatcagggtaagggtacccctgggtgagaggaggtggtgggttctcttctgagaaggggatggggaatggaagggcttctaaagggcagcagcagctctccacaacccccagccgcagcctctgctaaatactaattctcccagagatgatctcattcaactttgcagggtttgattgaactgacggcgttcccaggattcatggttcacagagagataggatcttgacccttgtctcctatattatcgagacagggatacagctagaccagacctacatccctggataccctgtcccagggcctgcaggactgtgagacaaggtctgaaaattgtcttttctgcacatttcctcttgggctttcttaagagaatgtcagccagtgtaactgctcagctagaccctgaggggaaacattggataaagaggtttgagagcagccagggcctgggtgctttgaaactaccaggttggaggaggtggctgtcctatccgctctgggggacgttgtcttcccatgattgcaactaattaattattgaatgatgggctcctcttttgtctgtcaatccattagcccagatgcctgggtgacttcagcaactccaagctcttcagtatccttcagcagtggaaggtgtgaaggaggtacctcctcgacatcccctgaactttaaagagacacatggcctttgtacacgtggggatttacatcaagcatactatagggagaggcgtttctgaagaccctttatgttgtattttttaggaatctggcttaatttcagaagctgttaattatagatgtcacgccacagtgacaaccttcattctcactgcttatgaattcaaagccttatgaagttttaagcctgaggaggaattcttaagctgggttcagtgcttatttagtggctgatattgtaccagcctttccagtgatagctggaaggattcattgaatgttttcaatgtgtcagggacagtgctaagcatattactttcattattacacataatcctcacaagagtcctgatatacatatactattattatccccattttttacagatgaggaaacaggctcaaattggttaagtcacctaagatcacacagctagtgagtggcagggatggtattcaaactcagcctaccttctcttttttttttttttttttttgagacggagtctcactctgtagcccaggctggagtgcagtggcccgatctccactcactgcaagctccacctcccagatgcacgccattctcctgcctcagccgcccaaatagctgggactacaagcaccctccaccacgtctggctagtttttttgtatttttagtacagacgggattttaccgtgttagccaggatggtctccatcttctgacctcatgatctgcctgcctcagcctcccaaagtgctgagattacaggcgtgagccaccgcgcctggccgcctaccttctcttaagcactgtggtacattcaattaaccagtggttctcaaaagtggttcctgggccagcagcatcagcatatcctgggaatttgtcagaaatacaaattctcaggccgggcacagtggctcatgcctgtaatcccagcactttaggaggccaaggcaggcggatcacctgaggtcaggagttcgagaccagcctggccaacatgatgaaacctcatctctactaaagtacaaaaattagccgggcatggtggtgggtgcctgtaatcccagctacttgggaggctgaagcagaagaatctcttgaacccgggaggcagaggttgcagtgagctgagatggtgccacattgcactccagcctgggcaacaagagcgaaattccatctcaaaaacaaacaaacaaacaaacaaaattctcagctcatcccagacttgctgaatcagaaactctgggggtaggatccagcaatctaatttaacaagccattcacataattctgatccatgctcaaatttgagacccattctgttaaacaatgattaaacaaataataatttataaatataaacacagttccctaagctgctcatctcattgaggaaacgagaccagtggatatggaacaacacaaaaataagacagtgtggaatcaagtgacaagtttcacactgttgaccgtaagcacagtaaggaaaggaagtaggagcagtgcagttttaagtgcttgaatgtgttaaccagtgaggttagatccgaccttctctatatgtgatctaagtaaggagtttagagaaaggatcacagtcatgatgaggagccagaaaagttctccttaagaaggagctattcgagctaaacctggaaggactggtagaatggagctgggcaaagcgagggggtgacgcaccatccaccagcagaggagcagagcaagggggagtgtgcgccaccatctgactgtcgaagccatcaggctggagtgcagagatcccaagcagggcgtgcctgcacaaacagggtgtacttgagcaagttattgttacttctaggcttgttttctcatctgtgctattggagtaacagaaatattgagaggattaagagggaatatataaagtatgtgacctcaacttcctatgagcctaggacatagtaaatgctcaaaaatattaattattatttttgttatcggcacataggaagcattcaataaatgttagctctctttctcctgattcctttcttggtggggaatagtatataagtttgccaagtgacttgccatttgtcttcatttgaggataactacaccttatcttgtcaatttgtacttgtggattttccccactagaacttaaaacactctgagagcaggaattttgttttttctgttttgctcatagctgtatccccagtgctagaatagtgcctagcatatagaaggcatgcagtaggacatgaaggaccttcctctcccccagtttcatggggggtgggggtggaggcagcaactagagcgaagaggcaactgaaacaggcacctcatgacttaagggaaagtgtgggataaagtatctagatatctgccttcactgtaactgagggaacctgattccagaaaagccccactcaagtttctaaagttgtttttttgtggttggagggcttcgtgggaagtttgggaaaggggtgggggatagttttcctagaaggccagactttagctgtgactgaagtataaatttacacacacccttagaagctcatgtgcctgcccctcggagttacggggttccttgggtgacagcacttccttccaatcagaacctcgccagaagtaagcatagaggtgggacaggttctgtttggtgatctgcgatttaacagatcaatttgcagcctcctctggcagcttgctttaagtttccctaggctgtgctcctggtttcataaacatacaaccaggccctgccagagccagcacagtattccctggcccagggccgctgactgtactcaccactgaatttttaaaaacaaaataaagcctagccattaaccccactacattaatttctcttatcgtggttgatgtcaaatgtgaaacccctcccaacatctgtcatgtctaaattcagacctgcgatcagatagcacagcatattcctgtgcctttcattgaaatcacctttttttttcctacgttgcatagcaatataaataaaacactacacccccaccaagccgcatatgttggcttaaaggaaaacctgggcgctgtttattccttggtttattgttgtatggtcagtgttttcctatcattgtgctgcactagctgctcagcgttactgacccacaggaagcagagctgttcattgttgaaaagcagattccatatatggcaagtctgaagttgccctcctttccttctcaccattattaatacagctttgggttttcacttggggatgcctaacaggtacatttaagaaagacagtgtcttgcaggcttgggagtcaaagaagtttgactcacatgaatctcatagaggtcaccttccactctttcccaaacttatttcaaacagtaacttcagagcaatcacctgtcagagacattggtttaggaaaaaatacctaaagaaagtattctttggagaccagcccataaggcagataggaatgttctcagcctcgctggaggagaatcttcatttctgatttttgtcaaggtggaaagagagtaccaggggccagtgtcccctagtgtggacctagaattgctaggaggaacagatagcctacaagaggggacagtctgaagaagccacagctatggtgccagggttccggtagacctcggacagacctatgcagcgtggcagttcaaatccaggaatccaaaacctgggcagtggatactgacatcatactgcctgactctattcctgcctccactctttactacctaggggactttgggcaagttgtttaacctctttgagcctccattttctcatctgtataatggacataataaactactaatatctgtgaactttgtgcacataaaatgagttaatatatgtaaggttataagtatggttcatgcatacagtaaataataacatatcagtaatagttgtttttaaatactagaagtacaaatgggaaagtagaatctagaatccaagaggttcataaagtcacaacaaagcaggcaggtgttttacatccagctaagcaagcaaggtagcaagaggcttggagtttatcaagggcatggagtcaaaaggagagatcacttcctccaccgttccctgccaagtgctgggaattcaaagatgattaagacacagcccttgatcttgaggcactcatgcctttatttagcctccattttgcctttgattagaatttattccctgtttagtctttgctccttgagggcagggactgtgtccttttggcatcccctttctcccaatccctcagtacctaatagagttaagcatggctccagctaaggtagttgtgtgcactgaccctggagcaggatctgtttatttcctttcccacttctgtgctactaagtggaggccaaggaaaagcaatgggaaaacctttggtgatcagtgcctctcaaactttaacgtgcgtacagatcacatagggagcttattcagctttattcggattcagtgggtctgcatttctaacaagctcccaggtgatgctcgtgttgctggtctgggaacatgctttgagaacccctgttttagatgtggcctgaagaggtcagagattcagcagtggcacttgtttctgactgaagcagggtgtgccctgcttcttggcttactcacttggcttgtttttggcagttcttttaatttcagttaccactttacctttattaagtctcttttttacgctaatacttgatgctttctggaattaccgggaggccacctgtccattgttcattgcatttcaccttgttgttctagaacatcagccatgaagtgtctttgggtctccaaccatgtgtgacaaaagagaacgtaacctctatcccccaaccttgacagttaatatcgcgaagctgctcccttaaaacaagtgatgctatactgagcactgaaacaaatcatgtcatggttgctaaggaattaaagagagaatgctgccagcaagatggaaataccagatgggctgggagcacatcttacagatgaattaactcgggttaccttggcctgcctttttcatcctctttgaatttgattgggaacaaaaataacaatgcttcagtttacgaagtgctttcatatgcgttatcccacctgatcatgaatcacaacaatctcacgaaatagtgtaattattcccattttacagttgtgaaagctgaaagtcaggcacagtaggtggtatgtcccaggtcttctgactttaaaccccatgcttttttcattgttttaatttattggaacgtgtagaatataaggtataagaaatgctgctaacttggaaaatctgaagcctgtgatcagggagattatattcagtgtcagatttagtcttgatgcattccagaaacaggtacaaagagatgcctaaaaatactaaggcatatgggagaagaagcaggaaggagagaggttgggaacactgctgatcagtttcaggcagaggaaaagtaacatggaaattgagaaagggtatatatcaagagacagtttaaaaagttaatttcaggagcaaaaacttgaagaatagtaagcactatataaatgtacactatgtgccagctgctttcctaagcatttattaactaatttaatcctcacaacaaccctatgaaatagtagcagttatcatccccagtttacatatgagaaaacagaggtctgaagcattgaagagacttgagagctggccagtggcagagctgtgtctctatgtgtgtccccagagtctgtactcataaccactccaagtctacagactatcggagaggaaggttgaagctctgacaaacttgtgaattctagacctgcactgtccaatgcggcgactatgctactgatcacatgtagctatttaaattaattaaaactaaataaaatgtaaccttcattttctcagtcccactagctacatttcagagctccatagccataggtgcctagtggccacaacgctggacagcagagatataggacatttacatcattggagaaaggtcttcttgacagccctagcctaaatatagttattctttcactcataaatatatctattcatatttttctcttatggggtcttaaaaacattaaagagaggagacatagtttccacaaaaggctactgactttctagtatagaagatttagaaaaccgaaaggaattccagctgtcatggaaagagggagtgtggatctaaaataaaaattagtagaggacggctgcagcaaaccacattattggaaccatgggagcgatgtttcctatcttgaagattaagcttttggtttgaaggtaacattagcaagtctaccaacataatagcacaaagtgtgaggcacttactgttctcagtgtgtaacatgaactcatttagtctctttaggaggcactattattaccttcactttgcagatgaggaagctggggttagagaggttaagtggcttgcccaagattataggaccagtaagtgccagagtctgattcaaacccaaatgcgtagaacccccatttttatccactacaactcctttacacctacgtaccgtatgcacgcatgtgtttattaccctaagggcatcattatatattctgaacacccagaagaggtgaatttctagaagaacagttggcagatattccaggatgtgtaccaagctctgtcctccacatcgtaatggtgattgggaaagagtcagcttattaacaggggtggcagagcaaggctgagcagggccaggggtgcattggaagttgctgtcactcatccaggaagccgactttgtctccctgctcccgccagagtctatctagccttctgtgaatggaccagtgctgcaccttcctgacctcaaacaggtcctggtaaaatggcttttaagaaaaatctctatagagcaccaagctagactttcacaatttctgctagattccacccatgctaacttcttagtaaacaaattgttttggcttttctaatctagccttagttccatttgaaacatttttttaaccactgtcattctgtaacaactaaaactggatgaagatcattatttattgatcaataattaagaattgtttatctgctccaaagtagttctcccaaccactataaataaatattgtttaatgtgttgtctttgcttatgtaaagctctatatagatgagatgtcacagtagtcattgtggcctccaagataagtgattatatatgcagagggcaggcctaggatgagagccagctggatgttccaaggaggaggtccgctgaacctagaaaagaccatttttttcctctccgggcttatccccttgatgaggtaagtaaggcagacattgagttcagttcacttctgtgacttggtagaccagattttagttctgtacatatttgatcttcatttgagaaagccatctgctccctggaatccttagccagtagtctatgacatttcattttgctgtatagtataaagaagactacataggctgggcatggtggctcacacctgtaatcccagcactttgggaggctgaggcaagaggatcacttgtgcccgggagttcaagaccagtctggacaacaaagtaaggccccatctctaccaaaaaatagaaaaaaatagctggatgtggttgcacatgcttgtagtgggaggaggaggtgggaggatggattgagcctgggaggtcaagactgcagtgagctgtgatcaggccactgcactccagcctgggcaacagagtaagaccctatctcaaaaaaataaaaagcaagaaaactacacagccatcgtctttctcctaattcttgatgttccctaatctccttctccttctccctgtattgttaagagaaaagacattatgtataatcaccaaataaacaacacattttccactgtctatatgtaaattatctgctctatcatttgcagcaagcttttcatcccaagttagtttccttcccctgagcttatatttctccagcacttctaaactgcccccagcaatgttggttgacccatgcaagttaactttataacaatttaaacaaactgaaggtgcatctggcacaaatgtatagcccagtgttctttgcagagatgaatggaacactcctgattttattgtggcctgaattgcaccacccttccatcactgcagagaattaagcattggtcaattataaaatatactcttacctgaaggaagtttttcttactgtgagctttttcttaggaaatggcatgaggaaaataatggggagatcagaaacactggtacctaaaggagctgccatgcatttccagactaacacagccttctcatcgccacaggctgccacagtcctgcctctcagttcccactcacctggtcctgatgaaggccaaggtagtgaggtccttcggagaccatttgacatagatgtcatatggcattcaattcttgtattttttctgataaaacccttgattttgaagaaatgccatctgaatccttgacttgcttttactgcataacagaataaaaatcttgggagctggttttcctctttgagaaaattcagatcatcttccagagcaaatgtgcttctgacttttgcctgctaagagggtgagactccattacccttaaggtatcataatggggtttacaatcagatcaataatcataagtgctcattatgtgattccaatggggatgagaattgccaccaagagcaagtattagcttaaaagcatttaatgaaaattctagggttgaagcatcatttccaattttgtgacttcatcccaaagaagagaattgcaaatgagttggtattcaccctggagaagcaagaatacagaattgattttgttcattctttcatttgagtgcagcatgcgcgtgtgtgtgtgtgtgtgtgtgtgtgtgtgtggcgctataattgtattgtgttcatatgcccctgccagtggaaggcatgtatacattgtgtagatttacattgtgtagatttattctttgtatccgtggatggtacacaacacacattcctgcaggcttaggaaaacacagaactgatactatgtgctctacttttgttttctgtttctgaggcatgtgttttgctgagcatattcaacagcgtgttcacacagtgccttcgaaggtatctgcagtgtttcccaggtgcagatgagtttgaaaatagcactttgtgaagtattcccttggagacttgtgaaggaggttgttcgcaattgctcctgtcagcctgtcttaatcagctcaagctgacattttaaaaatataataccacagagtggggtggctgaagcagaaatttatttttcacagttctggagactagaagtcagaggtcaggtgctggaggttggaagtcaggttggattctggtgagggctccctggtgagggcttgtggacagctaccttcttgccatgtcttcatatggtggagagacagaaagcaagctctctggtgtctcttcttataagggcactagtccctcatgatggccccaccctcatgacctcatttaaacctagttacctcccaaagccccaaccccacatatcctcacactgggaattaggcctcaacctgtgaattttgcaggttggagggatacaattcagtctatagcatctttgtgaaggtcctccattcactcatttagcaaatgtctattgggagcccactctgcagggcagaggggattatgtttgggaaacagcaatatagaccctgtccctgccctcacagagcttaggccttaatttacaaaatatgggcatatttaagtagaaaacattatgtgagatataaaagaaggtacctatctaggtcatggtaggcttccctgaggaattaatgttagagctgtgaatgggtgtcagctagggggaggcggaggagggaacagcaagaacagagacctccacaggggcaggaaggatctgaaactgtagctggagcatctgagggccaggacctgtggttcccacttaggtatcagtgcacatgctgtctagaacttccctaaatgatgctttttacccccaaagggggcttttttgctggacttagtcactagaaagtggatagcaggtatttgctcttggtgatctggttggctaacctccaggaaaaggaggacagctgggcagactggggaggccagaatgaggaatgatctctgcattcttgcatctcagcaccaccccactccaaccgcagcgcctgcctagggaccatgtttgcaatttgtgaaacctgtctttttttaaaatgaaaaaatatgtcctcaagataggacatctcatcagcaatcccaggaaatggaagtaagtacagtaaaataaaattgaaatctattagcaagctctgcttcatgcacgatgacttttttttggcagatagccattattaaagaaaactttttgtccatccactttgctttaaatgctttctaatcaagttttcagtccttcttctgtttcttgagttttagaacacacattgttttcactaaagacatatgcttacaatttgcaatttcgtgtcctccaaactctctggaatatggttagctactgaaagaacttgcccaagacaatacgtactataaccatatgtgatgatcccctatttaatgacttggaattattgtcactatctattcctttccctgcattcttatcttcttttttttttttaagtatttttcttgtcctctttttaacagttggcacactcttgcccttaaatactattttatcacattctctgagtacctcacatacaaccggtcctcagaaaaggaatgatgaggctgggcacggtggctcatacttgtaatcctagtactttgagaggctgaggtgggcagatcacttgagtccaggagttcgagactagcttaggcaacatggtaaaaccccatctctacaaaaaatacaaaaattagctagtgtgatggtgtgtgcctgtattcccagctacttggagggctgaggtggtggatcgctagagcccgggaagttgaggctgcagtgagctgtgatggcaccactgtactccagcctgggtgacagagtgagaccttgtcaaaaaaaaaaaaagggagggaggactcaaaaaatggtgctttctggcaatttctcatgtgcattctggtgggctgcctctggattgacttcccacctgcagggttggattccctcctgggccacccagtggggattagcgtctccttgagccccagaagaaggactggactttcctcatctctgaaaccttggcttctgactcatagtagttgctcaataagtgtattttaaaggattaacatcaaagtccaacttttgcttctgtatgaaaaagtccatttccagaaaaacaacaatgtttctagttgtaattgttccaaaggcacagggattggcgctggtcctggaagcagggcagccctcagcaaagttcttcaatgagtacagtgagttcgtagttctcacagctctccacgtccactcccctggtgtcctgtccctggtcctcagccattcaagcctttccctttggctccctgctatgtctgacctccaggtaacattcatgctcctgatggtttccatcaaagtgtgggcttctgtccctcctcccctcaggcagaccttgctatgggctttccaagatggtagcaaacaaagtagaagccgagtcatggtctgtcccacaccctctcaagccccaacctccgacctccccaagactctccttaaaaaacacagcatcgaggtaaggaaatgaacctctgtactaccatctctgcctggaattcgcctctgctgccagtcgttccttgcccagtgacttctcactcattcttcaagatgtaaattaaaatttaatgattcctcctgcatgccagtggctacagtttgctccaatcccttggcagtgtgcatgctgttcctcttcagcacacttcctgcattatagtgcacttagtactttatgtgactatctaccacattagactatgaaccatgtctttttcatcatcgtttccctgacactgagcacagtacctggcctggactgtagtttattcttaataaacatgcaaggaagaaagacagggaagggagatgtggctgggggcagaagaaggaaaggttaaaaaaaaaatggtagcctcccatttcttatttgttttaacattggctgaggtgcaatgttatgtctgaatgcaagaggggttgagactaaagggagaagagagaatgtgggcgtgaggcagttttggcctcatcgggttaaaatttaggattagagagtttgaagacttccttcaggtctttggggagaccatttcctccagctctatggaatacagggaatgttgagaacttagtgacactgacatgctcactttgttcctgactggactggaactggtgtgaatttttttcaagcaatttctagtctgtgatcaaagcccagtgaacacagagcattccatgaatcttaaaggaatggcgagttaaaaaggaccaaagtgctgtgtggtctgtgccgatgccactttccagagcagtgatcgccctgtctcttgtcacaagcagcatcaaccctggccgggtccttacccacagcatccctgacacagccggcagcagcctgctgggaggattcccttccacacagtgatgacattcagctaagccacagtttccttgacccaggaggaaacccgtgtggttgggggttaggggcatggatgagcaagcgcagattttttcccattgcccgatggctttaaattgcaacctctcttttaattttccattatgcatcaaacacatctgtgccagaactggacaaatgtattctgtctgggaggataatcccagacagctataaattagagtttgtgtacagagattccaaaaatgtggcctcgtggtggggtgtccctgggaccagtcacctcctccacagtctgctcggtggctgctggctttggcctgatgcctctgtcaataggtcttgctttgtatttggaaactctgtctttccattgagtcgccacagagatgagggcgtgcagggttgcctgtgaggctttgctgggcagacttgtcccaggcagcctccagatgcttctaggaggaacctaggtgattgaccaagggcattgctctctttcctacacaggaacagcaaggacctcaaagctggtgtcctcccaagttaaagcatggcccaagaagactctccccactttttctggattgcacatagaaactaccgtgtaacactttaaaaatgtatttttaaagttacaagagaaatacatgcttaatgcagagaacttagaaaatatactgagaaggaaaaaagtcacctggaatcctgtccttcataaataatgttttagcaaaactcctttcaatatgtttccatgccatgccaccctttttttaaatgcagacgtctttcagaagctgattgatcccgggtcctttagctgcccctcacattatccaattagtgctttcctctaagtactggaaacttttagttactccacaagggagagtccagctggtagaattctgcccctctgactcctcctcactgaggtcgcacctcttttctgaagaagctggccacaaaggggattggccttgggagatagaaggagaagagggataaagtcctcatagaaatccagccagatcgtccagaaggctagttccgggtcctttataagctgcctggcaagacagaagtcccctgtataaaaaggactatgctgtctctggtgcgatttttccttttagacctctgcttctctgatttccatcctccatgctcctgttcccagtgtctgtgtgtgctctgctctgtttgggcaggggaagcctctaaattgttcatttagtggtagactagggcagcccaacagcaactggatgggctagcagaattaggaggctatttttatatctctgcttactttcccatggtgccctgggcccagaaggtgtccagtaaatatctgttgatggattgatacagtgaaattcgagagtggtgtttgtggagagaaaacaccgtggctagagcctgctggcacgcagcaatgacagtcctgagatggcagaaagggcttccaacttccaagctgagcctcacaaaagccttcagagtagggaaggaaaggaagccgggtgatgactctaccagccgccagcctgcctagccactgcctgtgccagccactcagcctctccatgagccacacagcacacagaccacgctttttcagaaaattattttttcctttctcactttccatggaaactcaaaatagcaaccaaaaaaaaaaaagactaggctatctccctaccagcaaaaccatccccagtcagggcagtgaccatataggatggtggagagggttacaaatgcccctaaaaccgctttctatttggggactgtgcactcacgaggtcacgaggtgtgggtgggttctgaggttgaggttgctgtattttcttcccattcagaaaagtgggtttcccccaggtcttggagttcatcgtgctcttggtgacctggcagctgagacatagtcacctctcgttgtggtgtgggtgaagagatccaacatgcccagcaagggacaaaaaggcaggggcagatgccttccagagggaatgttattggaacattgcttttgagacacctccctggctgtgctgtgtgtgccccataaccacagggcagcctggcatcatggaaaaaccctgctttcagaatcagaaaaacccagtccaatgtcacatcaggggcctgaggggcttcgtgcacatcacttcacctctctgagccttcattttctcccctataaaatgggaaggtggtctaagtgatttccaaaggggtgaccttgtcagcatcctgtgcctagagcctgctctcggatctgtgcatgctctttccccttccactgtaaacacagtgtcgtttgccttccagctggctggatcggccgtcattgcttttggactatggtttcggttcggaggtgccataaaggagttatcatcagaggacaagtccccagagtatttctatgtgggtgagtgactccagcttcctaagctccagctcagagtagatggggctgtgcaaagacttagagcagaagctgcacttgaactttggtgggagggggagggcagagaggcagggaaagacgctgaaaggagccacctctgagcccctgtgcactggtgtagccctccgagttgtctgctggagacaggtagagaggctgtggtgaccccttccccttgccctcacacggtctgttcctccgctctccaaaatcaagggagtctggggctggtaagagcagtctgttgtgctttgtttcaaggaaagaagtctcaaggaaatgcagctaaaatttatttcaaagaatgagaaaactccctattgcccctggagtaaagtgggtacaccacaagtgtgtcattcactagtctatatggggtgacacgggacccctgtaggattttattttgtgatcttatattttaaattgtctaggaaaaaacataactcaaaatacaggtttgaaggtgctaatctcagtctctccatgactagggactgcagagtggaggggaggagagagaagaatgagggagaggagggatggagggagaggagatgagagggactcccctgggaagaggttccagcaggaaggggcaatagctctgaccccacctctgtaggaaggggtgaggagtgtggggtggggtgcagcctccacccgcaaggcagtgttcttagtaggggctgagcattgttgccctgggattagttgacctaattctagcatttcctgtgacctttcctcattccccagctaagtggactaagactctagatttcaaaaagcccaagacaattgtcattaaaggtggcacccccatatactggctgttttaggatctgcaccagccatagagtaagcttcagttgctgtggtgacctctatggcagggaggaagagcatcctgcacaggtcatttgctctaaatcacaagaagagtagagtctcttccatgagagagagagcgcaggccccactcagagcagggacatcctcccgaagggccagcctgcagctgtgctacctcttattacaaacactcttcccacacagcatcctcctgcgaggaaaagagctgtgtcagttaggatacttttagaggagagtagcagaaaacctactaaagatggataacaataaggacattccacatttcaggaaatcttagatgtggctctttgtaaaacactcaattattttaggttccattaagaaaggaaaaaatgctaccagtttagcttagctatgacataccataaaagatgcattctaatttcagcattgttaaaatataccaaaaaataaatcatctcaacagtgatgaaatatagtaaaagaagtctggagatggggactttccagaattcgttcagagctgaacaaagtcatcaaaggcccaggttctttccccctctctgctgtcttcagtgtccttagacatctctccttaaaagatagctgcagtggctccaggcatcgtattctcgtacagcaacatccaaaagagaacaaagcaaatttcgcttcatagggtcccttttttgaatgagtaaaacctttttcagaatctcccaacacatttccccttgcagcttattagtcaaaattgcattctgtattcatgcctaaaccaatcatggccaagaagcgaattactatgattggatctctgactaattgatattcacaccctcacaccctcccctgggcctggggaggggcctgggctccccataggacctgtgacacttggacaagattgggattttgtgacaaggaaaaagcagaggaatctgccgtagacataaaactgaaatgctcctttctacccacatggtttccaggaagtatgcacagggcaaggacatttgagacaaaaaaatataacctatcagtataacctaaatataatccattggccagcattcacagtcctgggctctgctgtcacacaaaaatgtataagaattctgtaaccgcccccatgtaacttgtaatataaatgaaaagactcatagacttcacaatttaaattacaataaaaattagtatgtgactaaatgccagctaagtggtatttgcagtgggtgcattagaggtcattctaaactggtaaggaaagaaggatttaagttaggttttaaagaccaggctgtaatcaatggagaagaggaaaaatggggactagaaaggctgaggggaaggcatgcacaaagaatggctgtggggagggattagcaagctgggaggggctgggggctctgttggggtctgaggactagggcatggtgggcagtaggatttggaatgttggggagggaaaggggacaagtatagaggcctttgaatgtcagggttaagttggtaaacagtagaagaatgatttggggccgggggtagggtatgatctgcactgtactttaaagagattattatggcagaagtagaatgaaaggggaatcccaggacagaaaaaaaaaaaaaaagcagattattgatataatcaggccggacaaattagggtataacccacaatgattgcagaaggaattaagaagaaagaaacagaaagataagaaacattattaaacatttttaagcctgcctaatcaaactcagggacagaagaaatcaaaatggcaaaagaggtagtgagaggcagagtcaagcctctcagtaataattcatgactttctgatggaaacctgagttacaggtctaagtaaggggcccccgctccatcagagggaggggccgttgcgtggcgctacagatggaatacctccccgggagcaacctcagtctgtgtttctccagaaacaaagggctgataaccatttcacagctctagatgtcagttccacataaaaacctttatgattagatacatcaaaaggttgaatagacttccatagatgaaagtgagctctccttcatgtcatatttaaccactatcgtggcaagaatcagaattgtgtgtttcattcaggagattcctgtgttgagccagaggctgaactggctctacacccacattcctgattttgtttctaatctaaaccaaacaatacacacactgcctgagatatgaggaattcttcattatgtcatatctttatggacatgtctatcaggactcttcgtattgcaaatcacagacacctactcaaattgactaaagcaacacagacctttattgacttacatacttgaaaggtcaagggttaatactggtctcagggactcagatgatgtgacctgagtccagtctggagccatctcttggccctgctttcctttggctccattcttaagcaggtttcttctccatgtgataaaacggccgtcagtggctctaggctccacttccagagtgactccagaagtagaacatgcttttttcattccaacagatgcatgtaatgccccaggcctaactctcgttggcagtattggacctcgtgcccatcctcgaacttgtcattgtggacagctgcttgtgggcatatgcctgggcttcatgcccaccgtggagctggaggtgagtcagccctctcaaaccacatgggctgagaatggaggagttccctttacctaatagagaaaaagaagtggattctgggcagggaaaacagcaggccacagcagggcctgaatcctcctgcttgctcttggtgtcacagggcatgatatgggtttacccacctttcgttcctcgtccaccccatctccctttcctaaggcagcccagagtggttggtggtaaaggcactcacgatccatgctcaaagttcagagaagtgggtcatcatagaaacttagcaccacgcagaataaggaaactacaggctgtggataaacacctggggctggcagtcagccagggcttcccagctcctcctggtggggcttggcctggaacccaggtttgctgacagccaggtccgtgcttgccctgtctcccggtgctgcctctctggatagtggcaacaagaagtccttgtgaagtcaggtaccttttttccctttcaagtatgtcttataatataaatagaaagacaatagacatgtttgtagaaattgacattttttcctcagtaaataattttccacataagatacctgctctccagcaacaaaacaagaagaaaaatacactaggatgctgtttatggatttgcacaacatacagtatgaggtgatagcactttaggaaacaaacaggcccagtgtttggaaaatctcactccactgtcacagggcaccattcactgatctgggtatttccttttcagaataggttccagataaatcagcccattaaactcttatcacccctttgttaaagagtgtcctaaacaggcatggcacattcaaatggttcttaaagaaataagcccttcccagccttgactctcctctctgagaggaaccccaggaagacacacttgtctaggtccctgcttcggggtagatgactgccagactttgtaagggaaattgtcccatcttctgggggaagctttcctttctggcatccttggttctctttccttggggatggagcgagtttcccttcctgtgataaagatcagacataacctccaagccagaggtgtggtcaatcccagggcagggcaggaggatccagctgtgggaaatgaggacagggcgagaggatagtcagactgactgccacctgtgtctcttctcagggccctctgcatccaggccaaggcctggaggcccttccaaagtctctgtgtccactggttgctaagggtagaagagaggacctggcaggagtgacgctggcagaggagggcttgggttgctccgtgttgcctagaccttgtccacgctagtctctttcagggcactcttgggagaagcccccgtgtcttccaaattccagcaacctgcccatctgacttcctgttacagtccctctctggagtgggcagacaccccaggggtcttctttctagagttacagagtagggagcgagcccctcagcccttggaaaactggagagactgtgtgcttggtgcatgaagtcatgtctgtgagcagaggatattaacaggttttctccaagaaggggttgcccacacacgcaggagccactcggctctccaggatcgcagcctgactgcagctgtctctccctgtggaactcagagtctccaagcctggctctgattgtggctggatgttatgtataaggaaagcattccagtgccgaacaccaagggggtggcttggcttgttaaaaactctgactcacgctggtcatatttttttacttggttttcacttgtacctgacatccatggtagctgtataccagagaggtgttgtagcttacattgttgagacaatttctccagagcatttttataagaagttggaatagacaatcatttccatattgcagctaacgaaactgaagggtaggaagacttacctcaagccatagttggcaggcctggatttctggctcccagccctgtactttcagaggaaaaaccaggaatcatcaattctagacatctcaagtacttttctcaagggagaagaaaaataactctactgccatttataaattgcaaaatgaaccaatttctagctaagagcattgttgttcttcacagttactgctaaaacgaaagcataggggttcagggactgcactttggagtaggctcccctaggttcagttccaatttttcccctcacaagctatgcaatcttacataaattatttaatttcttggtgtctcagattcttcagctgtgaaatatgaacatatttaagcatagtatctgttctgtggtgagccctcagtaaatattggctattgttattacagatcgagcatccctaatctgaaaatccaaaatccaaaattcccccacatccaaaaccttttgagcactatcctgactctcaaaggaaatgctcattggataatttcagatttgggattttcggattaggaatgctcaaccagtgtaatgcaaacattccaaaatgtgaaaacatcctaaatctgaaacacttgcccttcccaaaaactaagttgcattcaatattctagatatttgcattattatatgcattcaggggatactgaagggacataaatgtagggacataaaaaaatttcaaataaaaaaaatggtcattagcagattatgtaaaaccatctgctgctagaaagccattaaaattgatgaccacgtccagtccctaaaaggggggaaccacatttttaagtgagtttatcccagtaggccgttaggaggttctctctcatttttatgttaactaaaatgatgtttctagcttaaaagaagactctgaaacctaagaaaagagtgatggaattgcctgggaacatgttccatatcttaccccagctagaatgactattatcaaagggagaaagaatagcaaatgctggcaaggatctggagaaaggggaagcctcgtacactattggtgggaatataaagtagtacagccactatggagaacagtatggcagttcctcaaaaaataaatatagagctatcatccagcattcccactgctgggtatatatccaaaagaaaggaaatcagtaaatcaaagagacatctgcactcccatgtttattgcagcacttttcacaatagccaacatatggagtcaacctaagtgtccatcagcagatggatggatgaagaaaatgtggtacatatacacaatggaatattactcagccataaaaagaaagaaatcctgtcatttgtagcagcatggatggaactagaggccattgtgttaagtgaaacaagccaagcacaggaagagcagatatcacatgatctcactcatgtgggaactgaataagtggatctcatggaggccgagggtagactgatggttactggaggccgcagagtgtagggggttggggagataaagagaagctgcttaatgggtacaaaaatacagttaaatagaaggaagaaattcttgtattctatagagcagtaggaaaattatatttagcaataatttttatatatttcaaagtagctaggtgagaagaattgtaacttcccaacacaaagataaatgtttgaggtgatggatatctcagtgacactgatttgatccttacacattgtatacatgcattgaaatagcatatgtacccccaaaatgtgtacaactattatgtatcagtaagatattaataaataattttaaatactttttaaatttttaaaaatgaaggtgtcccagggaaagtacttgtggtagcatgtcacagagatcactggcatcccaaaggccagctattcatgatgaaaatgtaatttcaaaatgttttctatttttcaaatcaaaggcaataggactcggaaagcatgagggctttgggaagtaggtcgtatgtttgtcacacctgctcctgtgggaaggagaaggctctacagtaaccatcttggaatttaaaatgtggctgtaaattaattattacattcagcagctattttttgagggtcagaccataagaaggataaagtatccttggaagccacaggtggccttatggcatgcggagtattagagccagatttggaactggatccggcacgcccagggaacctttcctcttgtagaatttcttctgcttttcccttcagcttcagcaagcaatgttcatttggagctgggctgagtcacgggcccacacatacaaaacagaggctggctgagaagtggcctcaaagttgaagctgctagggcagcttcaggttgtttttgccgtgagctctgggattctgatagcctaagaatgaaatattgttcaaaaaagcacactttcctgaaaagctcattatttcagaaggataaggattgttgcctgagggagcagacagtttcatttacagtggggaacaactctggcctcctcaaacctctgtgcccctgtccagtgagcctcctgcctcctcacgagcctccctctttcgcatattccagggtgtctcggggtgcgaagcaaccatcctcatgtgcttggctttggagagcacagctatgtagttgctttgtggatgtttgctgagacctgtttccagcatatatctctaagcaaagatgggtgatgacagccagcaagcctggaactgatttgattttctctgtcttatctactaatccaatgcacactgactaagaattctgccttgtgcagggcatgttctagagaggatgaataaggtttgtcaacttgaaatctataatgagagactaatatgagaacctgcaaaagcacaaaatggaaaagagcaggacacagccagatcatggtgaattcccaggtggctggagcataggatggataaagattttgggggaaactgttctgtaggctgtgacttcatgatagatctgcaaacggcatcatgtagcaattgtggcagtagcaatgagaggcaatgggcatgttctgcagcaagggggtccaccaggagacattccatgaaggaactgaatatggtgttgttgctgccgccctgcattcagctcgcttctgtggggtggtcaaatagaagtgtgggatgggaattggggctgcaggccagggcatcctgcctacagccatcttgactctcagacctccatttgtaaaacagaaataatagtccttgcttacctaaccacgttgttttgagaagccaataagatgatggaagtgagagctttgaaaacattgcaacacagtgaatgacttttttttttctttttcaactttcattttagaatcagggggtacatgggcaggtttgttacaaaggtacattgagtgatgccgagattgggggtatgactgaacctgtcactgaggtaatgaatatagtatccaatagttagtttttcaacacctgtgcccctctagtagtccccagtatctatcattcccatctttatgtccatgtgtacccaatatttagctcctacttataagtgagaacatgcggtatttgatgttctgttcctgtgatagtttgcttaggataatggcctccagctgcattcatgttgctgcaaagggcatgattttgttcttttttatggctgcatagtattccatggtgtatatgtaccacattttctttatcctatctaccattgatgggcacctgggttgattccatacctttgccgttgtgaatagtgctgcagtgaacatgtacccttttgacagaatgacttattttcctttaggtatttacccagcaatgggattgccgggtcgagtggtagttcaactcagttgtttgagtcatctccaaactgccttctgcagtggctgtactgatttacattcgcaacattgtataaagtgtcccctttactcccagccttgccaacatctgttatttttgactttttaacaaaagccattctgactggtatgagatggtatctcattgtggttttgatttgcatttctctgatgattagagatgacgagcattatttcatgtttgttgctcgcttgcatgtcttctttggagaattgtctgtttatgtcttttgcccactttttaatggagttatttgccttttgcttgttgatttgtttaagttccttacagattctggatattagacctttggtgaaagacatttttaaaacaataaagtgttgaggtagtggggccaacaacactattatttttaatatgatatcatttctcacattaccacatccattccctcatgaaattattcttttagagaaaagggaaagggaggaggtggtagagctagaacagcaggaaataaatacccacctcaggactgcagagcagcaaggcctcagggccctgaaaagaacgctgaggccaggtccgggtggggcaggaagcagagcagcctcgcctgtggctcctactaggtctgtaaactgccagatctgcccgcaaaccaccatcagcaacccagaggcgccccaggaagcaccctgaatgccaggcccaggggttccccacagaggcggggcaccagcccccaccctccctattaatgggagtggtttccaggtgactcatatgagtaaaatgcaaaaaatgaaatagagaccattaacatgattccaagtaagacaagtgccaagtcccatattgtattctaacttatctcaggatcagagaaggaaatacaaaaaggcttggctttagttctctcagaaccagagcatttctgtccttttctttctctgtaagaactgtacgtggggcttgcctaagcagtaagtgaaatccccacctgaatgatggctgcctccatcactagagatgcaagacagagtcggagtgttgggcaggcttttgaggctcatggctatttttctcccggctctgccaaacaccagctctatgaccttaagcaaatcgctttaccttttggggcccagttcctccgtgtcaaacatggcagtaagaatagcacctccttttggtactattagaatgctctgcagtgcccagagtcttaagcctagttggtcgtggaggcactcggttggctctcagtggtctcctctgacctcttccccacagggctgtatgttctggttggagccggggccctgatgatggccgtggggttcttcgggtgctgcggagccatgcgggagtcgcaatgtgtgcttggatcagtaagtggggcgagggggtaaatggtggggtgggggtgagggagcggcctgcatctgaagggagtcagtgcctctggcccctggctccagctcctccgtggactctctgagcccttggcatgcacttttcctccctcagtcttggtttctccatctcttatatatgaataatactaactagggccgggtgccatgactcacgcctgtaatcccagcactttgggaggctgaggcaggaggatctctggagcccaggagtttaagactagcttgggcaacacagggagacctagtctctaccgggtgtgatggcacacacctgtggtcccagctactcaggaggctgaggcaggaggatcacttaagaccaggagttgggaggctgcagtgagccatgactgtaccactgcactccaacctgggcgacagagcaaaaccttgtcttgaaaaaagaaaaaagaaaaaaaatattatctttgttcctgccttatatgggaagtgtgaaaagaaatgacgtcattggtgtaaagatgttttgggagtaaaagtacttagtaattgtaaggggtgactatgattgttctttaaaaaaaaatatttcacagtgggtgaggcagctaaaaggtttctatagccagggaagtgctgttatctacaaggaaaacatttatgtttgagatcaataacttaaccaaaatccctcttgtggcttattttaacaagcaacctctgtttaaaacaaaaatcaaataatttcaattaactgctatacattctatgtcagtgtagcctgagagaaacagaaaggaagaagaggggcaggaggagagaaagtgttgatatttctccacagagagtcagaaacagcagttttaataggcagcctctcatctctcattacttattgtgatctttggatttttaactctggccgtagcctctgatctcttgctatgtgaaatgtctgacttatttctttgccattcattccttctctttctcctactgttgagcacatttctgtcttgtttatcactgaacttagtttgatcagagcaaatccatagaccagaacagaaatccatccagaaggacacccctcacctcatctcctcaaagaagcctttccagaccacagaatctccagtcacccccttccccatgcccaggccgcatcagtgatgctccctctcctgaccttattttatatctttctaggtcttttgtgttcgtcaagtatttactaagcacataggtgccaggtggtgttctaggtggtgggatttttacatcactacctgaacttatcttattcactttttaacttctttacacagttatcgtatattcctctgtccaatccaaggtccgtgataacagagacatttggatattatcttgttcaccactgaatactcagcaccaaggacagtacctggtgcagaataaatgcctaataaacaattgctgaatgaatgaatgaatgaatgaaccacatgaaagcgattcagccattacataaggaaactaaggtgcaaaatatataaattgaaaaggtattaaattaatgaaattagtattttctctcctctacagttttttacctgcctcctggtgatatttgctgctgaagtaaccactggagtatttgcttttataggcaagggggtagtaagtaaaattacttataatgtttttctatgatggttaaaagtgttagaatattgatacccacaatagtgttaagaaaccaaataatccccattattatagtttaaacagaactttttaacttagaagtggtgtgcagaactgagcatatatgtatatgagtgtgcaggcatatatacatgctcacatttttctggggagatagttcatctcttccattagacttatgaagtggtctataataaaaccaaaaaaaaaaggatctctaatttaagattcttccccattgtgaaatggggtaacagttagagtacagacttgagaaagaatctagattctcatcccctgtcagactgccatttgtccttaaggattggcctggatgggtccatttcattctcaaagagcagagcctacactgctgtgggctagtgaagccagtttatatttgctgcccaactctaggtgtccagaataggttatcggggggacacacagaggaagtagcctttcttcctctgcaaaacacactgtgggatagaagagaatggaatggaaaaggaggaagaatggaaacttaagtttgctgtatttcacattaactcttgtgtcattaatattatgtttctgaacttattttagactataaaacagtaaacatgtagaatagtaaatgtcacctccttttgaatttttctaaagtaactggctgtgttcataggttagtttaaattcagctacatacagaagtagaatggaatcttaggacctgttgagatatctgtggatttgaaatcacaagcttttatactagaaaaagcattctctaagctttatatgatatctgaatgtagaaagttttccttggtgatgaataccttttaaaccacatcataaaaagatttgaatgcttttaaccaatggggtaacaggaatgtataagtccggatcctagctatgcatccgaatcatctggatggagcccaggaatctggggcccagttgatgctgaagcccagttgggcttgggaactgtcagaaatctttctagtccatgaaaactgttctggttagtctgtccttccatcctcaaaagcatcttagaaactccagaaactataatcttctccatatgttgctgaattatcctaaaatacctatggaaaggcagtattttttttttatttctacaggttttgtggggaacaggtggtgtttggttacatgagtaagttctctagtggggatttctgagattttggtgcacccatcacccgagcagtgtacactgtacccaatgtgcagtcttttatccctcacctcactcctaccctttcccctgagtccccaaagtccattgtatcattcttatgagaaaggcagtgtttttcaaaggtgtggaagaggagattttccttgatgaaaggagaatgtttgaaacttcccacccagaagtccttcatttttcctcgtatttcttcaggctatccgacatgttcagaccatgtatgaagaggcttacaatgattaccttaaagacaggggaaaaggcaatgggacactcatcaccttccactcaacagtgagtaacttcacttcttccttaaaatcacagcttctaaagattatgtgtgagccaggttctcaccaatcaccaggattaaaaataaaaataaattcagtaaagccaagtagcaccacctattttagcccttttgagggccacagtttgcattatgtgtggaaccctagaagggaaagatgtctatcacacagagttcacaagagagacagaagagcatgaacccaaaagacacatgccccaaagagacaaaagagcacaaacaaggttacagagaaaggagcccagataaatagcaggctttgtcagagggtagcattgtggtgtaacagaaacaagtgtgacctgtaagtcagaaaagctaatttctagctgcagctctaccattcaacagccttgtgaccttgagcaagttacttggcctccctgatacccacgcagctccctcatttgtagaatgaagggtcacaggagatggctacactcccttctggaacattcagtgggactgtgctgtccgtggagtgctcagagctacatgcagttaatcacagaaggcttacagaggagatgggccaggccagagttattctgattttttagacactgtgatatgaagaagtagctgtgaattcctgggccaggtgttttcaggtacctagttcttgtctaggacaagtatgtcttggaaagtggccaccatttatacatttatacggtttcacctcagctgccgccaggacctgaagcagcacacaggttcttttgtcttaaagggccagctagcctaagcaggacacctgtttgctggccaatcttcaaatctggtcttttggaccctggaatttcctgcagccacttctcccctcttccccagactattcccagctaatgagtccttctgcagctcataaaacttgagctcctcagcaggttaaatgactcccagtctgaaagaaggaatctaaagccccaacccctttctaaaaagtagcaatttacacagacactgtcaattagcttcttgccttgtttgggttgccttgagtcacttcccatcataaactcagatggctttaacgaagtcattttcttgttttgccagcatgattatgtgattcttcactctccttccagaaatagcagtctgggttgcagtgactgggcctcggagctgctttgccgcctcggcaccccagtccttagcagggtgcccagacttgtagctgctactcctcccgcctggtcctgaagtctcttttctgactctctagtttcagtgctgtggaaaagaaagctccgaacaggtccaacctacatgcccaaaggagcttctaggacacaaggtaagcttctaccaaggttcttactctacctgtagtatcatgctgctagcttaggaagccattgaaggtagaatctcggatgggatctgcattttactgaatttgctctagtggcagcatagaggattgatggaaaatgaatagcgttgagctgagagacccattgggaaggctgctgtccttgttgttagcaagagatgttaaagagggccctttagaaagtgacaactacaggagtggtgaccagagaagagaggagaatccattactgggtttttggcttcaccacctacatagatgatggtgtcatttatggagctgagggagagaggaaaaggagccaattgtggagaaaagaaaatgagctttgtgtttaacatggtgattttgaggagccagtggcacttccaaatggaaatatccagtaggcagttggaaaatctggtttgtggctcaggagagaggtctgagtgtcagcacttgatgggaaacttaaagctataaatacggatttgatccattagacttggaagaaaagaaggatgaggatagatccttgggggacaatttaagggtgggcaaaagaagagatgccaaagaaggaaactgggaggggcggccagacacaagtgaggagacagcacgggaaggggagggaatggtcaccaggcccaggtgctgctgttgagggcaattcagtattgatcagctgcctaccttatgttcggcactgtggatgcaaaggagaaggagaaaaagttcctactcacaaggagcttgcattgcagtctgataggagggatgaacatgaagtccatacggtccagtgattaggaatgcatggaatgtgcaacgtgctcggaaagcacagagggaaacgcacttaggagaggcgagaggctgggggatggggaaggctgacagaggtaatgatgtctcagctaaatcttcaagaatggaaagtaattatgcaagcattgggcagaaagcgggagggggaggcctgcgtgccgagagaccagcgtaagcaacaacacagaggcagaaatgacatggtttgtgtggggaactgaaagcctaagaaggtctactaataactgctgaaaagctggcaggatttagcatgcaaggaaccaactggtgacgtgctgtgagggatggattgaggacagagcccaggtttcagagagcgagatgtgaggagagagagcatcctttcaagaagtttcgatttgagccaaggacacagaaagaaagtttacaaaagtcaaagtccaaattaccattaaacatatagaaaatatagaaaattaaaagtaatatttaaaatcaatagcaaattaaaatgaagagatgctgttgtttaatctatgaaattgaccaagtgtttttcctttcccttaacaataatacacagttttggtaaacgtgatgtcgtgagcattttcagagaaattagtaaatagttttaaaggtcagtatgactatgtaagactagaggattaagtatgtttatgcccttctatccagaaattccacttctcggagtttattctaaggaaaaggaatcagaaatgcagacagacgtttttgtgcaaatcatgctcattacatgttattcataagaacaaaacactggacagacccttaatatgtggcaataggggattgtttggataaattgtagtatattcatatgatgaaatgttttaccaccattaagaatcatgatttcacctgtaatcctagcacttagggaggcagaggcaggcagattgcctgagctcaggagtttaagaccaccctgggcaacatggtgaaatcccgtctactaaaaatacaaaaattagccaggcgtggtggcatgtgcctgtgatcccagctactcagaaagctgaggcaggagaatcacttgaacctgggaggcagaggttgcagtgagccgagatcgcgccactgcactacagcctgggtgagagagcgagactctgtctccaaaaaaaaaaataatcatcataatcatgatttcaaagaaatttttagtgaaacaaggcatttttaaagttgtaatattaagtttaaaaagctcactgttgaatataaagaatgacctaagggtgtaggtgtgtttgtgtgtgtaagtatcaccaacaaatttattaccttttatggtgagaatacagacatttctttttaaaaaaaaaaaaaatctcttttccagatttctacaagaagcatgtattccttttgtgactaaagccaatataccttttgtacatttgttttttacaaaaagaagctggcaatgaagggaaggagggcttaatggcagaactagaggaggacagtctcgagtgttgttttgtttgttttgattgaagaactgagcatggtgataggataagtagaaatgtcaatggataaggagaggctgaatgtataggaaggaaaaaaagtaactggcagtgcaggcttcctgaggagctgaaagacccaaagcaggatatgaagttaactgtcttttattattatttatttatttatttattttgagacagagtctcactctgttgcccaggctggagtgtagtggcatgatctcggctcactgcaacctccacctcccaggttcaagtgatcctcctgcctcagccccgctagtagctgggattacaggtaggtgccaccatgcccggctaatttttttattttcagtagagacggggtttcaccatgttggccaggctggtctcgatctcctgaccttaggtgatccacgcatctcggcctcccaagtgctgggattacaggcttgagccaccgcgcccagccatgaggttaactttcaacagagaagggcacctctttggctctgatcagagaaaaaggagtcaggagtgtgcttgctacctacagcaatgcctggcactgaaggaagggagcatctaagtgtataggagaaggagaggaagagtgaaagaattgctataggttgactctcattttttccactaagtaagggagccactccttagaagagtagttttcaaacttttgtcagaatgcattataggtatctcttgtggatctgtgtcctctaaactgtgaattcccagaaagcaggagaaaccatatcctattgtctctgcatctaccacccctcttccagtgactaatgcaaggtagatgctcaagaaatgtttgttgaatgaatgaagtgtgataggaaatacgaagagagaagtaagggttttatatagctcagatggtatcaaaggaaccaaccagtgacaagtgaacagatctgaacaacctgagggtacagttggattgagagcatccctctacttaagagcactccaaataggagtgtttgaagttggagaaactaataatagttacaggtgatctatttggctttctgtctaagtttccccacatccatgaaggccctttgaatctatgctgcacaggtgtcttatgggcacagatgaaaggataggaactcacccagcacagcccagcccagccaccacaggagagaatggtcctctagctccaagacttggcttttctaattcttggctttcctttgtttaacttgaacctgttaagactttttagtttcttaataggtcatgcctactttgcatagtaaattgggtcaaagacatagaaagtattttaaactgtaaatgacaatatgaaaacaaagagttattgttttaagggtattttacttatttgctacaagtaagaagtggctccaaatttttagattccttggaaccagacaaatagcttcctccagttatatttcagggctccgaagaagccactggcctaaacatgaaaatctcacccaaaggagaggcttctatttttttccccaaactgcatttttgcgttaagcttattaggatgatgttatcaaagatgaattgttgaaacatgagtagaagctggcatggattaactctcacagaatgaactgtagagatggaaaggataggatcaggataatgactgacacatacaatcagtttttattcccgactttttttcctcaaaacagaattgcatcgatgaaattgagaccataatcagtgttaagctccagctcattggaattgtcggtattggaattgcaggtctgacggtgagaaagttctagaacttaccctttttgccctctaaaaagccttgaaactttgcatcttatttcttttcaagtgtgatagtatcttaagagagaattctcataaagaaaaaagacctttgttcacaatgtattacatcttctaagaacaaagctcataaatatattaatagtttgtcctctaaaatataatagaaatttcaactttaactcattatgaccttgagtgtgtcattgttattaacttcccgttttaaggctactatccataacctagataaatgattttcagttctgggtctctttctactgttacaaattcaatgcaacatatcaggttaatctctctcacctacgatttgaagaggcagcagagcatagagattaatagggcgagctctggcatcacatggtttggatttaactctaggctccaccatttgcaagctctgagatcgcaggaaaatttcttaatttttctatacctcaatttcctcgtctgttaatatataaactttataggattgccgtgaaaattaaatgggatactacatatacagtagtattacaaattaatataaataaagtgtctgggacatataacactcaacaaatgccagctctctgcataatctaccaggcaaaggcaatggcatagatggtattaagcgtagtgcatccagaccaccaccaggtggctctgtacttctaaagtacaaaagaagagtgtgtgggaagaatggatagcagcggacaggtatggcaggagttgcgagaggtggtaatggagagagtattcgatctacatcattgagatctttgtatgcccctttgaaagggtgggcttcacccttaaggaaaggggagtcaccaagagttggaagaacctgtggtagaggatagaggaaaggttggagggaggcaagattggatttggaaggcgggttaaaggatgatttccattgtccaggggttggatgataatagctaatgctaagatggcacttagtctctagccctctatgtagattaattcatggcctaaactaaggcaagggctgtgggaattgtgaggaaatcagtgaattttcagttatcaggggacacacaagcgccttccccttttctgtatttagagcacagaggggtggagaagtggctggaaatactctgctgaggccctccaaatcaagggacatttctcaggtcctccccacctgctctggggatagcctggctgcagttctgcagctccccaaaggacagtcctgaggcaggtctgagcgtgtgctgcataatggagagtttcacaatctcagcaaatgagcagcctagaagcattcacccctgactcgtgtcggcagtaggctgagactgaaggagtctcactgaaaccaggatgggtagggattacatccaaccttatggcaatgataaaggggaaatgcccatagtgagcctatcttgagtcggcacccccaggtttcttcgttagttcttttctctgtaaagtgagagttgcacaatgtaatcagctaactaaaagtgcattgggtgtcgcccgtgctacacactggtactgagtcctgtcatccagaagcttgaaatcctgttcctggccatgcccttacctgcttctgcccctcccttttcaaaacaactgatcattcatatcttattgaatttagcacttacagatcctagtctgacttaggatggaattgaggagagaaccagaaagttatagtacccattttttaaaataagcattgacagtagtttatggaatggtgcccacagatagggttccatgggctctacaaaattgtaggggaaataatagcggacaagaagactctttggcattcttctattcaaaccatggaagtggatattgatttcactcaagtatttaacttctcagagaactatccaaaaggtaaaagtcaataataccatagtataaaccctttagtttatgttttgctaaaactattgaattaaacagtgaagcatcgtttgcccttaaaaatggactgagaatgaagtgatgctccactttttttttctttttttgtgagacagggtctctgtcaccagggagtgaagtggtgcaatcacagctcactgcagcctcgacctcctgggctcaataatcctcccgcctcagcttgccaagcacctgggactgcagggacacaccaccatgctcagctaatttttgtattttttgtagtgacagggtttcaccatgtttcccaggctggtctagaactcctgagctcaagcgatcctcccaccacagcctcccaaagtgctgggattgcaggcatgagccactgcacccagctgatactccatttttggatgtatggacactgttgtaaaaaatcagagcttttccagcaatagaaaattatttagaccacaagcatatctaaacaacaagtggttatggacacagttttcaaaataaacatataaaagagatctaggattaacctgaaatataaaattccaaagccagtattgtgtctgtctttcacaggtattcagaacggttctataattctgaagcagggtaggttcttttaaagcagagccttgttacttgttaacaataataatacacatttaaacagttaatctagaattatttaccccatagccaaccttaagtaacatactaaaatgtcatttgtgactggtaattattggttataattatttgttaacttgagttagacacccaggaagtctgctgaactttttacctatcagtacccgtttcaaagtcactgatgagtgtttcttctgtttcagatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattgtacatttgcatgagtacgtatgtttggctcattactggtttaccccttgagtgaatgcctgtttatgatgactgagagcatattcatgtgtgatctgcgtgtttctggaatatgctttatacgtaatgaaatctgtttgctgggaattcctgattcttgttatataagaggaacaacctatttcgctcccagaaaaaaaagatcaaagagctttcagaaactttgagaacttggctatttagaaaaagtgataatgggtcagtttctcagactgtagccattgaaaattagatgcagagaattcagagatttcttcttaatggaagtaataagctgtaagaattgagagatcacaatggagtgttaaaactgactgtgtctaagttgggtgtaagggtttcctgggtttttttatatacatgctctccccagaatacagtaaaccacagttttagaactaaacacatctgtaaaactaaatatagcatggaaaatccaatttgaataagtcatgctttcctagaatttaaaaataaaaaagtcttcctctggaaagagaagtcacacagacaatcatgtgccctataaaagtgagtgtttataggactaaaaaacttttaacaactttttaaggaaatatttttgttcttatacaaaaacatgtaaatattgctttattactttcattttctgaccctgctgtaaactactgcaaccctcacatcctcaaagggacttttatgtcaaactcttctgtttctccaaatataaggaaaaaagactaaagcaagagatctggcagttgaaaattgtgggaaagagaatttgtatgggcactgtatctatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaaccaaaataaagaaaagcatcttctcctagttgtgtgtgggcaacagaaacaagttaaggaaacaaaaatacttatatatacacagaacaaaaataatgttctttttatgcaaatcccctgtgaaaataaaattttcaatgtttttttggtcttaacgcttcattttaacttagtaaacccaaatttaggatttacattggcaaatttttcagtgatttttaacgtgttacatttagtaaaccatagattttttaaaaactacattttgtaaggccacacataagtgaaaatacggaaggctttggaaacccccagatgaacttctatacatgtgaaaacacaagtctttgagtgtgcactaaaagtgtcacactcccaaaaaactcacaaaacattttgctaaaaagatatgactgcttgaaatagtctctctcccatggagaaccacatttctctttctgccatacttgctactgctactgattttggaggaaatttttctagaagaacaaaggtcatatttgaggcaagctaaaaacttaattatacatggctactttactgtgtctgtagctaaagaaaaattattttacaaaaattacttcatgaaatatagtttgtaccccagtagttgagaaatgtgaccttttaggcaaagaacaggcagtccatctctcttagctttagtttatctctctgcctgaagacaggaaacaggcccaagtgcatactcgggttctttccaactcagaatcatctctgattccacaaaagtgagtttagtttcctatctgaattaacaactttaaaggagactacaatagttaaaagtggaagaatagaaataaataaatttaaaatgaaattaattaaagtagaagagaagggttctgttccatgtacgattaatgtgccccttttggggataagctttccaaaatatgcgtatgagtaaaattagagaattccaccactaagcaacaatagattttatatgtgtgtgtggatatatatacacacacacacagaaagatgaatatatatatatatatatctgtataaatagacacacatataatatatatagatatataatccctatatatcttgaatctacaaatatctttatatgtatataatttgaatatatacatgtatgtatatacagatgtgtgtgtatatatatatatatacatacacatatacataaattttcagctatttctgttcccctgaactaatttgagattagacccaaacatgcttttaaatgtctcatgccaaggcactgaattaagacttcttaatgttgaaatattttaagtgatttcatattaaattttctatatactgaaattgcttgtttgatttatcttaaagtcctattatatctttctacaaaccttcacgcaacttatctaaatgtcaaactaccaatcaaataatgtgattaaaaaaaaacagagtggtaacccttctataatttactattggtagttgacttaaaagcaacaccctaaggactcttactgcatatacagtcatctgtcagtattcatagaagaatggttccaggaccccctgtggataccaaaatccacagatgtccaagtcccttgtataaaattgtgtagtatttgcatgtagcctatgcatatcctctcatatactttatttttttaatttttatttttttattgttacataatagttgtacatacttttgggatatatgggatattttgatattagcatacaatgtgtaataaccacatcagggtaattgggatatctattacctgaaacatttatcatttctttgtattgggaacattccagatcttctaggccttttaaaacatataataaattgttgttaactatagtcaccttattgtgctaccaaatattagaacttattcattttatctaactgtatttttgtacccagtaatcaatccctcttcatccctccctgcctgctaccctttccagcctctggtaaccaccattgtatttactacctccatgagatcaatttttatagctcccacatatgactgagaacatgattcatcttgatgatatttgtctttctgtgcctggcttatatcacttaatatcctccaattctatgatgttgctgcaattgacaggattttattcattattcagccattgtcatggctgaataatatttcatcgtgtatatatagcacattttctttatccatctgttgatggactcttgggttaattctgtatcttggctattgtgaatagtgctgcaataaatatgaacatgcagacatctctttgatatactgattttctttcttttggatatatacccagcagtaggattgctgagtcatatggtagttttctgaggaacctccaaactgttttgcatagtggctgttgattgtttcctttgttgtgcagaaactttttagcttgatgtaatcctatttgtcaatttttactttggttgtctgtgcttttgaggttttaccccaaaaatatttgcccacaccagtttcctgaagcattttcccagtgttttcttctagtagtttcatagtttcaggtcttacatttaagtctttaatacatttgaattttgtgtagggtgagaaataggggtctggtctcattcttctgcatgtagataaccagttttctcagcactatttgttgaagagactgttctttccccagtgtaagttcttggtgcctttgtcaaaagtgagttagctgtaaatacatggatttatttctgggttctctattctgttccattggtctatgtgtttgtttttatgccaataccatgctgttttggttactatagttttgcggtatactttgaaggaaggtagtgtgatgcctccagcttttattctttttgccaacgattgctttgactattcaggagtttttgtgtgtgtgtggttccatgtgaattttagcattttttttctatttttgtgaaaaaatgtcattggtattttgataaggattgcattgaatctgtggaacactttgggtagtatggtcattttaacaatatcaagtcttccaacccatgaacatggaatatttttccatttttttctgtcctcttcaatttatttcattaacatttcatagctttcattatagagacctttcacttctttggttaaatttattcctaaatttttttgtagttattgtaaatgggattgctttcttgatttctttttcaaattgttcactgctggcatataaaaatactactgtttttttattttgattttatattctgcaactttactgaattcatttatcagttctaacaatttttttggtggaatctttaggtttttctaaatataaaacatgtcttctgcaaacaaggatgatttgacttctttctttccaatttggatgccctttttttctctcattgaattgctctggattgaacttccagttctacgttgaatagaagtggtgaaagtgggcattgttgtctttttccacatcttttaatttttggccaggtgcagtggctaacgctagtaatcccagcacttcgggaggccgaggcaggtggaccactaggtcaggagtttgagaccaccctggccaacatggtgaaaccctgtctctactaaaaatacaaaaattctctggacatggtggcacatgcctgtaatcctagctacttgggaggttgaggcacgagaattgcttgagcctgggaggcagaggttgcagtgagccgagatcacaccattgcactccagcttaggcgacagagtgagaccctgtctcaaaggaaaaaaaaaaaagaaaggcttttaattttttatttttccgtgttcaatatgtgatgttaggtgtgggtttatcttaaatggcttttaatgttttgagttatgttccttctatcaccagtttgttgagagtttttatcatgaaggatactgaattttatcaagcgccttttcagtatctattcaaatgttcatatggtttttgtccttgttactattaatgtttattgatttgtgtatgttgaaccatccttgtatccctgagatgaatcccaattaattgatcatggtgaatgatcttcttaatgcgtttttgaattctgtttgctagtattttgttgagtatttttacatctatgttcatcgggaatattggtctgtcattttctttgtagttgtatttttgtttggtatggctatcagggtaatgctggactcattgaattagctcttcaattttggagaatagttttggtagaattggtgttctttaaatatttgataaaatttggcagtgaagccatcaggtcctgggcttttctttgatgggtgacttttattactgcttttaccttattacttgttattaatctgctcaggttttctacttcttcatgattcaatcatggtaaattgtatgtatttagaaatgtattcattttttctaggtttttccatttattggcatatagttcaaaagtctctaatgatcttttgtattactgtggtatcagttttaatgtctccttttttgtctcttatttacttaggtctttcttttttccttagtctagctaaaagtttgtcatttttttatcttttaaaaaatttcatttttcattttgttgctcttttgcattgttttttagtgtccattttatctctactctggtttttattatttcttttcttctactaatttgggatttggtttgttcttgcttttctagttctttaaggtacatcatcagtttgtctatttgaagtctttctacttttttgatataggcatttattactataaacttccttcttaatgctacttttcctgtactccattggtttggtatgctgtatttctattttcatttgtttcaagaatttaaaaaatatttttaatttcttcattgacccattggtcattgaggagcatgttgtttaattttcatgtatttattcaattttcagtgttcttcttgttattgatttctagattttattccattgcagcctgaatatttgatattatttcaattttttgagtttgctaagacttgttttgtgcccttgcatgttgtctttcctggagaatgttttcatatgctggcaagaagaatgcgtattctgcagcagtaggatgagtgttctgaaaatgtcagttatgtccatttggtctagagtgtagtttacttttcatgtttcttttttttaattttctctctgtatgatctatttattggcaaaagttgggttttgaggttccctactattattgtactggaatctagctctctttttgtgctctgatgttgggtacaattatatttacaattgttatatcctcttgcagaatgatccctttaccattacataatgaccttctttgtctctttttgcagtttctgacttaaaaagagacaaagtgttgggtcttgttttttcattcattcagtcaccttgtgtcttttaaattggagaatttggtccatgtttacattcaatgtaattaatgataggtaaacactactgccattttattgttcgttttctggttcttaagtcctttattttattcttactatctttctctgtggttatcttccctggtaatacattttaattcattgctttttatttttactgtatctattataggtttttgctttgtgattgttatgagacaaaaaatcttatagttataataacttgttttaaactggtaactttcatcacaaagaaaagaagcaaacaaccaagttttttagttgtttttagaagaaactaaaaaaccctacaatttaactcatcttcccccactttttgactttttaatgtctccatttttaactttttatgttgtttatctctctctcgctttttttttttgagatgtaatcttactttgtcacacaagctggagtgcagtggcgtgatctcagctcactgcaacctctgcctcctaggttcaagctattctcctgcctcagcctccctagttgctgggattacaggtgcctgccgccatgcctggataattttttttatatttttagtacagccagggtttcaccatgttggccagtctggtctcaatctcctgacctcgagtaatccacccgcctcggcctcccaaaatgctgggatcacaggcatgagctaccacacccgcccttatgttgcttatgtcttaacaaattgttgtagttattatttttgatagatttgtcttttagtcttcataccaaagatatgagtggtttactcaccacagttaatgtatgagaatattctgaatttgtgtatttacttttaccaatgagctttataccttcagatgatttcttgtcacactttagcattctattctttcagattaaagaactgcctttagcatcttttgtaagtcagatctggtgctcatgaactccttcagcttttgtttgtctagcaaagtctttatttctccttcatgtttgaaagatagcttttttgggtacaatattctcagttgaaagtttttttccttcagcactttgaatatgtcttcccacttccttttggcctgtaaggtttctgctgagaagtctgctgcaagacatattggggctcctctatatgttatttgcttcaaaagaaaagcagcccttgctgcttttagaatcctttctttatcctttacctttgagagcataatcattgtatacctcagggtagtctcatttgggttgaatgtgcttggtattctctaaccttcttgtgcctggatattcataactttctttaggtttagaaagtgatctattatttctttgaataaactttctaccccatctttttctctacttcctctttaggccagtaactcttagatatgtccttttgaggctatcttccagatctcgtaatgtacttcaatcttttttcttttttctcctctgactttgtgttttcaaatagcctgtctttgaaatcactcattctttcttctgcttgatcagttctgctgttgagacactgtgattatgcatttttcagttaatcagttgtacttttcagctacaggatttctatttcttttttattattattatttcaatgtctttgttaaatgtctttaataaatttctgaattttttctgtctgttttcttaaagttcattgagcttcctcaaaacatctattttgaatttcctatctgagatatcacatatttccaccactccaatgttggccattggccccttatttagtctgtttggtgaggtcatattttcctgaagttttgtgctggatgcttttggatgctcattgatgtcttggcattgaagagttgggtatttattccagtcttcatagtctggccttgtttatcctcatcctttttcagaaggccttctaagaattcaaaggcagctgagtcttgagttcagtaagcctgtgtcattacagctatttcagcactagagggtgtccaaagcccaggtacactaagattccttacagattcctggatacccatccctgatggacttggaaaaaataagggaagtccctggatacccaggaaaagtccctcactctcttccctctctttcccccaagcaggagtccctctctggggttggccacttggtgttgtgggaggggtgactcaagcactctggccattgcagctggcagtgcgctgagttgcatctgatacccatgacctcccaaaccagcataggactaggacactcaaggcccatggctgctattgtctgactgcactgatgtttattcaaggcccaaggacacttttgtcagcaggtagtaaagccagccaagaattgggtctgccctgccagggcagtggattccctcctggtctggagtgggtatagaagtgtggtccaggagcagtggcctagaaataggggcttcaagattctgctaggtgctttgttttactgtggctgggctggtacccagtcgcgagacaaagagtaacatcttgttcccccaagcagaaggagtctcccttcttgctgcactgcctggagttgggatgaggtgacaccagcactctcgtggctgctgcagctggtgttgcaccaggtcacatcccaatcccactgcctccaagaccaatgcaacaccagggtttgcccaaagatggaagtcattatggcctgactgccacttgaatttatttggaaccccagaccactttactcagcctgtagtgaagccggctgtgacttgtgttcctcctcctgctgcaaaagattcccctctgccccgggactggttgaagtgctcccttcttgagcatcagagaaattctgcctggtgttgtgttctgtgtcagaacagctctgagttccaatgcaaaatccctcatattttgctttccctccactaagcacgcagattctctctctgtgctgcactgcctggggttgggaatggggtggtgtaggcaatgcaataccgtccttcctaccctctttaatgcatctttccttgttattttattaaaaccaagtgctgtgatctctcacctgatttcttagttcttttgaaagggctttattttgtagatagttgttcaatttgatgttcctgcaggtagggggccctatcactgcagggttctattccagcatcttgccccacttcctagctcctcctgtatactttaaatcatttctagattacttgtttacttaattcaaaggacatgctgtataaatacttgttatgctgtattgcttagggaataatggcaagaaaaattttatacgtgttcagtacagatgcaaccatttttttttttttggtccaa

SEQ ID NO: 1691 - DNA, 652 bp, Homo sapiens
cgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggagccatgcgggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagaattgcatcgatgaaattgagaccataatcagtgttaagctccagctcattggaattgtcggtattggaattgcaggtctgacgatctttggcatgatattcagcatggtcctctgctgtgcgatacgaaactcacgagatgtgatatga

SEQ ID NO: 1692 - protein, 216 aa, Homo sapiens
GGLRCIKYLLLGFNLLFWLAGSAVIAFGLWFRFGGAIKELSSEDKSPEYFYVGLYVLVGAGALMMAVGFFGCCGAMRESQCVLGSFFTCLLVIFAAEVTTGVFAFIGKGVAIRHVQTMYEEAYNDYLKDRGKGNGTLITFHSTFQCCGKESSEQVQPTCPKELLGHKNCIDEIETIISVKLQLIGIVGIGIAGLTIFGMIFSMVLCCAIRNSRDVI

SEQ ID NO: 1693 - DNA, 24348 bp, Mus musculus
  misc_feature (1)...(24348): n = A,T,C or G
ctgctttgaaaatgaaatgagataaggcagggaaaagcaagggactaatcctgtgatccagcccaagcgctttatggccgaggcgcagcatcactccttaaatatgatgctgatacaatgcaagtcgtgttggtcagtgattcagagaagaatgtaaccaatcaagttaggtttcctttccttttaagcagaaacagtccctgactcccccacccatgtgtgtgtgtgtgtgtgtgtgtgtgtgtgtgtgtgtgagagagagagagagagagagagagaaagagagagagagtgtgtgttagttttttggttttgcttttactaaggaagaacttgcaattataacttggctaacattaaaaatctcatgacgtttctcatctttacacactctgaacctctgtgttcttacttggctacttgtaagccacatttgaagcactagtctaactctgctttattttagtgaaacggcagattagacaaacaacagcatttacctttaaagtttttccaaattttcatgtttttggcagctgagtaccgtccttctgcgctgcataacttttacaaacctaactggagtacagcagcacacacagcggcaaagcaacacaacaggctctgcgctcagctcagcttctttccaccagtgctccagaacggtaccacttgataacacagcaaatgtgtgcctgccgcagcggcactgccatccacagggtggcagcactgagaagagagcagagccaagcagcaagcacacttggatgccaatggaaggaagcacaccagtgtgtctgaatcctgattaggaaaagagttcgtagacacacgggcattttggttctaattaacaagctccttttaattctggcaaagaaatcatagtctgcagaaaggctatcatgagtcagcctcggaacgggatcctttctcctcttctcagctgttttcttctcctattcatgcagtgaccaataatgggtgaattgagtataatttcattcaagtatgacgcagggccaatgtcgaacagaatggctatacctgcagtgcctatgttgagctaatctgagctatggtttaaagtgcttcaggacagcactttctttcaagaacagcatgctgtgagaacagggcatgcttaaaaaataaaagtagtacgaaaagcttcaggaaaacggaattaagttttaatatccacaaagagggcttctgaagaaaacactgataacagtacttttaaaaaacactgaagtagcactgtcctagtaaacacgtaataattaaagctcccaaacacaacagatgtgcagttcggtactaggctgttactacttttcttacaaaaataaccaaaatgattgaagatattaagttctttgatgtcattttgatcatttaaaatatgtttactaaccatcaaagacaaatgcttaagaccttttgcagagctccacactttttgattttatatcattactattatttttaacattattttacttacaaacttctggggctgaaaaacagattctgaaagaaaaaccaattcttttgattaaaattctgtcatttcaccagtaaatcaatttattcagataaatatttaaatctcatttttgtccagttaagtttattatttgatggtttgttttaatcccaatttgggtaaacaactacggtaacacatcttcacacacagtgctgtgatgcatgacaaagtattttcaaggaatgccttaatactattttttttttttttttttttttttttagaactgagaaagaaatccctgggaaggctgaccatgcactctccatagagcaaaatgaagtcagctctgcacagcatcagctctgaggatgcacaggaggcagagcacacactgtactcaccaggacgtccaagcaagaaccagcagcgttgttttcaccactcttgggataacctattttattgtatgtccgattctatcttaatgctgaaatcacatgcatttaccaacaattttcaagtaaaagactaatatttgaagagaaagaaaaccaagatagaaatttactcaattaaattatcccagacaataacaaattaccgaaacacgggaagaacattttctaacatttacctaagcaaatttaaaggcgctaggagagcaaatttgtatttgaggctgagcatgcaattgggcacactggacacacaagtgctgatttaaagaatatgatatgttttactcaaatatgcaaagtaacattttttcaatgaacttaaaaaattatgacaaatttcatgtcaacgtaatagagctaatttctcttcttcagagtggtacactctcagaaattatacctagagaatgcgaaagacaacctaagaaagggaatgcactcttctacaaatactgttctacctcactgcctgaagacaagacactagaacatttttattataacttctttgggcatgatgagaattaacttgggctctgaaattatagcattaaaacaatacaagaaaataaaattgatttactgagaaaacgtagcagagtaaaatcaattggtgatgttttgaacctgcaaagttaaacaaccttaagcttccagctttggtttcttaaaattctctttctcaagaacaatcgactgccgtgtcttcagagaaacagagctgactggaacactttctgattctgccttttacacaaaagatttatagtcctcatttaaaaactgattttagtttcccaaaaatgtatattaaagattctaatgcccactgatcagacattagatattttttaaaagtcatatgtcagctttttaattgtggtatttactctgagaattagtattttcatcttcagaaactataacataggagactgtaaacagcttacatgcaatacaccaacactaatatgagacaataatttaagtactaacaactaaaaagcgtaaaatgagagtctcctgctcaaagatagatttcaagactctgcaatgctctctctcccaccactgcaaagagccccatgcattctctgagcagtttccagagctcgaggtaaattctacttcagatatcacaaaaggtttcaattctcctttagaaaaccaactaactaatgaatgagaaagagacatacctttaatcagcagcttacaccttaaaacactctagaaattaacaatcttattggtgaaatactcttatctttgtcttgtcaaagtttttaaagggctattaagactgtaagaaattattcaaattgcccttaaaaaatccacagagcaaaattattcttagactgaagctttaaaatttattttattaacctaaacaagttttaagctttctgataattaacaagggaagtattattcgatgatttctaaggctctcagaccatttcacattgctacacatttgatacctctttaaaatctcttttaaaaacagcagaaaatgactttctctttttccttttgttaaaaatgaatttcaaagaaatcatcactagaaatcataattaggatttagtttaatccacatctacagaagaaggagcaaaggcttgggaactcttgtttcaaaggtgattacaaatcctgcaatttgcactaaaaatattctctgataaaattccccaaagtaccactctgattcttttctttccgtttctttctttctttcttttgtaaacttatgggtttgctttgtagttggttattctttattcacataagctgaattttaaatttaccataattccaattttattctgaaattcttagtttttcagtttctcattattatttttgaatattttagtttacactgatgttgtacaatattctcattgttcaaaagtattaatatttaaaaggcatcaaaaccatatttttgttctctggtatcttcacatttctaggttttctataattttaaattaggaaaaggttccacgttatttttagctgcctgctttccctatgaacctaggatataagtgcagaagttcactcacatgcacccttcataaggagtcactccaagctcccagcacaaactgtggttagttttaataccaagatcctgtagtaactctatttacaagacgttcagggacttttaaatactaacaattttagtgtaatatcatactacttcactttttaaaaatgagatattatttgttttgtaacattttttgtacttgatatgcattttagaaaagcaaaatccttaagaatggcaaacaccaatataaatacaaaatcagaatacaaaaacattccaatgtctttgatatgtgaacatcatgatatcctggtcaactctcccctgtaaggagtagacagagacaggagggcacactaggtagaatgcaaaccttagggagataggccaatgaatttaaaagtaaaaatcaagctatgcctctgtaataatttctattaagcttttatacagatatatttcttataatgtcaaattttaataatttcacaccaatttttcataaaaatttataacctagaaatattcatttactttctcaaattaaacctgaaattaaatttacacatgagataaaaaagttgccttgatatgaaggaaagcagtaaccggtggatttcagatttgagagtttctaagaaggttagcagtgagatgattacaaaaagcaaccacacatcacttctactgtgtccttgtgttagaatggaaaagagttcttcttcatgagctctgaaaccacagtgaaccttacagttcatcaatccgatgtagcctgccctcgaactgaacttatttgtaaatactgttctaagggtacctaaacacttactaattggttaaatatgctgcctacattaattcctgttaaaactaaagaaataaaaatccatctttgttttcaagcaatgactgacatgctttcaacatagtctgtgtttcagaaaaaaatatttaccaggttcttaaaaccctttaaacgatggcttaagggacagtttcccttccaccctgaacagatctacttgcttagcttttacttgacaagacactcttcttctgaaactctcatctcatgagttaacaggttaattttttacacgttaaattgtcaaagaacaaaattacaaagaaataatattaaagcattcctagaaggatggctagtttgattatacagcttgagtaaaatgattactgaagtaaccttcaaaggcaggcatggcataggtttcagttgtacgtcttttaaaatcccagttgtgataggaacatgacatttaatttaaaaaacaatagtttaacccttaggtaaatttctagaatatcatatgaaaatgtacataatagcaaccaggattattataataatgaaggaaaaattctcatttttgaattgatactaaagcaaaaaaaattcttaaaatttcaaattatagtgataaaggaaaattcaactactttaactagaaaatgtctgcttattgaactattttgattatcataaataaatacacagataaggggttttatcagtattatcccacactcactatatcatccaccactgcaggaaataatcatttcagaattttcagtagtgccactgggcatctaagtctcagagaagaattctcctctgtggggtttctctaactgtaagtgaggtcgtatggagcatgggctgctgtccttagactatctctctgtattggtataatttaataggacttccagcaaaggaagttcaacaggcagggtttctaagcatcaaaaagccttagtacaatcaactcaactcagctcttgtgctactccctatctaagcaagactctaagagttacaggttttcatctggacattatgagtgtattttttttaacttcaaaaagagctggttttactaaaccccaacaaagtgtatattactctatatgagaaagaataacctctattttaataggtgaacttgtgttgaggttgacaacaaagaatgagatcctatttttaagtgcccaaacaccttcagtagctcaatgagctaacagaaccaaaagcaaaacttgccttgacttttactgacactgaatttattggtaattgtatttggtttgtcaaagtggcaaccgctcagtatccgaaagtctcatgcattttaagcacaaagtataatcctgactacttatagtcagagtaactatcttgagccagcaacataatgaacatgcaaaataaacttcagagggttttttttttttttttttgtaagtagtgatggaattctgaaatctttggacacaagattatggtggggaggggtcatcttcttcattgagactttaatctctttccaagcatcaggatttcacagggatttgtgcccctgtgctttccttagtgacttcttagaaagctgtagttgttcccaaagtgggaaaccacaagatgatgtgctcacaggtcactgatactgttttcatgtaggtatggacagaaagtgctgagaaaagtcagttagaaacaggaactaacacacaatggattgtcacaaaataatttttatgcagtatggcaaaagagaacactacctaagaagtctaaaaactcagttcttactttggtccatttctataaattgtaaaaacaaagcaaaatagagatttatttcccaaactctatatggctgtggaaactgaatataagtagtttccatcccagattagttgtaatcttaaatactgtacagttaacaatgtacacattttaccttttgaaaatactgcggacatctaagacacaagagcagacacaagagcagataggagctaacgattagcaaacatttcctggtaaacacaaatcatttcagcggaaaagatacaaatccataggtttcaggatatccaagcattttcattttcaaagtgcaaagttataacatatgcataggatggactatatataattttgaaatatatatataaacttttccatggtcttcatgagagccactcccgcctccccagaaatgtctactgtttacaatgttaaggagtctccaccactttgcctgtaagtttcaaccagaagtcctcagtgtacctgaagccaaactgagcattaggtattttacaaaatggctgtaaacccccattatgggcatacatggctctttgatctcactgcacagaattcataagtgttcaataatgctataccattacaccacacaccttcaactttttccatttttccacaattctttccaaaatcagcttccagagcaaagcaatgtaacatgaaaagtttctgggagggcttgttacataaaagaacagcgtggatgaaaactaagccacacacacatccatcttctgctgggcttgtttatccctcctctccctccatcactcctaaacggggggtgcacttgagtaatggaaagagaaggctcttccatcaccacacacttccagcacctctgactttggtcctctgtaagtctgcataggtgatgaaaaccctaagaaaagagaagctgtccctttaaaatgccctgctctgtcccagatcccacgtggaaccaacatcagcagcactttcccactaacatcaatgtgatgcaagaggcaccatccttttatatacataaaaccagaaaacttcagtccaacattccttagtgagggcgaacaggtgaagcaaacgagccaggaagggagaaaccaaacaactccccacccctccccagaaggttcgccagtcttgccctccagtctctctgggcaacagcacctttccacccctcctctggagagcccagcttaaagaaaggagggagccactaacaaaacccgaggcataaatgcgacgaaaatgcaatctaaagccggaaaggtttattcttccaatcacacatattaactctattaagaaaatggcatcactttttttcctaccccaaaaagcaacctcctcacagatcattaaaagggagttataaaatagcaaatatagtgtttatcttatctcagatcagtccacattaccaataagtttagtagtttctgcactaccacctccccctccctccccctgcttctcttgcattggattttcacgttttctcattgtcggtggagttataaaaggcttttgcccttcgaaagttttaaaaaataaataaatattaactccttggtccctgcaaagtccaaatggacttcaggggaaaggcggttcacacttttacctttggcgagaaaggggggcgcatcccggatttttagggattttttgcgattttttaacaatttttatttggttatatgcctgagttctccctccattttggttgtttatgatactgacaacaagctgtccctgctccgtcccgatctcctgctttcatttagcaccccctccccctacgcccccgtcgccacccggctgggtccggcgccccgcggaccccgcaccccgactcggctctcccacctgggcaggagggcaaaaacaaatgcatttctccagaaaagaaaaacctcttcggaaaagggggcaaagttaccccaagtcactcccagtaccccccaaatattgccgaccgcgggtctccgccaggccctctgggaagcgaccttcccccgggatgttttggtggaaaacgcggagagtttcctctcaaaaccgaatttatattaatttttcccttatttttcgggtctctaatgtcttccgctctctctgctgccgctgccgctgtcacaatattcacagcaccagagaggaggaggaggaggaggaggaaaacttttcaaactttccagaccctgaataaaagggttttttttttcccaccgacctcaccttcgggtccccagtcgcgtcgccccctgccctgtcagcagcgacctcgggagtccttgcagccccgccgcacgattttatttgattttttattattatttttctctctggggtcctgagcaggggctgggagtagcacaaacttttcctcctcctgccgccgccgcggctcctctgccccctcggctagtcccataatttaaataaccctgatattcctcccgctaaacgcctccccgccgccccggacccccggagaactcaccgcggagctttaacatcctccctccggcccgtccgccgcctttacaccgcccgcggaatttctaataatttttttctcatatttcgggctggacgcggcgggcctggaaattgtttccttacgcctctttccagcagccattgtagtgtatgcgctgcccctgcagctcaacttgcagctgccgccgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtctcacgccgtcccacccgctcctcctgcttgagccctcctcccgctgcccgggggcggagcgaactgagcccgccccaacctcacagagttccgcgcgcctgtcaatctggcagcggcgtgcgtggattggacaagctggaacggggggcgcgggggcagcacgttggggtgcgcgctacttaaggtcctgctgcgtgagccactgacgtgtttggaactgcagccggcccgggtgctggctgagtggtggcctgtggtgagtggtctccggcccctccctcccctggacagcaggcccgggacagcactgcgccgagggcagaccctagttccgtggcgccaaaccctcccgcggcgcggcatgctcctgccgctactcacgccacgcgattcgtccggccggggcagcggaaggtgaccccatgcaggtctgggcaccccggattgtgtcactcccctccttgccctccccaggtccccgctctacgccgcccccttccttcccagccccttttgtggtgtttacctgtgcccgccctccaccgtccgattctgcggcgcggcacctcggaaggcggtgcggtccgggagttacattcttggagattcgtctccgacctctcagatccctgtgatgtgtactttgacattttgtccctggtactctgtacccaggtttatggtgtgctgtatttctgtttccggatttaacactcacagaccagactctgagaagcctggggggcctggacttgttcagtaacgtgcccttcccccactgcggatcaaagctgcgaagagtgggaaatcaggaacttttttggtaagcagtttgccctttagagtagattttagcactatttctcagatgtgctgtaggtttgcagtcttccctcaggctggttttctttctgaatgtcatcttggaagtagtacagtgttgtaacagttgttcactcctgcaccttcaaaaagtaaacagataaggcctctttagcagggcactccatcttgtccttcagccacactcctccatgtaaattgacatttcctcttccttttctgttaacacaggaattcatacgaaggaggtgacattaggaaaaccatgtttatagtgcatttagtatccagaataaaaagcagtaaaacgggaatagcctgaagcagcaaatttgatgcctgttttgtgtggatactttttaaaagaatttctggctgatgataatgaaacaacagaatctcatgatcaggacgcagtgtgaattgtgttcgtatcagattgtcgagattattatatgcatgaacgatcaagcggagctctgtgggagacatgaagagaagactgtagattttcttagttctggtattctctcaggaagaggcagtcttgtaaactatcttccgaagaggaaaggcttctagagatagttggactttgtactgagtgcccttcctgtcaagacgcttctactggctgggtattttcaatgaagttcatggcataaatgattatttggtgattactgaaagttaaaggactcagagtaatcagattctatctccgggaaaagttgggctcctttagcttagacatcccgatctttaccagaatggaagaagttggactggatggccattgattcagaatatgttcacttcttaagagtttatgggcttgaattacttttctggaatatacattattttgtttaacattgtttttggtgacatttcatacaaaacgttggacttctctgaaaaggcccatgcatgtttgttttgttctgttttttaattcagtagagttgtgtacttcatactgccttatttctctggcatctgctttgatttttcggtagaaaagtgattaaactagagtagcatttgggtgtgtaagccagatcagccccttaagctaagtagaggacgttttttcaaagatggtgggtggctcatcaataccttatcgatatattgagataaatgaagccctttctcaaataattgtgacttggggttttttttttttttttttttttttacctcttcccctgcaagagaattgtacagtttcatttgaactgggatttgaagagcagttgtacttgaccatgactgattggctgacttcataaagtgtatgacttgacttccaatagctaattggctcttagggtaatgtgatgtctttaatggataaaacctttgcaaagctgtatttttaagactcaaattggaaaattactgagccacagtagcattctctgacctccttcaacccatggaaagtattaatctacatagaaggtagaaagggaattgaaaaattcattcattgtttttttaactatggctttttagaatgttaagtaagcagtaacttgacttttgtttgtgtgtgtttcattgtttcctatagagtaccttctactttgaaaattaaattttgtgggtaaattaaattaaaagtacttgtggggctgatgacattttctggtcatttccttctgacctgtttttctgtcgcctgccttcagtaagaagacaagatgcccatggtcactcggcggctgagagatcctgacataaacccttgcttgtcggtagggtgctttgcttttcattgtcatgagggttaacttggaaaaaccaatattaattttgtgggtatctgtcctaagcagttattgaataaaatatttttctgtgaaaaagatattcctggccagtgtattttatttcactataacacttaaaaatgaccaaaatgtgcctaacaaagactctgttcttcaattctgcttaactgtggaataaacagggtttggttgtcactgtaaaacttgtatatgtagcactaaggaaagtccttagtctacacatgggacagtacagcaaatttacaaccaatggttttcatcacagcaattatttaatctgcctttgagacagcctggcttgagtcatgggttcacagtaggattagcttatgttaagctcaatggttttcacaaaggtatcttatagacagcattgtgttgcaaaaataagtttttgttgacattaattggatatagcttgcaacactttgttgtggctttgccattcctgagaaatacaatgtaaatactatattgttgctatgaggaatattaatccaccatcctttatggggttttcaaaaatacacattacacagtatacatccattggtttatatcatctgtttccagcattaagtattgtttaggcaagatagtttttttaggcctgtgaagcagattccctgcgtatttgaaactttattttagataacttctcatagtcctacctttcactttgaagcttgttgtacaatctgcttctagttcaggcagcttaagtttaattaccagtagtacctacttcattttaaactcatggccttgtgctgctttctttttgaagtcacattaatgataactattaaagctgcctgtgtaatagtatgcttgcataacggagtgaatgaatgatagccaaaagtgcaccaagatgggtgctgttaatttaggttgccttgatgtagatcatttacttgtgtaatttacttggaacctcaaaccaagcgttaagatcaaaacatctagtcaaactgagatctagggaaagccaggagagctgcactgagctgtgggaggctggtttctgctgcttgcagtgtagccatgctcagagctcctgataccttacttcagctcctggaacaaatgaccatgatcagggctttgactcaaactcatgtgatcagatgcttagaaaactggcccagactgggcaaaaaagatgtcttttttaagttgagtgatttctggagtagttggctattatttttataagtcttcccaccaccatgcacaaaaataagccatttgatatcttttcaggggaaaacagcttcagaagtctttgtgtttgggtctttaatagatcacattctacattttaaatgatgatctcttacatatttaaggaatctgatgcttctaccagatgcatggatgaaaataactatgacagggaaaggtgttccagttacttcttgaagtacaaaaactgccggcgattctgggtaagcccaacttctcaagcttcttaggcttgtggccgtagctgagaataaccagtaatccacagtttcccagtgatggctgtaggtacacttactctttgaccttatcttctgagtgggattttagttctgtggcatccttgagcgcttgtttcattcttttccaaggtttaagactcaacctttaatatcaataagtcttcctaggtgagtatctttagtcataaaatagccctgagcactggatccaggtccttccttttctgatagactcagtttcacttcataattatgcacagcttttgtaagtggactgtatatactcctgtatatatactaaatgtcatatccctaacccaactcctgctaacaatgctttctgggtgcataatctcttcagtgtaaatgttaatagattgaaacatctggagttttagaagtaggttttggagttttaaaacttagattttagtattttctttttgaagaaacaactgaaaattactgtcagattattaccatttaatatgtaactgattttggtgttttctttcatgcctatgtatagaattctgtcatgatccaaagaagacaaaatggagttcagccatctatgcctacagcagcagaaagagacgaaattttgggagcaatgcaaaagatgccctactgagtatttgcattaaaattgtttctataacttgaaacatgttttggggtttttttttgtttttttttttttttttaatcaatgattgctgaaatcttaagtctttattggttccatcccaggcaactttgagttgtacgtggtgagacaattcagctagccttaaggctttggtgtttgctttcagtgctgtgacaaaaatgttattgccacactgtcactcatagaaggacaggactattaggaaggtctgttgtagaatttgggctcttttaggcctggaaagagatttagcatgagaacaggctcctgtggctgttagaaaagtggtcgtcctcaggaaaggaaatgattgcaagcaacacagtgatggaggaaatagtgctgtgtttaaactgagtaatgaggtggagaggtgattggcaggtaggtagattcatggtgggccataggcctggggatcattctggaagtccttgccctgctacatccaccatctttaaggttagtccattgactaggaggtaaatgggcacaggaagactaccgagtgaatagagtacacaagagccttacttctttagggacaggcttgattccaggattctggctaaaactccatgaatttttggatcacctaaggccatagcagcagttcatggaccacagtaataggcagaaataaataatgaaaaagaaagaaacgattcctagaagtaggatttctagtttcagaacgagagcacaggaggcatggagtttattggatgaatcagtgtgggtgagattagagtttacctttccctaatgataacacaggaactctccttattcccactgctttttcatagattcttgtgtacttaataacattctattctaggaagtcagcaaattattgtgtccctttgcatcatttgggcttgaatcaggacatctttttaatgggtgttaacaatcaactgtctagtctgaaacctagcctcagaggttttaaaaccagatgaatctttatattattttatttttcatggcctggaacttagtggtcctcacaactcagcctcctgaacaatgggatatcatgtggcttgaccttgattgttggatatggtcctgagtaaaaaatggattgagaatatttttttttgttcagaacttgtgggagtggccaagttttgtttaattgaggcccacgcccggaaaggaagcccataccctacaatgcctggatgaccaagaaccagagactggatagctcagagacctagaattggtgccttgtccagttgccatcagagaggcttcctgggatgaaagcagatgggagcaggtgcagagacccacagccccacgtgtggagagagtctaaattgacttcttcattgggttccttccgttggagatgggggatatgggaaaccagactttacatgtttattaggtctcaaaacacgggtgcctacttaacatatcaaagcagacctggctgccagtttctcccagcatccctcagtccttaccctgcccactacctcaaatttctccagccttgatctgggctttctttaccccagcaccctaacctacataatgcaaccattttggttgccctacccccttggtctggctcctcccccacccccactcttctcacacggcctggctcagtctagtcatgctcactctgtactctcccagatgcctttgctatggctatttggttatgctctcccttttacctacaatgaactttttcctgcgctgtacctacaagccctcttgtctttcctttttctttctttcttttttttaatttaatactagtgtaatcattttgtagctatttgttgatataaccctttaaagtttttcatttatttatgtttataatttctgccttataagtacttttattacctcttaaccaccagtgctctcatctgagtatttctccttggtaccaagctgagttatactgtagctgttaacttttaagtcgctgatgggcttttcagtctgagcaccagtcagaatgccagtttccacatctttagcacctttgaccttgatggtagccatcctaatggctgtgagtggtttgcatttctctggtggtaaacatttcttacatgccttctcatacagaaactgactttggaggagctccggtacgaccacgagactgtctggggcctgatgcgagtctcggtggagggtcctgatgcagacaaactgcaaggctctggggcctttagttgtgcttgaggatgatgagctctggctggaagagatacgtgccccatgtagtccaggagttcaccagcctgtgaggtcaagtgatgacagacacatcttgatgagcttcacctcatctggaaaggagttctttaggcctgcacagagatggaaggctgcaagcagaaccaacacaagatcagaaaggatctggtccagctgttcagttttccagatcctcgatggttcttatggcctccacggttttatcttattttgacttgggagagggagtcactcgctctctctctctttctctctctctctctctctctctctctctcatctcatgaagctaggttggccttgaactgatgatcttgagcttctcattctcttgcctctacttcccaatggtattacagccctgagccatgaccatgacagctgcgattgcagcttcctgagcatgcccctctggcatcaccactcaatcaactcatagatgttgtccacactttattgatccacattgtccagggaaaagtggtaggaggcttttaggtacaaattgaccagagagctctacgttggtgatataattttgacaaattatggctgattagtcatatggacctaactgccaaacaaaatggcaaaaaaccaaaacgcaacccaacccagcaacaacaaacctggaaatcaaagctactaagaaaaggtcccagacattattgctggaagggagattagaagtcagaataaggagtcaaagtttgtctcagagaagctgggtgtagtggcgcacgcctttgattccagcactccaggaggcagaggcaggcggatttctgagttcaaggccagcctggtctacaaagtgagttccaggacagccagggctacacagagaaaccctgtctcgaaaaaccaaaaaaaaaaaagtttgtctcagagaaatgttatcaaggcaagatacagttccatgagaccccaggacactcttgtctgagtgctttacatacgttagatgtaagatactagataaaagggtttgaatagtttcctcatctgtggattgatttccacttaaggtatctttatgaatcatatttttttcagttttattttttgtgactgtaagttaagcaacattatgttagaatattaatctatgcagtgcctttccccctcttttggtacctaatctaagagagcattgccaaatgtaaggtcatgaaggcttacatgtaatatacacctattttcttctgagaggtctatggtcatagcattaaagcatctttctgctttgagttacttttgatgtaaagtctcaggtgaatgtctactttcatcttttacccgtggctatctggttttctcaacaggtattaaaaaagactattctttgtctcattgaattagcatcttagttgcaaatcattgattatacatggtaagtagttatagtctgcaatctattctggggaaaccgtatacatctatccttgggctaacacatttatcttgattattttagttttgtatcagtgtcactattctgtgatgacctatgtctgttaagtgtattttctatgaagcactctgatgacaaacttacatgggagttgtgaatatgtgtgtacacttgtgtctgtatgtggaggccagaggtctatgatggtatctcatttaggctaagctggctgcacagtgggctctaggaatcgcagtctctgtctgtagtgctggtgttataagtatgtgccgccgcagcctgctgtggtggttagagggagaaatgtaccacgaaaggctcatgtatatgcacccttggtccctgagtgaggggactgtctgggaggttatggaacctttaagtggcggaggcttgatgaggaagtacatcattggggaagggctttgaggatatataacttcaccccacttccagtttgtttgcttgtttgtttgtttgtttcattttgaataagtgatctctcagtttcttgttccaactgcctgcagccatgtcttccctcatcattgtgcactctcctggaaccataagctcaaatcaacttttccatacatcacttaaggtcatggtatttcatgacagcaacagcaaagcaagagatacacctgattttcttaaacaggggtactggatgcctgagcttgcataagaagtattttaccaattcaaacatctccttagaccccttacttgtatgtttggagcaccaaaccctggaaattgtgtgtttgtgtgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattttgtcaccactgtttgtaatagttttattttattttaactgggaaatattttttggaagttaattttgtaattgtatatatgtataaaacacttagtgtacattcaacccagtttagtggtgagttctttagcctttgcttttttaactgggaaatattttatgtatttattatattattgctccccccacctctttcctatttgcccttcttttctctatttttggtagtatgctaactttgtattattttcttttaaatctcatgtttccattcttaaaatactttgtcttaatcctttgaggattccataccctgtattttgaacacattctctctgcccttaactgcttctcttaccaccctttcagccctcccatctcttcttacgcaactctgagatctattgaactctttcccagtagtctagtttttgttgcagtcttggcctgttctggaaggtgatcagtcctctaggtaacatttaaagaagtgagccatcattgccaatctgcttctcagttagtgatgggattatatacccacctttccctttaatactgggtctttatctggctgagcttttgcaggccttgtgcatgtggtcccaattgctgtgagttcatacctgtgtctgccatttgtgtctggaagacatgtttccttgtcactatctattatctctaattcttagtctttttgtcttctcttctagaaagatccctgaacctagggatgaggtattcatgtctacttgggggctgaccactcaactattattgaccaggttagggattctgtgttaattgacatctattgcaaaggaagctgtgctcgataatggttaagagatgatctgactgtgggggatagcaatagggagacattaggagttgttttagtatgtccattttcattccccctttatttaactctgcattttaagctttcttgttactagggattttcaccattgcttttcttttttcttttctaatttcttagtcttttctgttctcctatccttttatttttcctttctcttactcagccttacttcctctgatttattcccttctttttacttcattttattaatttattagttctacattaattctatataactttaaaattattctgcattagttttaccatttctagtttcatgatcattgtttatatattggagggttttaattgattaagtgtttctatatcttgcaaaatttcatcttgcagctattacagctttttttcttctttgtaagtgggactaagaactaacctctcaggagattgacctgctcaattagaagatccatatcaaagccaacagaccagtgaatcgtcgaacaaatcaggaaggaaaatgtaaaatttctagacaaatgatgatcaaaacaaaacgtaccagaaactttgtgccacacctaaactagttaggagaggaaagttcacaactctgagtcttacattaaaaaaaaataataaagtcatctcatgaaagtcttagaaaaacacgaatgatccaaaccaaaagcatttggcaaaaagaaacaacaaaggtcagggcagagattaatgacagactgaaagaacaatatataaactcaaacagttggttttttggaaagacaaccaagattgacaagcctctactaaatttgagagaagacctcagttagtaaaacaagagatgatatatatcagagtccaatagattctggagaactactaggaatcctttgacaactttttttaattagctgaaaagtctagaagaaatgaatatattcataaacacatatgaactatcaaacttagaaagatataaacagtttaaatagacccatagcaagcacttagggtaaagcagtgttttaaaaagcatcacaaaaagtcccaggactgacaaatgtatcaagttgtaccaaacttctcaggaagaagctgatgccatcacccctcatgctgtttcacaaacatggggaaggagttgtcaccactgctgaacttgccactgttacatttctccaagatcctgctttgtgaggaatggggctggttcagttgataatttaaatgtcataatgttagacttcaggaaatttttatatgttatcaactattcaaaagcaatatgtatgcatatgtatgtgtaagcgtgtgtgtgcgtgtgtgattttatcacatccctattcatttgctatagcagcagcatattacaggttctcagtggagcaggaaggatgatgttctatgtctgtcttatataagaattcttttgagaaactaccatgtttgcaaaatcctggaagccataaatgtttaatatttttctagtatatgacaaatgaccaaatgtttgtgtttggggttggctatagtttttagaattgagaaatgtacatattcaaacaatgtcaaaggactgacaactcaatgcaatagatctttctagaaatagctaatgtcaagatttttcaagatttcttattcgcaatcagcattatcagtatattttctttgcactaaaggaacatcatagtatatatgctccattgtagtttgctttttgcttttaacaggcatagtttggaataatttgaaacaggtggtagcaatcattttggggcttgttatattttacttgtaagataatttctaagatttgaatttttacattaaagatttctgtattccaaattttgtagatactgataactcaattaccttctgaaaagaagcacaacaatttaattttaacaataaagactgtgtcttttcctggcatcttcagtcccaactttaaaactctttcatctttaccaatcatgtgagtgaaaccagaacaaataaatacatttcttttgtccctttcttttaagatcctagctgaaaattcattagaagtcgctggctgtctttaggaaattatctcgtcataattcttttgtatacccttttgctttttgaatgttaaataattttctgtacagtgttttatgttgctatgtaattaaatagattattttacttatggtgtttgaagtttgaaaatactgccgggtagtggttgtgcatgcctttaatcctcacattcagaaggcaaaggtagggagatgtctgtgagttccatgccattctggtctacagagcaagttccgggacagtcaaaacttcacagagaaaccctgtctcagggggaaaaatactaaatgacaaatacaaatactgctatcagtccagtttcctctacaacatctgccaagtgcttatggtgtgcagcatgcatatggatgaacaacttcttgaggtagttcactgcgtggctggagggtaaaaatagcactgtggtaggaataacaaaaaaccaagagggaagcagtctacataagcacagaggggcacacatctatgtcatttcgggggaattccttactaatggaagacacagcatatgaagggaattagcacaagaggaagaatgctagaatgtgttcagactaacaagagccttgagcattgtgcttggtgctctatagcttgctttatatgtaagagaaagctagatagcgttttgagacaaaaattcaaatacaatttgcatataaaacataattctggaggcagacatattattatagtggccccagattcccacaatggatttacctgttctataacactgttcctgctctctctctctctctctctctctctctctctctctctctctctctctctctctctctctctctctcccccctctctcaaatgcagcaggtgaatctttccaaaatgcagaaattgtttcacttaaaatcccaaagacctacctaccctctcaggctgatgcacttcccatggtttgcaatactcttgtgatctggaacatcaagggagtgaattggaggaagttacccagaactcatgcccactgaccttagattttaggcatgaggcatgagattattgacatcccttccatacagtgacatcttgctattttcattcaccagcaccaagcataccctgttttctgatcttgaatgtctactccgctgctctcagctctgctatcttctcaggctcagctctcagatatgtgctgagcctttatgacaaccctggtcagattcactgtgctttctcatcatttgtatacaggcactgtggcatttccactactctgcatagctgggggacacaactattcactaaaatcaggcagtggaggactctaaatgtgatctttcacattctgccttctgttttttaaaggaaggacgaggaatggtatgcctcacttcaaacaggagaggggtgtggtgatttgatttttgttcataaagacaacagttgccagtgatagttttcagtttcaggagccatttctgctgttgtcagtgtttcagatgaacatcctgcaactgcatagagttctgtttgtgagtcataggctgtgctcagattgagaaatttgtaggagttctcaacaaatggctagttttccttgtaagagctggatggtgctatcacacagtgagatggtaggtatgcactggatatgcaccttcctttagaaaaaactgtgaaatcacattttaaaaaagactattttggggactgaactacttggggcttcagtggtggagtgcttgtttagcacacactggactgtaaaatgatcagtctacaaagatcacctaagtctacccactcagcatctcctgtttgagaccacttggatttctcattcaagtcctgagagttttcttaaagaaataaagaaagtaagggtcatttcaaagcacatacctgggtactggtaggaaagagggcaagctacaagcaaattcaaacaaagggaagaacagaaaatgacagaatgagagggtaattcaaccaggtgcagggtaactgggcaaagatggctatgctggcttctgaaacagccacaatgaaagtaaaaagccaaatgtcctgattaataacataagtattacatggcaaagtgtgaaaagagcattgtgtttatgtgagttttggctctgcgccctattatctggatcatctgaatgaattgtttcacccttaagcatcttctgtgttttgaaattataatttaaaaaattggttatagtgaccataaagaaacccatgagttgggtgggtagatactgatatttgagaggcgtgtattgagactggattattcatcactaaaagccacag

SEQ ID NO: 1694 - DNA, 342 bp, Mus musculus
gtccccgctctacgccgcccccttccttcccagccccttttgtggtgtttacctgtgcccgccctccaccgtccgattctgcggcgcggcacctcggaaggcggaatctgatgcttctaccagatgcatggatgaaaataactatgacagggaaaggtgttccagttacttcttgaagtacaaaaactgccggcgattctggaattctgtcatgatccaaagaagacaaaatggagttcagccatctatgcctacagcagcagaaagagacgaaattttgggagcaatgcaaaagatgccctactgagtatttgcattaaaattgtttctataacttgaaac

SEQ ID NO: 1695 - protein, 101 aa, Mus musculus
SPLYAAPFLPSPFCGVYLCPPSTVRFCGAAPRKAESDASTRCMDENNYDRERCSSYFLKYKNCRRFWNSVMIQRRQNGVQPSMPTAAERDEILGAMQKMPY

SEQ ID NO: 1696 - DNA, 25860 bp, Homo sapiens
  misc_feature (1)...(25860): n = A,T,C or G
gaatgtgatcaattgcacttctcccacaacaaactgctttctctacttttccctgcactgagggataaaaggtgaactaagaataattaaattcaagcaccacatgagatctaatgtttaagtagagcaactgtatctctggtatacagctgaaaagataacccaggctatgattaaaagtgctcctagataggaatttaagaataacatgatcttgagaacatattaaataaaagcagttacagaagtaaagttttaaaataactgtctgtcaccaatctctcagcagcaatattgtgagataggaagtacagacattagtttatactttcccaaaagaagggcttttaagaaaaacatctgtaactgtacttaaaaaattgaaataccattaaaagtattaaatgcttgataattaagaatttaaatacaacagacattcaaccaagtactgacctatttgtcactacttttctttgaagaataatgaaaataattgaatatatcacgatctttaagtaattttgaccacatatttgaaaaaaaactaataaatttattaactgttaaaggctagctgcttaggaacgtctacagaattttatatgtgtattttgtactttgtttacaaatttctaggcataaaaagtagattcagatacaaaaacaactatctgaattaaaattatgtatatttcagcagtaaatcaagttattcagtttaatatttaaagctttcattctatgtctaattaagcctgttacttgatagtttactttcattttgatttgggtaagcaaatatgacaatatattttaatacagcatctttcaaaacgtaatatatgccaaattattgctgaaaaaatgtcttacacctttttcttaaaaataaactgagcaaattacattaaaagctagacctgatagatgtgcttaacatacagcatagttaaatcagttatttgtttgtatgacagtagccctgagaatgctcacgttttatgaagcaagataaagaaaaacataaaatgtcactaactcctgtttggtgtgcctgatcatcacagaaactttccttcttggaaacattttaaaaatcttccaaataactagtagggctgcttccaccactcttggtgtaattaacctattttattatacatctatttctattctaatgctaaaatcctatgaaattgaatagtaaacatcaagtaaaatgctaccaacattagaagagaaaaatctagattgaaatttatacaattaaattacctcagtctatgacaaattagcaaaacatatgaagaacattttctcagatttatttagaaacaattttaaaggtgcaaggaaaacaaattcatgtttgaggtgtagcttatttataataggatatgctggttatattaatatttgtttttaggcttataataggttataaggtcataacaatccaaatatataaagtgacaactgttccataagttgcagttgtgtaacacagaataatggagctaatttctcttcaatggaatgcagtgcttaaatgaattatgtttaggaaatacagaagatagcttaagaaaaggaaagtgctcatatataataaaacagcattttcccttcattgtccaaagttgataaaaataaaacctacttattgtaactctctcagggtatgaagaaaagtgacgtgagctctatgtaactccagcattaagacaatacaagaaaaaatcaagttaccgagaaaatctggtagactaaaatccaaccggtgttattttgaaactgtacacttgaactatcttaagtttccaggtttaatttcttaaaattctcatgatcaagaacaattcaataaatatttactaatgtatcttcaaaggaataaaattgattatgacaccttccaattttgcctttgagccaaaggggctaaattcctcatttgctaattgatttctagtttaacagtctccaaaaatgtattttaaagttaaagggctctaatgtctaaccactggttaaagagagataattttttaaaaactgatatggcagcctttaacatatagcacttattctgagaatattatcacattcagaaacaaaaagataggaaatcacaatcaatatatatatgtgcaattccaatattggtctgcaataataattcaaatatttaatgagtgaaaggctaaaagggggctctcattctcaaaaaagaagagttcaagactctctaatggcacatccttcacaatctgtaaaggattctgttgccttttaagaaaagatgccccctcctctctcaaaatattttctaatagtaaaggcaacttctatcccagaagattataccaaaagtttagatactctttcagaaaagcacttgctaattaataaacgggaaagaaaaaattcctttaatcggcagcatagacctaaaaacataccagaaattaggagctttgttggtgaaatgttatcattatcttgtgaaaggctttttaaatgtgactaagtctgtaacaaattatttaaattgctctaaaaaagtccatgaagcaaactattcttagactgaggttttaaaatttatttcattaacttaaagttttaaactttctgatgaacaatgaagaaaatgattttcaataatttctaactttctcaggacacttcacgaagacacacattcaaaacaatcttcaaaatattttataaaaatagcaaaaagtaatttttcttatttaaaaaaaattctgaataaccattacaaattattcttagaatttaatttagtttaattcaaatctaagaagagaaggaaggcaggctttggggatctattttaaaaaggtcattatgaaaccagcaattggtattaaaaatattctttggtagatctccccaattatctaatttttaaggcaaaattacaacttttgccttgtagttggttattatttattcacataagatgaatttttaatttaccacaattgttattttactctgaaattcttatctaccaaattctttaccatgaattttggacattttagtccatacttattgttacatactttcattgtttaaaattcttatttttaaaaggcaccaaaaaaaatttttgcttcctaacaccttcacattgctaggttttctatgtttttagattaagaagattccacttttaaatgtaaggaaatattttaagcaaatttcttgtcctattaacctaggacatactgcataagttcattcattctacacatgcacacacattttttaggtagtcatctcaaattcccagcacacactgtggttagttttaataccatgatcctgtagtaactctgtttataagacatccagggacttttaaatactaacaattttaatgcagcataacactacctttttaaaaaaataagatatttctgttttataaaatttttaaatgttctgataagcatttttttttaagagcaaaattcttaacaacaaacaccaatacatacacaaaatcagaaaacaaaaatacccaagtgcccttggaggttccacaccaccatatccttgtcagtaccaccctgtaaagaggaggcagggatagctataaacagtgagtataatgcaaacctctggacagcagactaatcgatttaaaagtaaaaatcaaattatgtccctgtaataatttctactaggctttcatacacatacatttcttacaacttcaaatgttaatagctcaatacttttataaaatgttataatctaaaaatcttaatttaatttctcaaattttacaatgaaatttgcaaataagatataaaagttaatctaacataaatgaaaagtagtaacagtggattttaggtttgagcatttcaaaaaatttaggcaataaaatacaaaaagcaaaaattagttacctccaaagtagtcttacggtaaaatagaaaagaattcccatgcatgaattctaaaatcaggttaactttacagctaatcaatctgatttaccctgcattcatattttacttacttgtaaatacttttccatgactacctaaacacttactaattggttaaatatgctacctatattaattcctggtagaactaaagaaactaaaggtctacctttgtttttcagaagtgactgatatagtttcaaagtattcaatgtttcagaaaaggtgtttatcaggttcttaagacatttaaaaatggctcaagggatgatttatagcccttttaccttgatcatattcactaccttggattttgttgaacagattcagtttcctccttttgaaactcttcccttactcaaataattaaagaatctaagatgttatcaatataaagagaaaaaattaatatttatttcttatacacttgcaaacacaccaaaaagaatatgtattccaagcaatgtaagtaagtttcttcagtaaaacttttttttccttggggatgtgtgtaactggtaattttttatatatcttaattttccaaagaacaggattctaaagaaaaaatattaaaacattcttagataaaattattttgactacacagctcaagaggcaaatgattactgaaacaaaacttcaaagatagctatagatatatgttttagttatctggctttccaaatctcacttaagacaggagcatcacatttaatttaggaaacaacaaatttaatccttagaaaggaaaatttgcagaatatcaaaccaaaatgtacatagtgacaatcaggattacattaaaaatgaaggaataacccccacctgtgcatgttattaaaacacaaacagcacccttcaaattttaaaactatactgataaagcaaattcactaatttattttgctataaatatctatttactatttactaaaatattttggtaataatatacagatatagaatgtgtcaatattagcccacacttataaatcttccacagcagataaattctttatagaatttcaagtagcaaaagtaggcatataaatttcaaataagactatcaatatatgaggtttctccgattccaactgaaataaagattttgactacacaatatcatgacattatttctgtatactggtataatttaatagcttcagaaaaggatgttcaacaggtagtatttctaaggcatcacaaaagctcagtacaatcacttcaaattaaatattgtgctgtgccccatctaaataagactctctaagcgattacagattttagattggtgcactctgagtgcgttttctgaacagacaagtagctagttgcataaaatacaaacatgaagaaagttttacaccaccctatatgagaggaagaaaaaaaatcacaataccagcacttttatttagattgacaataaaccagtcatagtgtccaaacaacctgaataacacgataatctaatataacttgaattccttcatttttttatagagattgaatttattgatattagtatctggtttgtcaaagtggcaattattcaagatctaagtctcatttattttaaatgcacagcataattctgactacttatagtcaatgtaactgtcttgagccaaaatacaatgaaaacgtaagataaaatgaaaaggctttgtaagtcttaatggcattctgaaacctctggacagaagatcattgggcatggaggagtttcccttctctattgatagcttaatccttttccaatcaattttgatttaactgtgggtgatgagattaatcttttaatgagttcttagaaagttgtaattgcttccaaaatcagaaaccacaagatgatgtactcaaacacgttactgatgtgatgttgtatagaggtatttacagaaagttggaagaactcagttgtaaacacaagttaacatacaatagactacaaaaataataacttgtttatacagtagggcaagaaaaaacattctatataagaagtctaaaaattcagctctaattttaatccatgtctataaataataaaaacaagaggaaataaggatttatttcagaaactccatatacctgtggaaaatggaacacaagtaatttctactgaagattaaccttaatccccattatagtacagctaacaatttacacattttaaattttgaaaatatcgtggaaatctaaaacataagagccgatagtagtttatggtcagtaaacactttctgttaaataacacaaataaattcaacttagaaaatgaaaactcacagggctcaggattttaaaaatcttttcatttcaaaggcgcaaagttacaacccatgcataggatggactttaaaaatggcatgtgtaaacttttccatggtgttggtgtgtgtgctttccttccccctaaagaaatgcctactgcttacaattttaaagaatcttcaccactctgtaattttcaaccagaagtcctcaatgtaccttaagccaaattgaatattaagggattttacagtttttacaaaatgggctgtaaaatcacattatgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcccttgggccgtagcggggcccgaatgcacttctgcggcgcggaggcgctcccgccaggcttcgccgcagcgcggacctcttcccgttgctcttcctcccgccacacgggtctgttcgctccgggggcgaggaagatgacctctgcctagtccgggcaaccccagctcttcttccactctcctgtgtagcctctgaagcgcagttaccggccccacccccagttccctgcgttttcctcgccccttgtctctctcggcatggtctcggcacagcaaggtgtgttcacctgtgcgcgccgtccaggatcagatgctgacgggctacaccgcggaaggcggcgaggcctcgggttcgcccttcgtttctccttgccctgcgcgcccacctccggcaggccacccttgacttcttgcccccttccactttgcacctggcagtgggttaacggcacggcgtgtgcagcttccgggtttagcagagccgcggaccctgcctgggctccgaccacggggcgtgtgggcatgaacgtgttcagaaacgtttccttccccctgccctttcaaagctacttagagaggggggacgtgaaccactggatgggaaatcaggaactgctttattaagcagtttgccctttggagtggattttagagttatcccctgaatgtgctatggttttgtggcccctccttcatatctttgcttggtttttctttctggttatgctctgcaagtagtagagccttgtaacatttatttagtacattcaaaaagtaatagacaaggcccctttagcagagcactcgatgttgcaattcagccccgctcctcactgtaaattgacatttcctcttcaattccagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctaggtattatttttgaagaatttctgactgacaataaaatatagagtaggatactttcatgtaaggcacgaaacttaaatttaatgcaaggttgtctgatccttgttgagattattaaatctaaggtgtatgaagagttctgtgttctcacatcataggataggtgtaaaaaagaaagctgtgaatttatttactatcatcatctctcttaggaagaagggaagtgtggaaaaaaattgtcttcaggagaggaagaagcttgtagatataattgaacagcatcttgatttcttttttgccaagatgttactgttggctggttattttcttgtattgttcaatgaaaatcataaaattattattcagtgattacttaatggacaccagaataaccaaacccttttccattcttttttttgcaaaggctggtctcctttggcctggacgtcctgatctttcccatagtagaactgggctgggtgtctctttttttttttttgagacggcgtcttccactgctgtcgcttgggctggagtgcagtggcgcgatctcggctcactgcaacctctgcttcccaagttcaggcgattctcttgcctcagcctcctgagtagttgggattacaggcgcgtgccaccacgctcagctaatttttgtatttttagtagacagggggtttcaccatgttggccaggctggtcttgaactcctgacctcgtgatccgcccgactcggcctcctaaacttttgcaaagctgtatctctaggaattgaattggaagattactgaagcacagtagcattccctgacttcctgcaacgcagggaaatagttaaaaagaagatgccactggaagtaaaatttcaactcttttgtttttgaaacagtatagcttttcataatgtcaactaagcaataacttggctttttggtgtgttggctaccctactattggccataaaataggcactctggtacttcagttgatgaatgtttttgctaaagttggactgtaccgaatttcattcttattttgtacgctaattggtgtaaaataaggaagtaattgttggaatgcatactgtattcttaggttttattagtacatttggttgcttaaacttaagaataagagtaaacaacaactgaattataattgaactatctttctttttcgtttttttgagacagggtctctctctgtcacccaggctggagtgcactggtgcaatcacagctctctgcagccttgacttcctgggctatcccaccttacttagccttccaagtagctgggaccacaggcacacggcacgacaccaggctaatttttgtatttttggtagaaatggggtttctctgtgtcgcctaggttgatctcgaactgctgagcttaagcagccctctcgctccagcctcccaaagtgctgggattacaggcgtgagacaccgcacccagccagtagatgcatttcaatccaatatatggcctttgtgttgaggcatggcaatacaaaggaaaaacacgttcaagtttttattcacaaagtacagagaatacatgaagttcctcactaagtgatcattatgccaaaatcaaaatttcaggtacttttagtgctattgagatgtattgatttattttctgtcaactactgtataattattttttttctgtctaccctcagtaagaagactgttagaatgccctcggtaacacagaggctgagagatcctgacataaatccttgtttgtcggtaggatggtttgctttaattttcatgagtgttaagttggaaaaacaggctgctctagttttgtgggcctttgttttctgcagttgttgaataaagttatttctctagaaaaaatattgttggccagcatatcctatttaactagagcatttttagatgtttataatttctctaacaaacattcatcttttctttagttttccttatttgtataatatgcaagcatttggttgtcactgtaaaactagacaggaaaatgtaacactgagaatatttagtccaaacatggaaaactggaaggtatgatatttttaaactgtcactgacatttattgtttcactagcaataatatcaccatgtccttgacaacctggctgagagtaatgggctgataatataattagcctatttaaagcttaaaggttttcacaaaggtatctgataaacaaaatgttttaagagtaagcttttattggcatttatttggtatgatttgcgatacttacttgtggctttgctacgtttgaataatgtagttatcatactggtcccatgaaaattatactctttagttatatgcattttccaaatatatacattcattaaatatttggcacagaaattcagctttgttctgtttacgtagaacatgtttcttagatatgtgttgcaaactgtctacccatatagctaaagctttcctttagatctgtgttccccaaccttttgggcaccaaggaccggttttgtggaagacaatttttccacggatggggaagggggcgggcgtcaaaaggcattagattctcctaaggagcttgcagcctagatccctcacatgcacgcagttcacaatagggttcgtgatattagatcccacaatagggatctaatagcattagatgagaatctaatgctgccactgatgtgacaggaaggggagctcaggcggtaaggctcacttgcccattgctcatctcctgctatctggccgggttcctaacagaccgaagaccagtaccactttgtggcctgggggttggggacccctgctttaggtgacctcacagaatcatacctttcacttttaagtttgttattcaatctacttccagttcacacagcttaaatttaatccccatgtggcacctactttcctttgaatttatagcttgtgttgttgacttcggttttgaagtaatatctattaaaattgcttatataatagtgtatttgtataatggagtaaatggtagccaaaaatgcattgagatgaatggtgttaatttaggttgtcttgttgtagaccagttattagtgatttacttggaatcttgaaaccaatattatgatcaaacattgaagccaaagtgaaaatctggaaaaacaggagagatgtactgtgagtcaggagatggattctgattctagttgtgcagtagtcatttaacacattgcaccttgcctcagtttcttactaaaatggttactggattaattgatcacagttatttggctcaaattcctgtgatcacatattcagaaaactggcccacattataaaaaggaagatgttagcctgagcagagtgcatactgggatagctggcgagattgtccagtttttattagtctacccatcaaaatgaacacaaatgaactatttcacattatttgcttctggggaagcagcttttgtttgtttgtttgtttgcttttagatcctgttctaccttttaaatgatgcctctcttatatctgtaaggaatctgatgcttccaccagatgtctggatgaaaataactatgacagggaaaggtgttccacttacttcttgaggtacaaaaactgccggagattctgggtaagcctagattggttagctttgtgttaaaacccatctcctagggttgaaactgaagcctaaaattagtcagtacccacaatcctttcccactgatggctgtagggaaacttaacttttcaactttatcctctgtgtgctactttagccgtgaaagatccttgagagctcttgttagctgcctcgtcgtcctctaagctataagaatgcagttttaatataggtgggtcttcttagacatttaagtatctgcagccctaaaacaatgtctttgttataaatttagttttcctggagatgaacagaatgtttaacttcccttgtcataacacatcatgttaggcttcaatttctgcctttttctctctcactgccatccgtggaagttaaaatggtccatttttctgaaaacattggtatataatttctgtttccttgaaccacgggatccagctatttcctttcgctttgctaaatgcactgttggttttatttcacgattattcagtagctcttcttgacagactgtatatacttttgtactttgtactttgtatattctcatcccaattgctgttaatgtattcctgtgggaatgagtacttctatttaattgttactaatttaaatacgtttatctggagtcctataattaggttttgggattttttttttaaaaaaaacttggtttttagaatttcctttttgaggaagcaatagcaaattactggcaaatgattagcatttaatacatgactgattttggtttcttcttttttattttaatgcctgtacacagaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaattcttttgatttgtattgactgctataaaaatgatggattaaaataggaccagaaaagaatgaatgcctacctgtgtaagaagtatttttgtatttttaagcacacttgttaaagggcttggaattttaatgtcactcctttgaaggtacataccaatatcaacattcatcttgtaactagttgtcctgatgccactcttgttgagtctttattttcagtacctttgccttattgctgagcacttcaggtaaagacttggacacctgccttcccaccaggccctcgtgcccgctgggcctctgggttgaggttgatgtagttcaagaactgcagttggctgccgggcgcggtggcttacgcctgtaatcccagcactttgggaggccgaggcaggcggatcacgaggtcagaagatcaagaccatcctggctaacatggtgaaaccctgtctctactaaaaatacaaaaaaaaattagctgggcgtggtggtgggtgcctgtagtccaagctacttgggaggctgaggcaggagaatggcgtgaacctgggaggcggagcttgcagtgagccatgatggcgccactgtactccagcctggacgacagagcgagactccatcatagaaagaaaaaaaaagaactgcagttggcttaccagtggcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcttacttgacttcctgaaagactttaaaaagataacagccttattgagatatgtcatgtatatcaactcttaaaagtatgcaattcagtgatcttgtatattcatgaagttgtgcagctatcaccacaaatcaattttagaaagtaatcatttcattaccccaaactgaaaccctgtacctgttagcactcactccccttttcattttactttttatttatttatttttttgagagagacttgctctatcgcccaggctgcagtgcagtggcacaatctcaactcactgcaacctctgcctgccagggtcaagtgattcttgtgcctcagagtcccaagtacctgggattacaggcataagccaccacgcctggctaaattttgtattttcagtagtgacggggtttcaccatgttggccaggctgtctcaaactgctgacctcaggtaatccaccctcctcagcctcccagagttctgggattacaggcgtgagccaccgtgcctggctcattttattttttagagatgagatctcactctgttgcccaggcttcagtgcattggcgtcatgatggctcactgcaggcttcagctcctggcctcaaagcatccttccgcctcagcatcctgagtacctggagttgtatctgcgtgcctggctcccattttcttctaatgccaacctccaacacttaggcaactggtaatctactttctgtttatcttattgcctatttatggacatttatataaacggaatcatataatatgtggtcttttgtgactggcctctttgacagcctaatgttttcaaggttcatttatgttgttgcatgtatcagtacttaagcattctgttgtatggctataccacattttatttatccatgaatcagctgatgggcatttggatttccacttcttgcctattatgagtcatgctgttttttgaacattttgtacaagtttttatgtggacattaatttctccttaagatatatacctaggagttgaattgctgggtcacgtggtaactgtttaaccttttgaggcacaaacagtttttcaaagtggctgcactgttttacaatcccatcagcagtgtatgagagttccaaatttctcaacttcctcattaacacttgttatctgctctggattacagccatcctagtgggtgtgaactggtatctccttatggctttgatttgcatttccttgatggctaatgatgtcgaccaaattttaatgtgtctattggcagtttgtatctcttctttggagaaatgtttatttggatcctttgcccatttttaaattgagttgtcttaattactgagttttaagggttctatatataccagtacaaattccttatcagatacgtggtttgcaatttttttctcccattccgtgagctgtattttcactttatggtgtactttgaagcataaaagtttttgattttgatgaactccaatttcttattttctttcgttgcttttggtatcatatctaagaaagcattgcctaatccaaggtcacaaagatttccaccttttttcatagagtgttaatggttttagctcttacatttgggtctttgtatattttgacttaatttttgtacattatgaggtaggagttaggcttcattcttttgcatatggctattcagtgttcccagcaccgtttattgatgaagactattcttcattgaattgtcttggcacccttgttgcaaatttgctgactgtacatgtgagagtttatttctggcctgaaattctattccattgatctgtataggtctatccttatgccagcaccacactgtcttgattactgtagctttgtagtaatggcacagctctttgatgattggtttctataagtgtgttttttataaagtactttcaatgacaaactaattgttttgggatttttaatcagcaaatccttaacatatatgtaatgactctgtccaggcaaaacttgttcagtttaaaatttgtcttcagtaattccctaattcctagtttacctctttacacctaccctgaaaacttcagtatactcttcttataacctggttgttcaagatctcatggcaccacttttgagtggcagtcttgggagtttttctcatcaccactgttaaatttgcctctgttgtatttatttccctttccaagattctactttgggagaggtgaagctaattaatttgataaattgtgtcagtgggcgccatgagaaattttggcgtcggcaagcctttgatatcaattatcaactgacaaaatatagagaaggcattttgctgtgttcatgtgcatctctgtcctgcaggaaccatcttattacagattctcagtgggttgggggaggatggtgcactgtgtctgtagcacggaaaagcatcttttttttttttcctttttgagaatcggatctagtatttgtaagctcctggaggacataatatcattcacggttatagccataatgcctggtctgcttctattatatagtaaatggtcaacaaatgtgtgtgtttgaggaggtggtggcttttaaaattgaccacactgaaaaacatgcaggttcaaacaatgcaaaagggtatacagtgtacaataaatctgccccagaagcagccggtgtcaagttttcaagattttccatgcatataaaagcttatctattacataaaaagaacatcatagtacgtgagctgtaggataccttgcttttttcacttaatgatattaagtgatattaagtttggaatgattttctatctgtgattatagatttactttatttctttcagtggcttcagtttctgttttatgatataccattattgaagcaatctcctgttgatgagtgtgctataaacaaggttgcaacatctttgttcttgggtctttgtgcgtgtttttatctgtaaaattgctaagagtggaatttctaggttaaagctttttgcgtttaaaaatgtgtagatactgcaaatcaattgccctccaaaaaggaccacaccaatttatacgcttataaacaaagcctgtgagtgtttcttacctgacaccctcagtcccactggatactttaaaactctttcatccttaccaatctaatcagtgaaaaatggaactgcaggttattggttttcccttgctcatttaaaaaatgttggtgtgaatgatttggggacccttggtctatcaaagaaattacctttttgtcgtatgtattctatgtgtattccctagtttgtcttttaactttaatttctgcttgtaaagatatttctgtacagtgttttacatttcaatgtaattaagtggatcagtttttttatttatgatttctggagctcaataaatattaagtgaatccaagtaccagtactgctgttaccgttaaattctgctcaacagatatttgccaggcgtcgataatgagcaaaatgctaggctaacgttgtggaggagcatggatgaataacactgtcctggccctcaaagaattccactctgctgtaagggaaaatgaaatgatcaccataataggaataagagcaaacttctaagaggggagcctcaataaatacaaaggggcaataaacacatagcatgttagaggagaagttctcacgggagccagggtgtgtgaagggaggtagcaagagaaaaagtctagaaaggtaaaatgggtgtagattatgaagggtcttgaatgccatgcttggtattttagaccttattctgtatgcaagagaaagctatgaaggattttgagatggagaggatcaaatctagtttgtgtttagaaaaatctagaggcattgaggcagacaggttattgcagtgattctgaatcacactgcagctgtcttaacttttctcccatcgaatcttacccccgacctcccaccgccattccttctgtatactatggccaggcaaatctttctaaaacacaaatgaaataattcctctgcttgggaaaaaattcccaagacctgctcaccacctcaggcgcacgttcacatttcttcccttggtttacaaaatcctctgagagctggcacgtttataaagggagcagcttgaggaagttagaaagggatttggttttggacacataagacccaacccatgtccttaatgaccttaggttttagttagatagacagacataaaaatatctaagtgcaggctgagcatcccttatctgaaatacttaggaccggaaaagttttttattttgattttttaaaaaattttggaatacttgcattatacttatcagttgagcatcccaaatctgaaaatctgaagttggtgtgctctagtaagcgttttctatgagcgtcaaatttgggatttcagcactttagatttcagattttcaaatttgggatgctcaacctgtgcattccttccatgcacactcaccattcccgatgtatcctattttctgaacttgaacggccatctcttgactgctccagttaaaatttcacctgtctgttaaggcttagctcatacgaaatctctctaaggccttcctcatatgcctggtcagaattcttctcccctcctaattccccctcatctctactgtaatattcactttgtgtactctgggtagctgggtacattactgaacatggtaaaatcaggcaaatcaagtcgcctaaatgcactctaattatttcaccttcagtttttattttgcagaggaaaaataaaagaataaaatgtagtttaagcatcagttgctttattccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattttcttctccttcacatcctaccatgatcatagttccttaatatatacctggaatctccaataagcaaggagtacaaaaacattttactggggggaggtggggagattgtaaaaggaattggacctatataccaaatcattgagaagaaacttaatatcatccatcaacatttagagcacgacatatataggtaaagctgtcagctagattgtcccactaaccataaccagaagtcctctcctttctcttccttccaaagctgtgtttcatttccttcaagaactgctctagtctcttctcacttccactgaaatctgtgtgctaattctgcctctcctagtcctgttcctcaagcacctcttcaacctcactgcagcttcctcgctttccaccttccctgtgctgtagagctgagtacagctctaggtggctctgtacatgattatatgttggtgtctatcattttatcccacattgtacacataggttttatctgtcacgtcctgcatgaaaatgcagaagcagagaccactggggtacttcatatttgcacagccctttgcagtttataagatattgtcagaaacatgatcacctttaagatggaatacaacccaatgaagtcagtatttgtcctactttgtaggtgcaagatggaaactcacaaagtttaagtgacctgcctactgaacagggttctatgttgcccccactccccagtttctccctgtggtgaactccacctgctcagtgtccttcatttcctttacagctcttgactgtgactattattcaaattactattcatttcaccatttcatacttactgagtgatacacacacacaaaaaatgcttctgtagaacatgtaaaagtgaatgaggatgtttatactgtaggagaaaattacaaattaacaaataccattgattggataactgattatctactaaaccttcttatgaactctaagaaatctttcaaaatgttggattctgtataccctgacaacctcatcacatcctcatcccatccactgttatcctctgataacagtgagagatgacattggtgagagatgataacatgccctttgtcataaagtcaaaaggaagaataaggcaaaaagacttgatcatctgcaaagtagacttctcccccgctggataagtaggctggttttgtcattttcttgtgctggtgtttcctgacacatatgtggactccttaaagacttgggagttgtggactggcatggggtgttttgaatttatggtacacaccctgggcaaccagagtgtcatctccctgtttctttcacttcatatatacatatatgtcatcttgtagaacagaattccaaacccttgacagcttctgtatataattcctacttttgaagaatgtctttcataactttaatagattgcatttgtctccctctctggaaaacaaaaccaaaggaccaccactgcaacataaaacccagactggtgaatactcctgcaatcctgctaagctgaggctgtacatctccagccttctcagcgttatgacttcccatgcctagtacaagggtgttagactagtgtttgggtcagtttcctatgtttcctttttaaatctcattacttatttgcttatttatttttaattgttgtatggggatggaagagaagatatgaaaagctgaggaaagagggtatacaatgggaggtgtgtcactggtgattagaggcatggtctcttcactggctggatttataattctccttacttatttttaactgggagctttggatacattcttagatttaaaagtctcaagttctgtaactgtaaaatgccagcctcaaagagtgacctgtggatattgagtaagacaatgtctgtaaaaaacttagcaccgtgactggttcataggaagcaccaataaatattggctacttttattattctctattgctaccttttgaagagaaaggaaaataaaaagacacttatgaaatctctgttgaaacaatggggttatattttggtttttatctgctgaaataatagatcaatattccctaaccgccatgctgttgagctcctgatgttctcaaaattgcatcctagtcttgagtaagaattcgttattgctgaatgattacaaaactaattatagttattttagtatctggatatctctaagggagagggcaagctcgataaaattgcatggtgttgcaagtcattaatcttcaagaagacagtaacatatttccaaagatagccagagcatattatagcaattaattggaatagagaccttccttctaaactataaaataaatgatgggatgggttttcttagaaggggtgagcaaccaaaagagggactgcattgcataatgaaacattgggcactctgaagaatataggctagggtgggacaaggaaaggataagtttagattaaataaaagttctgggcaatgtggaatgtgggaagaaggtaacaaaagagagaagaggccaggcacggtggctcacacttgtaatcccagcactttgggaggccgaggcaggtggatcacaaggtcgggagttcgagaccattctgaccaacatggtgaaaccctgtctgtactaaaaata

SEQ ID NO: 1697 - DNA, 1589 bp, Homo sapiens
ccagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaa

SEQ ID NO: 1698 - protein, 102 aa, Homo sapiens
NVKKLMHQTRTGKKTVRMPSVTQRLRDPDINPCLSESDASTRCLDENNYDRERCSTYFLRYKNCRRFWNSIVMQRRKNGVKPFMPTAAERDEILRAVGNMPY

SEQ ID NO: 1699 - DNA, 88232 bp, Mus musculus
  misc_feature (1)...(88232): n = A,T,C or G
cacatggttaacagtagggagagtgcaggacatagcatggggagagaaacttgaagaataagtgtaggtgcttaacgctagctgcttccttatcagccagaacaatgtctcattcttaggagactcttgagaaattcacttattaatagacgggattaccaggccctggggaaaacttctgggcttttattacttattcatttatttttgacgaagtatattggaagtacactgggtcttaatggaaaataggtggggagagaggaaaatacattttcaaaagagaaatttataaaccaacaatatcaaacaaatagttaagatggcctatgtctaatacatggcatgtggtagttttcaataatgatagctttgatgtgtaagggagtttatatattgaactcttttatattatatacatatatatagtatatatattgaactgactctccaaatacctagacatgagacagaggctaaagttgggaagtgccacagcttttctctagttaaaatattttttgagaggtcaggggtagtggtacacacctttaaaccagtactcaggaggtggaagaaggcaaatctttgtgagtttgaggctagtctcatatagtgagtttcaggacagtatggagagagaccctgtttcaaacaaacaaacaaacaaacaaacaagcagcttaattatgcaaggtaatacttttttcggctggcagcagtgggtgtctgaacctatgttttagctcctcttcgtgcattggcacagagaaagtccatgaagccctgtagcctattcttcatagataatatcagcatacccagactactttttacaacacagacacctagggaacactgacattattacaggcatcaagctggagtgggctgcctcttttcttttttgcaattgagtggaactgtgtttgctagttgaaggatggcctgcctgtctcctacggtcttttccaacgacaacagcagtggccagtctgagtgtccatggtctcaatctatgtgcaatctaggcaagactgctggcaggcaagaggggccgtgagatggtgcagaaggtctgagctttggatgcagaattactgatcagaatctacatgcgtttgccttgtcaaaagcatatctagcatactgtgcttttagcatagagaatttaccaatatgagtatctcagttgttcatcaagtagaacttagtatttgaaagacaccagctaattactggacatttgcattgagcatcttcttctaggggaccttagggatgctcagaactttctggctgatcatcagccctgttatagccagttccaggcactcacgtaatcacaggaaacctcctttgtagggatgacctttcttcagtgtgatgtcggtatggactttggagtgtggattccagtctcagctctgcattagttgcatggtctcagagattagagagtgtaactcatagactagttctaccttgcaggttctttaagatgattagagacagaccacttagcagcatagcatgggcatatggtgctacgatgcagtcagcggtgctgatgtttgagctgatgatcggttgttatcaaacctaacttctggctggggagtttcctgttgagtattgctgaagttgaggtgaggtttaccaggaacgtcttctctttcaaaccactacagtcctttcccttattatcttagggttttactgctgtgaacagagacaccaagaccaagcaactcttaaaagtacaacatttaactgaggctggcttacaggttcagagcatctgcaattagttgtccagtttcacagtgtgggtgtgaatcacctggccaggcttctgtcctctgtcattgttagtaactcaactgtggaaatagtcaagaccttgcactgggactttcagtttattacatggggagaagcaggcagttcctgccagctgcctgcttctgtacctgccctgattgggctcttcagctaatcatgatgtactggctaattttgtgtgtcaacttgacacaagctagagtaatcagagaggaaggggcctcagttgaggaaatctccgtgagatgcagctgtaaggcactttcctcaattagtgatcagtgggggaagactcaggacattgtgggtggggccatccctgggctggtggtcctgggttctataagcaagaaggctgagcaagccatgggaggcaagctgggaagcagtacccctttgtggtctctgcatcagttcctgcctccaggttcctgtggtgtttgagttcctgtgctttttgagttccagtcctgacttcctctggtgatatgcagcaatcggaagtgtaagctgagtgtaactctcttcctccccaccttgcttcttggtgatggtgttgcttgcagcaatagaaaccctaattaagacacctggattttaggaagcgcgactgacttgctggtaggcggctcacttgtgagcattcattccagatgtgcaaaagccagggctgagaaaggtgctaggtgtctgagactcagagaaggctcaggaggttcctgctttctgacagtctatgcctggtcaagtagatggacagagagactgtggaagaactgccaggcctggttccacctaggatgtgtgagcgttcaggacaggggcttctaatgcagactgggaaatttctccttactcaagaaactgtatggagagacccctttgattcttctcacaacaactctgaaggcacttacagatctttttttttgggtggtttgtacagtcttttagtttcttcatccaagggatcatttccttcatcttccaggactcatagataaaaataacctgtaaggtttgaagcatggatctcagctgatggcctcacttcatactagatgtggatgccagctgctccagacattctgtgatggccaccaatctctatgctttctttgtccccataaggtcagtgcggtagctggaggtatcaagcttgtagacagacagacagacagaagggggtgcacttgactttgcttagcatctctctcagttacttctatgttgctgggatgaaacaccctgacaaaaatgcctaagggaggaaggatgtcttttagcttaaagttacagacaggatacattccatcatgacaagaaatgcctaacaccagggacatggctgcctgtcaggttgcattgttctgaaacagagaaggatggatggagggagggagggagaaaaggagggatggaatgatggagggagggaggagaagagggaaggggagagagaagagagagggatggagagaggggggaaaagggttgaagggttggaaagagaggagggggggagagagggagaagtaggggagagagagtgcgtgagctgggagggggagaaaggattggagggggagtaagagaaagggagaggaagcagggggaaggagagagggaagggggagagagggagggaggaagggaacgagggaaagggggaaggagcaggaaagggaaggagggagtgagcatgagcatgatgtggggcctggctataaaacctcaaagcctatgctcattgcatacctcttccagcaaggctccaccctccacggctccataaccttcccaagagcaccgtcagtcagcgtcagaggggaaccaagtgttcagagacataagcctatggggacacttcatttagaaaccacatcactatcctctaacagcagctggagctggagtaggcttcctctcttccttctcaaaggtgacagggttgctgcagtctgttgtggcgcagtaggttcggtgatctgagataccgttctagccttccccatctccttcccctccatgccgacttccctatatggccaaattcattactgaggactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctgttgtgaaaactgtgcatgtatcaaaccatgggtcccaccttacccccacctctatccccatccacccccaaaggagtcaaacggcaaatttgcagaccacggtggcacctggtctcaactggtactcaactaaaagtgtctttaaaaattctaaacataggactagaccacgaactaaaaataagcttctgagaatctagggggggggggcaggggcgggtggtgggcattccttaggggattgcaagggcggagtagatatggcccctgcccatgagacactcataaaacactgttgtctttccatcaaatggttcctgcaaatctgtttctacccccattgtagcccgtcttcttgggggcgtctctggggtgatggtgctgtatgctcccatagagggtggtatcactgagagaggattcttgagctctgatggctggactcgctgtgagctgggctctgactggggatgttccagcttggaactaggagatgttctcactgttccagcttgggctagaggctgcctccacaggcatttgatcagcaccttagggaagactccaaggaacacttcacaaaggaatctgcactccccaaatccttggggtttctgtggtcactgcttgattagcctttgttcagaacatatcttttgtttgtttgtttgtttgtttgtttgtttgttttttcaagacaggatttctctgtgtagctctggctgtcctggaactcactctgtagaccaggctggcctcgaactcagaaatctgcctgcttctgcctcccaagtgctgggattaaaggcgtgcagcaccactactgggccagaacatatcttttgtgagtctcttcttgtgaacagctagtctgactcaattcctaagcagccattattataccccaatgagcctgacagttaaagactttttaaaaatatatgctttctcccacttctaattctagttctgttatttgtacctttttcaatctaagtgaagtcactttttattttcatatcagcatgaaaggaaggtcttataagctggaagcacaacaacagtacagtcttacagaactgtagataccagcccatgggtatcccatggtgatgatcactgcatcttagacaattcagacgtgtgtgtggtgtgtgtgtatttgtgtgtgcatgtgtgtgtacgtgtgtgtgtatgtgtgtttgtgtaggtagtgtatgtgtggtgtgtgtgtgtgtgtggtactgttttagaaaacaaagggtgtccaatgaagtaactacttaagtaactacttaaggctccatctctccctcgcagtgtgctgaggagatgggcaggactgtaagctgtgactgttgtgtcactttctgtgtgtggcctttgggaaaagcactcactgtctgggaacttcagtgtgctcagaggcagaaccatttgcctgcaggcctttagtaaatcgctggcaccatcctttgtgtaaatgctccttactgtgatggttagtgatctgatcatgataagggcgtaatgatagttacgagttctctgctcccatgtgggtaggcagtgctgcatgatcagagtgtgcgcgagtctgggccagtctgcaggcccattctcatctgcatgtttctatgtgggcatatatgactatcctcaccactaacgttgactgtaattctagaggcctagtatagccacccctcctcttcctctacctgtttttactttaagtatgtttttacttttactatgcagcccaggctggctttgaaatataaatataaacgtgctgcctcagcagtaagaagctggaggggtggggtgacaggtggtaccacacctggcaggaacaggatgttttgagacaggagttcctacatccaccagttcctctgtgaaaatagctgcggttcgaaccacacatgtcacaggtggtactccacgcacacacaagaactgaccatgcaagtccctgagtggactgtgagagaagctggaggagcctggaacagcacaggcagggggggggggcctgaggccagacacagctcgccatacactttatactgagcagccaccactgcctccggcacactggtcaaatgccagggattctacgattgcttgctgggaccttggcatcctcttctttgtcaaagtgtgtggcctggagtcctccctgttgtctttgctggtaccctccacttttcaattttgttgcgaggctatttctccaggagctccttcaggcctgcctctttcccagcacaatgtagtttaacaggcttcccgcaggaaggtggagatggattcttgggggaagatctgtttttagagaccccaaatgtagaaaatagtatgaatgttcaagtgacacttttaaatcctgtctagagtcctttgcagtttatcatggagcaccacgtgtacagtttgtcatcaacagaataaagtctcatgacctttcgttttgtaaatgacagagctgtgcctcaagaatgcagcattaggatgatggtcagtaaccatggtagagagctggagccccttcgtgcaggtctagttttctttctggtctccatcatgtgtctctgggtggtacgctgcagctggaaaggagaaccactcacccaacacagcaatggtgactaagctttccatgctctgagaatgctgagctgttcttgtggacagtaagcaggggggaagaacagagaaggaactaataactctgaagatgtcactctgtcccaagcctgtgctctctgacggcaacagcaagccacggatgtgggctgtgtttatgttgctaatttgcaatagcctcattataaagtttttttttaaggtgggtaaaattaatgtagataatgttttatttaacccaatgtgtttggaatattactttattacatgatcaatgtaattattattaaccaggtattttcgattcctctttccatgggaaatcttggaattctggtgagcacgttgttcctgctagcacacatcagtttgaatagccacacgtggccagggaaaacagcatggcacgttcttagcattttgcatacatggcttctcatccctcaacaccatgcgcagaactgaactaattacctagtagcttaggaaatggagcctcataaggtaaggtcagttgacgccagtcacaggtgggctgagaagggctggagccagatcagccaagggctgccttctgctcccttctctgcagtctgtaaaccatggaagtttgctctgggcccagaagactggggaaggtgggcagaggctttggtgttgctatagaacctctgagggggttgagctgttggtggtgctgtagagaaaatgcccatcggccgagcctgggtagccagttacccagctgtccttcaacctgttggaagaagcaagggaagccattgcctttaagggcattcgacaacggtaaaggacctgggcccttagaacagcttttgttttggaaattagatgacattcaaggttgaaatgactcagtgatgccaggccagggtgatgttggtgctgaatggacgtgcttctgcgtcaatcccttagcattatgatgctcagttgtgagccgagggagggagactgtggaatctcagcatcccggtgctatgctgtggttttgcaggattcccccgcaaccacggaccgagagagcacctcatgtgatgacattatcctgttggtgttgatgaaaagctcatgttgggttttttttcctcccatttgttataaacgttttccagctaggtagtgttggtgatagactagcagtttcctaggaggatctagaattctgtattataatttgcttatttctgtggatatttaagttgctttgatatttgacctcagttttggtgctatagcgtgcaaccgtccactcatgatctttttgacctttgaactgtaaattataataagcactaagtctttggatttagcacccagagagcgctcaggtttttagatgttagttgggcgctacttagcttccctacctctgggtgacactcgggctttattagcaacaggtatgaaaactttatgccatgttttatccagtttaactgaaggacaagtgtcttgcacttgtgggtcctttgccacattgctttttagtatcaccagaataacttaaccactgatgctgagaccactgttagctgggagatgcccttttctccagaaacccaattagtcagttccatcttgcaactgactatagggtcatctgactggtaatggtgtgaccctaggtgaagcctcagccttccacggctgcacagaaatagggcaggacttcattccaaattctacaaaccttaggaaagaggaggggctgtctgtctgcttctgtggccccatagcctatggctctgacacgggctttggaggcacagatggaagtctttggatagattatttactctgcttttaatctcatttttccacccctctaaatagacataagagagagtgtggtagttcacccgtgtaattccagaactcttatgctgaggctgtgagtttaagacctggaatgcatggccacgttgtgtctcaaaaataaaatagtaaaatagacgacagtagcgtctctacgtataccattgttgtaagggtttcattgttcatacagaaaagtcctagtaacaatgcagtcacaggctccgcctctcatccaatgctctcttctgattgacgtctgtaagtaggattgtagcgcttgttttcatcaaggtgtatgagtgaggaaccatagtcagagcatttaacaccacaacctgcatgccaaaggcccttgctgaacacaacaacaaaaggacacccattctcagttctttataaagagcagtctagccacagtccttggttttgactgtatttagtgctgtggactgttttgagcccatgttgtaggtgtggaggctgtcacaaatcaagttgggtggtagtcaagattttttttttttttaaagacaaagttccattgagatacctttgcaagattacatagaaagagcatcctacttgatatgttcctttgtttggtgactttccccacagatagctttcaaagaaactgttggggcgtatggaaaatgtcatgggcttagctcagcagctcttatcgaagatgtgtataagggatatgtcttgctctataggaagcacagaaaaatgatcaaagaggctcatctgctcccttcttccccagtgccaggctcttcacatctgggttgagctgtgtgtccccaggggtattcccaggaacatctagactttcttctagcccctccaaatgcaggccaccttgcagccgtatttttcttcctctttgttcctctcccccgggtgcagagatacttggggatgctgtgatgtgtgggctgggtgcttggctgtgcgtgtttgctgggctgcacagatgaacttgcgattattggttggagatattgaatatctgttagaagatgagtagtcctgacaagaggccagggataggtcagaggtatcatccacttacgcaataattatgctgggaagtgccaagggctttccccttcgcccagacgaccttgtcctctgtgaatcattggctaatcccttactccagttcattcacaagcctacacaacttctcgccctcagcatctatctcaacaatttctctacaccggttccccttgctagggattttgggccacgaaagctctgggtttgtctgcctctgttttgtggctaaaagctgactctgggcacttcaaaaaaggtatgactgtttccttcttcaaccttcctgctccgaaggtcagaaacaggcctcttttcccttttttgcatgcagtcttaagtaaaaggagagtgtgatgtttactcttgatgatcagtttggttggaagaagaaacagctgggggatttgtgaaacacgcgcttgtgttctggagtcaggtcacgagggctcgatctgattgaggtgatcccctgatgggttcataaatggtagtattgtagggaggtggtggaaggtagaggtagggcctagtgggaagaagtacattgccatgcttatgtccttagggctatttcttgccctgcctcctacacagatgcccctcttctgtctgttttctgcttgtgcaatgtgaagaatagcctctgcctcacgctcctgccgtcaggactttctgaccaagctcacggggccgtgtgctggaggatcaaagcatctgaaaccctgagcaaaaataaatcctcctgctttgtttccattgggtatttggtcgcagagaaacgtaactaacttgggatctgcctcaaattcgtcttctggatacagtggtgagggttttctctgtttctgtatagctacctagataccaggataatttactcagtcttttttttttttttctccactgagttccattggtactattctaagaaatgatgtgaatatatgtgtgtggtactgttctagaatctgatgttcatgggtctctttctctgtgcctttctttttggttgtggtagtttcatgaggtaaagccctttcacactcatcccttaagactgccactttggatttttcaaatatttttctcttagtttagaattagcttgccgttgatttccagaaaatactggctgggattttgattgagagtctattgaagtttttgatcaaagtattaagctagaaacagaatcaacggtcttccacccaacctcccaggaattggtttatgcttttgagagggttgaaatgtctccagatcggcagttggcaggctggggacacaagagagccaaagatgaagttatggtctgcgtttggtctaaggattgggaatgatgacagagtctcttgaccaaatgccagaaggcataaaacccaggaagagatgacgttttgggcaagaaaagcccttggtggcttagctgtaggcaggaggaattgctttttgcttgtgagcagctcagcctttctgctgtatataaaaataagcctttgactacgtgaggccctcccactgggaagggcagttcactgagctcatgctcagtgcaaaatagtaatctcttgcaagtagacatatccagggtaatgtttgactggctatatgtggagtcattaagttgacataaagctgaccctcgtaacctgatgggggcaaattgttttaaaatcaaatcttcaaaatcatgagcaaaagtttatttctgttgcttttagccttttggtaatgactcccagtgacgtcctgaagttttcagggcaactgcgcccatctttcgtcaaatgtttctgtgaactgagacgtaatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagattgctgtcccctcccattttctcctcccccagcccctttccccttcctgagagggtggggccccctgggttttagaaggatgattgtcagcctcctgcataccagagaagtgtaggtatagccttgcaggatataattataagtcatttttgaagttccctctatacctacgcactggttaatcactgccaaaacacttgtttcctttggtctttaagggctctggggggacaagaggggctcctttcatgcagagaaatgaccttaagggagtggctttcaaccctttcaacatgggtcacctaaagacccttggaaaacacaggtatttacattatattatcattcatagcagaagcaacattacagttatgaaaataattcttgtggctgggggtcaccagtgtattgaagggacacagcgtcaggaagggtgagaatcactgctctaagggtatgatctaggaagcccgtcaacttttcctgagagtggccctccgcccgtcccaaagttagtgacttggccaggtcagacctgatttaaaatttgtaaacacaaatttgtaaacacttttcccagaagggcgacaagggaagcatgcgtttgtgttctagagacagggaagttcttcgacattctcctgacttttctgtggtcttcacagagggtcctctgtgacatcctgaacatgggagaaatgtcaagatgagccttgactatcaaacactataaaatttgtctttaggacaaggaactcaaatctttgaatttatctccttttgtaagaccccatgcaaatgcttaatcctcctcacccagtaaaacgtttgcttacagaaaagctctgtcccaggaattaaacatgacactctccatgaagatggtcttttaggacagttactagaacacttcctcaagggactcatgcttgtggagactctcctgcttgggccttcatagacaatgctgaaggaagagcagaaggcagtggagagaaagtagaccaaagtgttccatgttaaaccctcgagaagggagggaaattgcaatactgctggctcataagacatttttttgagtcaggcatggacaaaagcttttatttgaacagtgctataagctgtgttaagtgtagtgcccccaggggttagttgacaaatacagaaaccctggttgaggtcaaaaacattagctagtgcttgctttatttctctgcttctcagaagtttatcaatagtattttcatgattcaaagctaagagaagagactggtttttctcctcctttgtggttttcctacctctcttctcttcttccttccgctagtcagcatgtgctgagtcccagacctgagaacatggctgtagatgaaccagtatccctctctttgagcttgtgacccttacatgtttttacttttacttccgcaaacaataaacaacgcttaaaaaaaaatgctttttggctgttgttgtttttcaaaacagggtttctctgtgtagccctgacggtcttggaactcactctgtagaccaggctggccttgaactcacagagatccacctgcctctgtactgggactaaaggcacgtgtcaccacacctggtagaagcttttgtttttaaagacatatacagtagagactttgtgaatggaatagtgcatgacatttgtttcaaaataatctagaagtttcagaaatagagagggctgtaagcaagaatgtctactttgactctggtctgtgggatttttcgatgtagcacccatttgtagccattttagccattttttttcattatctgttaagagacaaaatttcatgaaatactgcttgcctttatatgtagcaaattctgacatttaaccatatagtcccttatattttaatacaactgattactatactcttgctttgattttgagactggatattatcaaggtagtgtggtcgtggactccagcttgactttgagatcagtaaaacagagacaaaaacacgtgggctaggcattggccacccaatgtcaatcgatcctggcttgtgttcatagggctctggccaattaggacaggacagaactacccactgaaaagcaatcctgacttgtgtacagagggcagtggacagatcagggcaggaaggtcactttctctgggaaagtctgagaagcattctgcctggaagggagacatgtggaagcatggtgagaagataaacatttgaggtcaatgatgaggggatgggagggctgacctctgctcaggatggctggaaagtgagggccttcagccagtagcttctggaggccacaactaaaagtcatgcaaggccctacgagacagcacaaagacttagacttaaagactttgtttctgtttagggttgtaaggtaactagagaaatgaccccattccgctggactttcatcaaggccattgccagctatgtctatgtaaagtatgttatctgtgtgtcatgatttagaataaaggactcctacccaaaacagggccgttccagagcacagatgtcttgagccacctcatagaatcacctccctcccctctgccatggggttttccagaagatccacagacaattcaatttgagattttttttcataacaaaagtggctttcgctttcagtgaattagaggaggtgaacctggactccttgcaagctcttgtcccctttcctgcacaggggctgctttggggcatgaactgtggcagcccgtaagactccgaggatacttacattttctaggtcttttatgactgtcaggtcgcaactcttttaatcttaaaaaaaaaaaaaaaaaagctctaggaagtataattattaccattatttgatttgtatagagactaaagcatgtttgactttgtccaaggtcaaacttccaagggtcagcagagctgggacttaggcagtctgattccacggtccatcttagccaccattgtacgtcttcactggaaaccttgtcagtaagagtgactaagagaaccaagagagctgatgctatcctcaggcactcccagagtctatggaattcagggactcctcgctggtgtctggtgtaggactgctgcttgtgttggatgtgagaggaaacctgcacaacatttacactgaaaaaaaaaaaaacaaaagcagaagaagcaagaagaaactggggtttggttttttttgctgtagctcattatacacaaatcagcctcactggtgagaatgctggaaaacagcagataggacgggcccaggagtcagaacttgaactcagtacaatcctgtctcagagaattacaccatggaaggccgagcttctgtgatgaactatgggaacctaggaaggagacaatggaagccaggaagtgtgaggacgggccatggagagagagatggtgaaggagacatgctaatgttaccactgcatggagtcaaagagctcctgtgtacactaaggatgtgtccacttgcagcagaccctaaggtgtactatagaagctttgaaattttcggcattagtcacggccaagtcctagacagctcctcaagtggcacttgtgaaaggcaagtatgagcagcgtagctgaggttttgaaatctgaactgatgtcagctgccacttataaaagggaaggcggcagagttggcagtgtattgcctgccaaaacaaacaggacccacatttctctgaggagtttaacaggacccagcatctcataacatagtattcaaatgtccagactataactcaagcttgacgtcactcaatattaaaaaatagcagcaagaatattcaaacagtgcttaaagagaatgataattagtgtgtccaagagatgattcagatggggttgaggcagcttttggatctagtcttgaaagtaatcgaaaaaactgaaattctcagcagagaaatagaaactagaacaaaacaactagatgaaactttaaacgaaaacaatgacatctgaaataactcatctaccgggtggttggcttagctgtagaatagatgacagaagagtcagtaagcttgaaggcaggtgtaaagaaaacagaaaaataatgtgggaaaaccagtgtttcgtaggataacatcaaaaggttggatatatgtgttgttggaatcccttctagaaggtgaatataaagatattggtgtaggggaagtacttgaagaatggctataactgtctcaaatatggagaaataaaatgtcaaattgtagaatctccataatttcagacagggtgaagtcagggagaagtgcttgggtgctttagaatcaagcctgctggtttgtttctgcttcttccaggcagcttgtccgatctgagagtcttttctacagcttggcttgtgtgagagtgaacctgactggtactgttgactcttgagggttggggggtggggaagagcctagtaaatcctgtcagtttcagggacttcctgagcctattttaagttgtttaccttctgtcatcaggcagcttccctgaaggctagaatgtttcagtctttcaattttgaaagaaactgctacacagctccaaggctctctgctgtccctgctcttaagtccaagggagtgaggggaagtcggaattcacgaaccgaaagagagaagtcacaataatagttgatgtgttcactagtaaacacatgcagaagtaaacaaagtgcctgtgatctcatgtacatgggggtgaccacagaagagcaccaatatttctggatgtgcatccaccagttcatttttctcagtgaatagacacatctgtctgctgtctcctgagcctctgtccactcctcctttcctccctctgctgctttttcttcttcctctcatcctttcttccttttacatttatttatttattattcatttgtattcttacgtgcgtgcttgcctagctatatgtacaacccttgtgtgcagtgccagcaaaggccagaagctagcatggagctggggtgacaggtgctggtgagccacctgatgtagctagggactgaaccccgatcccctgcaggaacagccattgttcttagttcatcacccaccttcccaaccattttcttcctttttttttctttcaagtaagataatagagttttgtgaggtttttctcattaattgacgctatatttggagcattttcttattttgtttaaaaacaccataaatgcattaaaattttagcttgaaaatggtacactattttttttttttttttttttaattcgagacagggtttctctgtgtagccttgtctgccctggaactcactctgtagaccaggctggcctcgaactcagaagtccgcctgcttctgcctcccaagtgctgggattaaaggcatgtaccaccactgcctggctcaatattatatttttaaagaaggcaggcattctgacatttatgggtgttgatcacactgtgccaggattagctcagcttgcctggggcaggtagttctgagagacaggctggccgtgaggaggtgccaggtatgctgcctttttatacatgggccattttcattaaatctttaaagactcttcaaaaatgtgatttttaatttttaaaatgctgttccatgtgtggatattccatgtgtttaataattcttttgttgagttgggggttgtttcagattttaagtaaaccgaggtttaaaaaaacatcgagtctcagaactcttgccatttctcctttgtataggagaattgcccgttggatgggtattttgaagtgcttggatgtgctgtgcaaagtcgcctttcagagttgctcactatttccccaattaccctgtacagctctaagacacatataagcagtgggcagagtgcagcgtattttaatatgcatttctttaattcttaatggtacttaaccctagcttgccattgagttaggtgagacaagtggaagcccatggctttattgttccctccccagtcttcactttggagaagagaggcaaatactgacacatgcagcccagagttcaaatcctggccttggcacttactgcctgtgcattttgtgcagttttcctctataagaacattctatagggagcaagcctggtggtcagtgggcaaagtgaagatggtagcttttcttgtctgagtctcaagatgaacaatgcactctcatacaggagccactatggttgtctgagccctgggttccgtcttacagagaaggctcttcaggaatctctgctgggcattggatcactgtctcttcatctctcagtcttcaccactgggcaggctgcaactttcattccccactgggcatcgaggcaaccactaacaccagccaggaaatccgtcttgaggaattagatggtctgggagctaattctgatcactgatggttcttacagttagtggcacacccctcacagtcattgatgtggaggactgcatgggatttcaggtgattttacttgacagtgtcttgccttatttactagagcaaggtttatctctggatcacagtctttgcagggcaactcagccaaaaccaagtccctacttcagtcaatggcttccctctggcctcactcttcaggctcagtgcttcaagggggatgtatttctgtagaggcacacacctgtaggctgggaacactgaaaatacaaaatggggccgcagcgactctttaactgtctgcagaccaagagacttcttggtggggaccatgggcatccttgacatgatctggacacaggtgagtggtggagccagcaaaccttaacaacactgccccacactctcctggagtcaggactgagtggccggcctcaggctgcttggtttctctccagatcagttcagtgacacctagtttctttcctgggcaggctcctggataggagcttgaaggaagtgggagatggtgaaggtctggctgacctggtttctaagctgaagaaaaatccagggtgagttgggttctgttgtaaggagttgggtagactgtcttttcctgtcctgagtgggtggtcccctcctgttctgtgcattatggcgtggacacagaaacagggcgaaaggggccacattctcatggatatgagagaaatgacttcaccccagttcacaatccccgagcatattaatggaaggagcctctccccgagccccaaccccagagctgtgtgtaaactggacagagcattgtctatgcttttttctgtggctctgcagagagagaaaaacagtaatagcactggtttggagaaacttagcgtaacacagattccccatgtctgcctgataaactctgatgtcttgcttcctctgcatttcaccataattctatgactatggagaattattactattttgattttgtgtatgcgtttgagagaaagagagtgagagagcaagaagcgggggagggggggtcagagacagacttactatataagccaaggctttgaactcatgattctcttgcccagctcactaggttggaattgcaggcataagacatgattctcactgtgttgtatacttggtttgaattcctggacttcagtgaacttcctgccccaactttttgagtacccaaaagtataggcatgtgtcacagatcttagctctgagataggaatcacaaattcccccagtttttttccctctcaagcagacaacagagggtggcttccaaagagaatggggattcagtgacttgacttaataaccaacacactccacctatgtgcactgttttgtggttactctatagttcacctttctgttggcttcagtgccatccctctgcgggcttgcattcttatttcctttgccacggggtggtttttgaaacaggaaaaatgtaaagggcaaatattggttttaaccaaattaagccaaagggaaatattgactcagggcactccctgaagtaccatctcatcttagaaaggaagacttctgcatcccacagcagctgggctgggctccaggctccttgtcactgctgtctacttttgggggggtccacgtgcacatattttacagcaggaaaagaaagtcctgggatggtcctgttatccacctaagaggtcccagatatcgaataataaagcagaaatccgaatctagtgtcacctgtgtctatctagggtgtggtttcaatgatgtttatcacaaattccccagcttgggccttgtcagggcctccctgctttctgtcttgggctttagctcatcagttgataggtcagcaccaggtttccaggtgctgtgtgccggagacaagtccaactgatgtcatggctatatcagtgttgcagggtgaatgtggagaatcgcacaagcctccttaaagccaaacaaagacctttttaagaatcccacaaaatcctccttaaagccaatcaaagacctttttaagaatgctcatcccacgttccccggcttcaccctcttcacgcctagaatatcagaacagtaggcttattgttaacacgtatgagagttcatcttgaaatctcttgcgaatcctcaggtcagctttccctgatgatctgatgggcttttatatggcttaggtgaggtgttctggcgacagataacagagccctgtgtattgtcccagagcacccaatgccgcctttgtatgcagtcaggtataactacaaacttgacatctgtggaatgaaattcatccacagctgcaaaggtccttcgcaggaactagctgcttattttccttgggagccatgagttacaagttcacttctgatacaaggaatttacagagatccaggagcaccgggtcctagtcttaacagtgtgagagccctgtggaataaggtaaagtattgtactagctagttttatgtcagcctaagccagagttatttaggaagaggaagacggaagctggtaccaggtcctgggggaattgttgagacaggcttaaccaggagttttggggaggattgtcatagcatttaaactttgggctggaaaagctgttgagcttaatggcgtgttctgtgggagtctggaagataagagtgttgagagaaatgcagatgatggagacccagcttttggaagcttccgagggaagtttggaagcctgcgagtgagccttgtgcagtggacactgagttatttactctatcagtttggttctgttttgttcagattgtgactgggacctggttcttccttcctgaagcaagaaagtatttaatctagttttgattttacagaggtccacagttaaagagactgggattttatagacaggctattttagagattttgagcggtttaaaaactgagcttttaaagtgtctaaagtataaataataaaaaaaaaagacaaaaatgtaagcatcctctctacgcaattgagaaatgggctaatggattggatagaattctcaagagaagaaatcagaataaatgaccaataattgctatcattgagaaaaaaaaaatcagcagatgctggcaaggctatggggaaatggaccccttcttcactgttcgtgggatgtgcgnnnnnnnnnnnnnnnnnnnncctgcattgactcagctctactgcacctgggtgtagacccgatggctgcaaagtcatcacaccacaggggcactcacacatccacgtgtggtccaccttcttcactgtaggctaagacatgaagctaacctaaatgtccatcggcaggtgagggagaggagaaaacgggatagctagtggatttttattcagctgtaaaggactgtagcattactgcaagatgggaaaatcactgatcgctgtgttagaagacataagcctgaccctgaaaaacttcattcttctctcatatacagatgctagttttaactgtgcttgtgtgctgtgtgtttgcttgggtgcttgtgtgagatgcaagaaggaagggaacagggagagagaaggacgaggactagacagaggtgaaataatgactatatgtagggagagaaagtgaacgagaaagaaaatgtcatgttcaaatccatttatttatatgctaacttcccacatcattaaaaagagtaagtataaaatgttccattaggtaaaacaacattacaaaacagtattaaattatttaatcaatttggaagacattcaccatgaaagtcacatgagaatggcagttgataaaatagttatatataaaaaaaagaaagaaagagaccacatagtgtctttgagttcagaggatcctgggttcaagtgttgcctctgccatttaccagcagaagtcattcaaggtccttggattcagcgtcttgacttttcaaacaaatggaaggctgccttcacaatcctgtggtggtggggggaaggagtgctctgagctgtgtggattttggatgcagctggctccattgtgtttgggtgattagagtctattgatgacaggtcatccagagacctgggctgatgctgtgggccagccatttcctatctgccagcaaagcctttggaagagtctctagtgagacagtatttgggccaggcccttactcagccatgccccaaccgtggtgggggagttggggtggggcggaggcatctgcggatattgctcttgccccctcccaggttaggcatggcctcattccccctgtgaaggccaccctattataatgctttaaggactgtttatagcttccaaccagttcagtgtgaatcaactgagtatgttaacagggcttctattaacagactagagcaaggctttcctccctgaattctcttcccttttctctgtgcatggtgcccagtgtgggcttgacctggtggaagacattagcttactaagatgagagcgcaggacagttgttaccttggtgatctggaggtaggattacctgtattcagtgatgctggtgtttaggagacgtcggctggagaaaaggcttcagggttaaaggccagacatagactgctcttccagtggaccttgggctcatttttgagcatctaccactcaaaactgccagtaactccagttcctagggatttgtagtcaccttctgacctaccacgatctctacttctgatcaccactgtggggccaaggagcccgtgcggagcccatgtgatggcctggagcaagagtgaggtggaggctgtccaaacccccaatatgtcatcttgagactgacaggagtagcaccttaccctccctgctctgggcctgcatgtcccagcacacaaagccttacaacctcccacccctgccacccttgaggtggtcagtagcctgtcggccatgtccagtaaacagctgggattcctcttatgcaaataaggcatttcttagctccagccaatgatgtaaaatcacccccaaagcctctacccactccccaaaggtttaagtagcctttgttctcttaattaaatagctgcttgatgaagcctgcctccctgaactctgcctccctgaactcattgccatcattgcctgaggtctccatcacctccgggcctattcctaccttccttcccctcaggccacatgtctgatcctgggcgatcatgctggtaagggatggggcgtggagtgggaaccacaaatcacaggcactaggcatgcccatggtttgcagatcagcatgtggtcagaacagccatccatataaaacagtaatttaaaacaattctggccctggcttccttttgcccagatgggcaaagatacagtggaatacaagaacagccctccattgacatgacccctggttctggaggttctgggtgaaatgatgcttaagataacactaacttaagataaccgtgtgactgttctcacagaagacacagttaaacttaagttccaatagagatacttctatttgtaggtttaagagaaaactgttgttttggggcagggtcgttcttggtctgtagcacgtagggtggcagtgaactcactgtgtagtcttagctggtctctccctccaatccttgtcccgtggcctctttctgagtgctggaactgacttctgtgctgccaccatgcgtgtccgagacttaagagaaagttcttcacatttgacttaatttttctttactttgcagccaactggccctctcttgcagtttagcacatgggacccggagggagcccattctcctgcctattgtaactgtactgctgaccgtccaaaggggaggccagtcctttccaaagggtctcctcctaaaatgagacggtggggcaggcccaccgacttgtccaaaattgggtctagccctcctcaacctgagctatggaggagaatttctgggaggttggtttttttttaaggccagcatccctcaggaactaatgaagttgtttcctgtttgcccaaagcagctggttccattacctctggcaaaagggacatgtggctctcaacatacacccatggctcctatcagcatatccgaggtccatgctagccagcctccgattccattagtcctgatttacaagggcctgttatgcatttcaaggtctatgctagcaactttgagcttctcacctcctcctctgccttagactccctctgctcacaggctttcctctccatagatccctatcctggctacttgcactgtcctccctccctcccatcccatctcccacccccggccctgtctagtcagctgtccatgttcagtctacttctttctttctctgatctggatgcttccagatgcttctagatattttacctctcttatctacaataaaagcttccccttgaccatcccaaggagccgtcatgttgtcagtttctttactgcacccccttgcatctgaaaggcatctggtgtggacaccctaacatatacggcttcttttgatatagggcctcctctgcattggctgctcagtgctgagccggggagggaggctctggcagtcgctagaatcctgtttggatgctgacgctctgatttccaaggactcttctggatcagcttagaatgagttacctttgccaagtgagggatggctgtgggtatttagttagccagggaaacctgctctctgggaggtatgattgtgtccgctgctgagattggaagataggattaaattatactagactgggtgcattcacagtgctgtggccctagatagtatgataaaattaaagtaatctgtagatcaggctggtctcggactcggagatccgcctgcctctgcctcccgagtgctggcgtcaaaggtgtgcgtcactaccacctgtaccaatgaggttttaacgggatcactgatgggagtttgggtgaggggttcctcacatgcatcaccaagaagcccagcatggggggataactcacggaagttgcagctccggagctctgcactgctgccaagcatctcaagatgcttctattgacagctcacatgctcagaggctccccgttcagcagtagctcaatgcttctgtaaccctggggagggtggcgtcacatgagtttccctctcccttccccaaatggatgttccaatttggaggaaactgctatgtaacatagaaaggcatcttaaagtgatgacacaaaactactctgaacctcatttctccaaagagaagacgattgtcagtaccctggctcccagggtgataagatcgattttggtaacataaaatgctagcacatagcagctcctcctccttcctctctcccaccttcttcttctaccaccagcagcagtagcagcagcagcagcagcagtagcagcagtagcagcagtagcagcagcagcagcagcagcagcagcagcagcagcagcagcaacaacaacagcagcagcagcagcagtcgtctccaccccaccatcttaggccctcacactgttgcctgggctaagacttgagctttctcccctccctcctaggcttctcttgcgagttgagattgtaggcataagtcaccagacctggctactgttcagacagcttcttggaacaccgtccttttgtactttctccagtttgctgcttacagcaggttctttggacagaagctagagtgaagcttctcacacatgccctccgaggaagcccatgttctcacagcactccacagccattagtctaaagccccacctgactgacagctctcaggcccccagctctgctgtgctctcagctccaggcctggcattgttcgggaagcaccacgggcttccctctgctcaggaaatctgctcttttgctcttccttccacccggaaccctcttctttcagaagacctcatggcccctccttgtgcctcctgcctgtctatgatgatgtggaggcctctcacacagccagcttttggtccacctgacccatttctgtctctctgcccactgcagtatctttcgaggaagttttctctttccaaagtgcctcctgcatgtgtatatgattggattctttatttccccctaagtacatggcagacgttgaatttctggccaccttcaggaccttcctctatgtctccactattgaactgtgagcactggcctgtgctctccacactttgggactcctcccctccccacatgctcttaggacttagattttttttggtaggtataaaacaaaacaacaacgacaaaaaacctgctgaccttgaaatgattggatatcaactggaggtggtttgaaatctggcactcattttctaggactcagagcagggactgtggggataccaccaggccagagcattggccagaaacagcacaagggagaagacaaatgctgtagtttcttggtagaagagaaaaaataatggagcagaagcaacagttacagactaagagtactgaacacggatatattcttggaagaagtgtgtgtgtgtgtgtgtgtgtgtgtgtgtgtgtgtctgcctgcggtcgtgcgcatatgcatgtgcagtggggtaattctgagaattaatgaagttctctttcagggcatattctttgttctcccaaggatgatccacagctaacacattctagatccctgttaatgacctcatggaaacccacctgagaaaagctgtaggtgtcggggaactggtgggaaatcataggaaatgataaagcactttagaagaaaaaaagatgtggcagggaccttagagacgagaaggaagtgaaacgctcccccttcccggtatggagatggacagacgtagttttctatttttctgaagcacaggggcgtggtgtaagtgtgtgtgtgtgggggggggagggggggtgagtaaaaggtggatgtgttgcctaagggctgtgattattcagccttctagatagcctctgtctgtgcctccctcccctgtctagtccctttgattgatggagcagaatgcagattggtgtttggtgtggtaagattgggaaagatgcctgctgggactgggaagtgggcgttacacaggaggagagttaatggggcatgaaagggctgcttttcctcaagcgcctgtccagtagacctgtacaatgagacatttgctcatctgcctgtagggtacaaggctgaagatagcatatggctaggagggttttatttttaattatttatttttaaatctgttcatattatctggttttggtcagggactccagctttgggatcagtgacctcctcccacaagttctgttctgtaggctgttgggcaagcactgtgagaatatagtctgttgctgaagacttcagcatcctttccatcactgtctgcctggctggggaaacaccagatctctggtaagagaaccttatagaagctcctttatcctcaaagctttgatgtgggcaagttctcaccttcctcaagcttagccttattcagcttgactttgggaaagcattacaaaggctgctgccctcaaactgtaaagggctcatgccttccttcctaaacctactgacttctcagattcctcagagactgacctgctcggtctcctgctgcttatcaccaagcccttgctagcagacttgtcagaagtgttctggcaaaagatttaatcttgactcattcgggcttgcgctttgtggaactggagcttgggtgttggaaccagacagttccaagcgctactggtatttcctcaggaaccatggtggctgctgcaggcgtgaagtgagccttagcacagcagaaagcacttaagtatcattgtctcaagaatgggagacagtgtgacaaacacacaccattgaatagttaattacatctgggacaggtgactgtctcagtatggtttatgtcttgcagatgaagtgtaaggctctccgaaggtagtaagacagacaggtagaaaaagccagggtttacttggtgttttgaaacaatagctccagctcacactttctccaaagttgggcatcgctatctatttgtaacaaagtacgactaccctcccctgcatttctcctgtatcatagtttttgcatcagcatcatcatcaccaacaacacgataatagcttataaagaaacaagaggaaggatacttagaatattagccccatttttaaaaggcaaaaaaaaatattggttttgttaaatgactgtaagtgttcctcactcttgattcttgtgctttttccttcctggatctcgaaaggctttctcagatccttgcttctctccacatttcactttggttagctttgctctagctgcctgctcctcagagcctgggtgtactctgagcagctgctttagaattggacaggggagtgtagaccagtggcagaggttcgaggccctgatgttgattcccaggagtcaaaacaacaacagaaacatctgtggagcttgttagatgcagttgcttgtccccaacacagactctttagatcagaatgactaagatagaagtcaagagtcggcattttgccagcttgggtagatcatgaagcagctgctgcggcttattccagctctcccatggccacctgcaggctcattctgatagccctctacccctctctatcagaacttcctttgagggattttattgaacatgtcttgagtgcaaacggctcactgggtggagggagatcagagcctgaggcacatacagccagtgggaagtgtgtatacaaccgaggacattttggtgcctaaatatggaggagaccagctacaccctgctgaggagccagtgacctataagatggaggaaccccaggaggaatataggtcgggaaccgagtaaagcatgtatgtcaagaaaggatgtacaggctgggcaggtacatctgggatgtacaggtggcgcacgcctttaatcccagcacttgggaggcagaagcaggcggatttctgagtttgaggccaacctggtctacagagtgagttccaggactgccagggctacacagagaaaccctgtcttgaaaaataaacaaacaaaaaagcaagaaagcaagaaagcaagaaagcaagaaagcaagaaagcaagaaagcaagaaagcaagaaagcaagaaagcaagaaagaaagaaagaaagaaagaaagaaagaaaagaaaggatatacaggtgcccagagggttgatgctggctgactgagaggaagacaggttgtggaccacctggtgcctctaacaagagcaggttcttggagttgggggcattttcaagtgagagagggaagatgggaattgggagacactgaatatggtctgtttcttagagagtcttactacaaacgagagaaaatagaggcagggctagaaaggaggaatgaggctgggaggaggaggagggagaggggacatatagtgactttatttagaaccatacagtacggtagctcatgtaaggctatgtttgactttatagttcattctttcagcaaaatagaaacagttatttgttataaactttttcttcaagttttatccattgatcaagaggggaagagtttatggatcaatcttcttccttatatagcttaaggcaaatacatttgaaatatttttttcccatttatactttgtttgtttgtttgtcttttggcccaaatcgtcttagagtaaaaacacccactccatatgcaagtgattccattgctcctcaaagagtttttgttgctgttgttcaaagtaaagttcaaataaggtctatctctcacatatcactattataaccttaaaaatgtttgggtttcatttatctatttatttgttgttaaaaccagctctattttcatacagaaaccatattttctgagttagtaaacagagccctgcaaacctccctatttactatgttaagtgttcccgccccctgccctggaccgtcatattttctaattatctggagttgcatttgaagctctgacaatatagagattgagcatttgcggtaaggacattcataggtggtgctgtgtgctctgaattgtcttgtgcagtgggttgaggggtaaatgctgtctatgtgccccattctttttttttttaattttttttaattaggtatttcctcgtttacattttcaatgctatcccaaaggtcccccatacccacccccccaatcccctacccacccactccccctttttggccctggcgttcccctgtactggggcatataaagtttgcaagtccaatgggcctctctttccagtgatggccgactaggccatcttttgatacatatgcagctagaggcaagagcaccgggggtactggttagttcatattgttgttccacctatagggttgcagttccctttagctccttgggtactttctctacttcctccattgggggctgtgtggcccatccaatagctgactgtgagcatccacttttgtgtttgctaggccccggcatagtctcacaagagagagctatatctgggtcctttcagcaaaatcttgctagtgtatgcaatggtgtcagcatttggaagcagattatgggatggatccctgcatatggcaatcactagatggtccatccttttgtcacagctccaaattttgtctctgtaactccttccatgggtgttttgttcccatttctaagaaagggtaaagtgtccacactttggtcttcgttcttcttgaatttcatgcgtttggcaagttgtattttatatcttgggtatcctaagtttctgggctaatatccacttatcagtgagttatgtgccccattcttaatgatgtcaagactccactgtttgtgggggcttcctgagtcacgagagatggcttgtgtttagtgtttgtttttaagatagaatagcagcctctttatgtgaagatggagtagcctttgagaaggggacacttactcctgctgaagaacgtggagggcttcatggagctgattcttcaatcaggcaggaggatatagagtccagggggtcagtgctagtcattgaaggttagatgcagccagttcatttttagtaataagaggaatatgggcaaacccacattgcgtgggctgttagtgtagtggagaaagttctgtaccggaacattctagtgttctcacaaataaggaacagcaagttcatcagagtggaaggaagctaggaggggagataaagcttcagaagagtggtaggtgagcgcacttgggggagaccatcactgccagacagtgttaagcatagactgcccatagccatcagtggtcaatcgtgtgacagaagatcagtaaatgagtctatgtatatgtgcatgtgtgtctatgtgcctgtgtgtgcatctgtgaatgtgtgaatgtatgtgggcctgtgtgtgtgcatgtgtgtgtttctagttagttcagctgcataactgcaggagtgaaatatgctaagagagttggctttctccagcattggaatttagcaaatgatgtgtaatgaaaatggctaaggaagtcatcctaggattgaccattggatttaagatggccaggaagaagtgaggacaggagggtcgaggggggcactctgagaagattgttgaggttgcggtgatcatcagaataagttccaaaggctgaagtggtgactggaaggagcatgtctgaaactggggttaccggttgggtttatttctttgggaataatgaaagcagttatttccttgagagtccatggccaggacaggattgctcagctgtcctagagaaggtggttgaactgtgaggcctggcaactggaatactttctggtgaggaagaatagcgctgagcgttgtgacaggtgtagtgatagaggaaatgacagtgatccaggagcaaaattgtttgggactgaaggggaacatcatcgtttttctggactagagaggaaatgcccacagccaatgggatgcagaggtcaatggcggagactgcgtggagcattggttgcaggaatgagatgagttgatacacaccagggtttccccacagcctttcggtctaagtgctgagcaggtgtgagggtttctcattctgagtccgtacggctcggggagcagcacttaaggcattagtatatttttacaaggaaagtgattgcctttcatgttaaaagtctttctaaacaagagacatggctgcttgcacagctatgtgttactagaggtggtaatcttgcatcgtcatgagtaactcacagattcaaggtatagcttgaactcacatcttcaaagtacagctctaaaggggatgctagcaattgacagggatgaagcagggtagggtggtatcagagccaatgtattctttcattaaaaatgactgagcgaatcaggcggtggtggtacatggctttaatcccagcacttgggaagcagaggcaggtagatcacttgagtttgaggccagcctggtctatagaatgagtttcaggacagccagagttgcatacagaaatcatgtctcaagcaaaacaaaataattataatagtagtagtagtagtaatactatggttgacaatttcttagtcatgggctggaggagtctagctagatgaagggatcatccgtttttatctgaaaggaagaagttttttatgtggttggaatagatctgcaatcaggggaatgtcacatagtttgaagagggcttgaatatgcacattagaatcacattgatctctgtgagaatgagggaatctacaaagttagagttggtttagaaaaagtgaagtaagtgtggcccacacgaaagatgaaagtctccacaataggaaagctattggctcaaaagtgtctggatcattgagagctctccctgagttccctggataaattttcttgtcttgtctgtttcctcatttgaaacactgggatagtattggcctccacagagtagaggtagtgatgatgtcaatgaagtgctgtgcatagcacttaccacagaggctattacagccctttgaggcatctcttcttacttggtttataaatgagtctgggataaaggctcagtcatcgtccccactttccagtgagttcctgagtcttggggctttgcgttagccaaaatcgtgtgactgatgagaagcagagcacaggcggctccccagatcaggccaaaaccaaatcccattcgcaggactggacgtttgccgatgtcattagagttgatagtttgtcatcctgaaccgagggtcctggtctcagaagatcaccagacctttagaggacccttctgacccatggtagatctagatagacagcttcaactggttcacttttggaatccagttaagcatgttttttgtttgtttgtttgctttttgttttttgttttttttttttggttttttcgagacagggtttctctgtatagccctggctgtcctggagctcactttgtagaccaggctggcctcgaactcagaaatccgcctgcctctgcctcccgagtgctgggattaaaggcgtgcaccaccacgcccggcttggtttttttttttttttttctattagatattttctttatttacatttcaaatgtttatcccctttcctagtttcccctctgaaaattccctcccctttccaccttcccctgctcaccaacccacccacttctgcttcctagccctggcatacccctacattggtacatagaaccttcacaggaccaaggcctctcttcccatttatggccgactaggccattctctgctacatgtgcagctggagccatgagtcccaccatgtgttttctttggttggtggtttagtcccagagagctctgggggtactggttagttcatattgttgttcctcctatggggctgcaaaccccttcggctccttgggtcttttctctagctcttccattggggaccctgtttagcatggtttttaatcctcctgggaggcaagatttctgaggaaatgcagttgacagggggaaggaagagctgggggtcagtgacttctcctcatgtctgggggtgttactcattaaaaatctcatgtcccaacagtttgcgtcttaagaaacagcagggaacgttcatcagcaggcaagaagttcatttaagggtcagtgctctctgagggggttatgaaagagcgtctttcatcagcaacgcctaaaatagcagaatgtttaaacaactgcttcattcagcaaatacttactgttgttcctactatgtgtctggggttcctcactgacaattgcagtaaagaaggctgacaaggaggatgcacatacatcggtgaatgctaataccacaaaggaagtagacggggagctgtcagagacattttctggctctcccaggaggccgttccaaacccagttcccctctgaattagtaaaggaagctctgaactgctttctccctcttcctgagctgaggactgaacgaagggctttggtcttgttaagcaaacactctaccgctgagctaaatctccgaccctggccccgaaccatttcagtaaaggacaaagggaggttttccacatttgcttccgtcttgctcctgctcatgaaagaaatggttctttcagatagagcctgtggccttcaatggagcatcttctccattttgctgacaaaactggttatcaggataccacagtaaaccctttgggtatgccgtcatctttgttgtggctagtcctctgtgacaggattgcatactgcttttccctggttgagaatatcttgagataggtttcaaggccagctcgatattatgcagccagttgattgcataggatgaagtgttttttcaatattgtcctcaagagtttgccttagttacccaactatcatcatcatcatcaccatcatcatcatcatcaccaccaccaccatcatcatagaacaccagttcttcagcaactttccaggcatgacacttgaacatgcttcacttgtacttgcaatcacatgtgtacagataacatgtactaggtttccattaaaatatttagtgttttcttctctatagcaacaaatgatcatatgtatgtattcatatgattcacaatattattcatagtattcattcaagtggatgtaacgtcaaggggtatttggaagttaagtcagtagatttttaccattataaataggcttgaatagaacccgttttctttatatatattattgctttatagcattcacggtttttttctgcagtaatgctcgttcagtctccacagttagagaaggcggggactcatttcacaggacaggagactgaaataggtagctcctcattttcaactgcttattcagccctagagttttggcagtttgatcaatagtcacaggatcctagagcttaagtaatttctagaaggggcaaaagtatgtatttgcccttcagtcgtctgacagctttactgtgacctgcctggcaatgtagaagactgttttgaagattgctgtgtgctgtctagtctgtaagtcattattttaatgttctagttgctccttgaaggtcttccttaaggtcaaccttaaggctcaaggagggacgtgggacacatggatctcccagggaaggggatatagaatacattttgtgcgtagactgtggtcaggaaggatggaaacaggagggatcaggtgggggatgggcctggtggaggagtgagagagacaggttgagagtattgggagagataactggaattgtggggcatttgtcgtgtgtgtgtgtgtgtgtgtgtgtgtgtgtgtgtgtgtgtgtgtgtgtgtgtagtacccacagaggccaaaagagggtgttagatcccctgggaatagaaccatagactggttcctagcacccataggtgcaagtgctgttaactgctgagccttacacaatgactgtttccctttttattttatctttcattgtatggaaatttaaattatcttgcaattaaaaattcatttagctttccctttggtattttttatatagcatcaaaactggaaaggataaatatagagtgaattctggttttgtcttttaaaaaatgtgatatatgctatgctagctatataaagcttggcttttactttttgctggcctggggttggtcaagcccagggccacgtgcttaccatacagatactctgccactgaagtatatcccatggttatcctttttttttttttaatctcaaagaataattcttgtttaatctagccattgtttgttcagagcatctaaaacatcaaagatggagctgtcactcattctaccaccctaggtaccactttcttcctagtactttttaaagttttgtttctgaatttaagtagttttgcagttctgtaacccatgttaaaaatacatgactcaaacttccccatatcattaaatattttgtacaaataaataatttttaaaaatgcatctagaggtttttttggggtggggtaggcagtgaaccctcatgctctttattctttaggggagactaatctcccgttccttcccggagggttttgtcatgcccacctcctctttctagaacattcttaggaatctttctctaagctgtctggattgctcatagatcttgaatatttcatgtatgattagcctttagttcttccccggatatgcccgcgtttacaaaagcgcccctctatcctgttaatgtttaacaccactctgctagaaaaatagtctgactgcctcctttatttgtatttcagatggtttttgatcatcctgtgaaaaatgagccttggcctccagacctagtaaagtaaacctctttcccatggagaacagtgctggctcctgaggacctggagggcccaagccccagaaggattagccagaagcaggtaacaagctcctagagacctgagaaagtagagggagacaatcccgagtaaaaagacaggggccagactgtgctggcaagggctccactccccactgtctcaccacagcctctctgctttctctcttctttcctttcctagtctgctaaatgcttgtttagggagggccaagatagtgtgggaggacaggcttgtccatctctgtaagctgcagatagaaagtctgggagtgttctataattgatagccttctatgaagaatgtttatatacctttgacattttgacgnnnnnnnnnnnnnnnnnnnncttcataacccttttactgagcctgaccatgttccagattcggttctggggccaattttttttattgtagagaaaggatacaaggaagcatgctctgttggcataagggctaaacactggttgctaacaagtaacaattgtggtaaaagtcaaaggcatcagttacaaaacctggaagctttacaaaataagtctggtgatacgaaaattcacaggtcgctcctcttttccctgaggtaggtattaggtgtggccttctttggtgtctttcttgctcaaagagctaggcaggtgagaataggcccttcggctctgatggctgtgactggaaacccaagccgatcttaggtgatggcaattttggagggaccacacaagccctgatggaaggttccagatgagtgtgttaaggccattttattattcagggttctctagagtcagagaacatatggaatgaatctcttctatatatgtataaaaagggaattttttggaatgacttacaggctgcaatccaactaatccaacaatggccaactgtgcatggaaaattcaagtctagtagttgctcggtccccgaggctgggtgtctcaggtgttcttctgtatatgtataagtaggcttcagtgtcatagaaggatccagatcacaggtgtgccctccatgtccggactgtacttaattccagatatagtcaagttgacaaccaagaaaggttgtgacagccatgaagacccaggctagctgagggctctgagactgtccttgaggtcatccgtggaagctgcttttccctaagcatcccaggaaaggcagtgccatgcttctctgagaaggagcctttgctggcatcacctctcctccagacttgcaagccaccttccagctgctcattcacaaacgccatgtccatgtcactcactcaagttcacagttccatgtgtttctcaaacctgcacatggagcttatgggagcttcactgtttattttaaaacactgcactggattttataacatgtaagagcccctggtcagtggtgcccaccaagggtgactggcggaggacactttgctctgagtgcgagtttcatctctgggctctctgatttctgagttctgatggtcaccacttactatttattaaccccgattcaaattttctatccttcaatgcaaagactataaaccagtggtgttttgtttgtttgtttgtttccaatcttcctgaagctgtgaccctttaatacagtttctcatgttgtggtgaccctcaaccataaaattacttcattgctaatttatagctgtgattttgctactgttaggaatgtaaatatctaatatttaggatattttgatatgatatgaccctcagaggggttgagactcacagattgcgaaccactgctataaacaaaccattagatacaggctaacctggattggaatcctgatttcacctggtggtgtggtgactccgtgacattgaagacttgctaagcctcactcccgtcattctaacacagttgtgaaagcttactttgtagtgtttatatttggtgagaggatgtggatacagtgtcacaaggtcatgtggtcagtgatagtgacctgtccgggggatatttaattaatttgttctcctgtgatgtaacaagccctccacctcctacttcatgacattgaatccgaattcctgtccatatgtgtatgtcacatcccttccaaaatatcatccattccattttcggtcacccacatcactcctgacaaggccctcttgctaaagggctctcctcctttctttgctcagaacaactccccagccgttgctttcaccgagttccagctggcgagcacatccttttatttaacactcccaatttggcacagatgaaatgggcagagatgactgttctatagatactcagcaagaatggaatcgagaccccaggattcatgaaatttccagtctagaactcctactgatttatctcagacatccttgggaacaagcttggtaggaaaggacttcagactcactcactgggtgagcaaagccccaggggcagttgctttgagtcatcctggtgagtaaactcgggagaggaaagaatccagtgttttcaaaggatacagaccttgtttgtacagagcgtttgtttctatcttctgctttgttactcagtggattctgagaaagcaaaggcatgaagggcccagatatgaagggccatcctagctatcttaccaagatttcctctctactgttaataaaacgatctagcttctcctgtacactgaatggtggactgtggggctaacctttgatctagaagtcctggattatagcccacatagaactggatgcatgggatgcaaaacaggtgcatgggacttctctggctcttttagctgatgtaggatttaagagactctgtgtatagaccagtcagcctgtttcctttttactgttgctttcaagtctacgtgcctttgttctacagagagcatgggctatggtgtttaaggttccctctggtctaagattttggagtgagctggagcagagagtggtagaagctgagtcatggtgcacatagggtggaaagatgcataaattttcacgactcaatgagatgttcagaggaatgctgcctacagtcaaagtccaaactaaggcttgtttccccgctgtggcttgctcaaggctgcagagttggttcgaggcagccatggagggacttcaagcgtttttgtgctagaccttatgcttgattcttcgcttgacccatcactcccctgcccaatactttggaatatactcaccctcatctttcttccccttgctctgtgtgtgtgtgtgtgtttttataggcttggttcctgctccgatcagtggctctcctgcccgtaccattcattatgattcataccaacttgaagagaaagttcagctgctttgtcctggtctttctcctgtttgccatcatctgcgtgtggaagaaagggagcgactatgaggctcttacattgcaagccaaggtattccagatgccgaagagccaggagaaagtggccgtggggcctgctccccaggctgtgttctcaaacagcaaacaagaccctaaggaaggcgttcagatcctcagttaccccagggtcacagccaaggtcaagccacagccctccttgcaggtgtgggacaaggactccacatactcaaaacttaaccccaggctgctgaagatctggaggaactatctgaacatgaataaatataaagtgtcctacaaggggccgggaccaggagtcaagttcagcgtagaggcgctgcgctgccaccttcgagaccacgtgaatgtgtctatgatagaggccacagattttcccttcaacaccactgaatgggagggttacctgcccaaggagaacttcagaaccaaggctgggccttggcataagtgtgccgtcgtgtcttctgcaggatctctgaagaactcccagctgggtcgagagattggtatgtatctttgttaagggtttctattgcttcaacaaaacaccatctccaaaagaggaagttggggaggaaagggtttatttggctcccactcttacattgtttaccaccagaagaaagttaggacaggaacacaaacaggtctggaacctggaggcaggagctgatacagaggccatggaggggtgctgcttactggcttgctcagcctgctttgctatagaacccaggactatcaaacccaggagtggccctgaccacagtgggctgggccctcccccattgatcacggattgaaattgtcttgcaattttaagtgccttgcagctggatctcatggagacatttcctccctctcctcatgactctagcttgagtcaacctgacacacaaaaccagctagtacagctgttctctgagcggccgatggtcgtccgaggattgactggggaatttcaaggccctagaacagagcctaagcatagctttacagatggcagagttgtcccagtccaatgttttccgatgtctttcctggagtgaaaaatgcccccaaggatgtctaaaaagacgggactcaggcttaagtggtttttcttttaatataattttaagaattgattctttgagaatttcacacgtgtatatagtatattttaacagcattcaacacactccctccttctccctcctagatttttttcccacaacatccctttccaactttatgccttttaaaaaataacctgctgtgtcaaattaatgctgcctgcatgcacatggctgtgtgcagtattctgctgtaacacaatcagcctcccaggtcccacagtccttgagaaaactgaccttcacccagaagctatcaggtgttaatggctcctcacctatctccccccactccccaacacacacacacactgagttgtggttattagaatatcttccatccctccctccctctcttccccctccctcccttctctttctctttcacttttgttttattttcttttttctagacagggttgctctgtgcagccctggctgtcctggaacttgctctgtagaccaggctggccttgaactcagggatccacctgtctctgcctccccagtgctgggacaaaagtcatgtgccaccagtattctatggagtgtttcatttaaggaaggaaggaaggaaggaaggaaggaaggaaggaagaaagaaagaaagaaagaaagaaagaaagaaagaaagaaagaaaggaaggaaggaagagagagaaagaaagagagagagagaaagaaagagagagagaaagaaagagagagaagaaaaaagagttgtagtggtgccaaaagcaaaactgctgtccactgtgatatttgaaaatacttgaggcatagaactggacttgttttcagggtctaagcttctgtttgtttctagtcctgtggaaggtgggcagccacgcgtcacagaggtcagccttagacactggctgtcaccttcaccttgtattcaggcagggactctttgttttttgcccttgctgggtacaccaggctagatggcctgtgagctcctggggactctgctgtctcagtctcccatctcctgcaggagtgctgcaattacaagtgcaagccaccatgtgtggcttcaggtgggttttgagagactggcttcctgctcttaagcttgcattttgcccttgaactgcctccctcgtactagttctgatacatgcgaattcctttaagtctcacttggctaattctctgcgaattccttttagtctcacttggctaattctcttaaaaccatattaaatcagcagtatttggtgtgtgtctgtatatacacgtgtgtgtgtgtgtgtctgtgtgtgagtgtgcatgtttgcatgtacatgtatgtgaggtgtgtgtcgtttgtgtgttatgtgtgtatgtatacatgtgtatatgtgctgggtatgggcatggaggtcagaagacaactctattgagttggttctaacctgccacctttgtgtggattgtgtagatcaaactcaggttaccagacttggtcagtaagaacttttgcctgacggacctttgaaggcactccaggtgcaattcttaaactggggcagctttaggctaatttcaggtgtttcatgaatccttgaagttgcctgcaaagcgacccagacagagtaggtgtttgcaaatctgtctgtgttttttttctaacagtacacctgatccccagagtgctctctaactgtaagaggccccatgtcaaaagcaccagtttgctattcttaaaacccctagcagctacgatagagccaggggccgttcatattggcagacttgcaactgagagctttgccacttctttttgttattttgagagaactctgcctgtggagaaagccttgctgtcaggctggggtcctgggagggtgacgtcactgcttttaattctctcctggtgactgccagggaggatggcctaaaaccaggcataagctttcaaagaaggaatgcagacccaaattgaactctctagaccagaaggaggtgagatcacattttctgtctctctgtgtcagcagggaccctaatggggctcacaaaatggccagtaccaccccagctttggtttttaggatttttttttcctttctagaaactaaatgcgattgatttccatcatccattatagaattcattttctttccttttttgtttcttctctgcatctgcaatagaatagtggtgttgggatggtccatactagataacctctagctctttctatcaagttattgtctggctaaacttgtgtccaagattaaggcagatccatatctctttgtaaactggagctacagattcattttcatgtgctttataattaaaagaaaaaaaaatttttttttttaaagtttgagttcattcatgaattgggttgcaaagccaactcatgtgcagaaccttggtggctgtttttctatgtataacaagacatccataatgccctgtgcctctaatagtcccacacatcaggctctggtggctccatgatcattagggcctttaaaaattaatagcatgcatatgtatataagctatgtagataagttgagggttttattttcaaactatagcatatttttaacataccatcaccaataagaatgatacactcactgtgtgcttggcctaaccgctttcctcttttaaaatgggagttttgcctgcatgcatgagtatgtagtatgagcatgtatagtgcccacggaggatatcagacctctggaactggagttacatacagagttgtgaattgccttgtggggtgctggaaattgaacctggggcttctggaagagtggccagtgttcttaactgctgagtcatctctccagcccctgagtttcaaaactaatatttttgttcattctttgagaacttcttacatgcacatacagtctattttgtgcctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctttatattttaacaacttccccgaatccagtgtgtgctgttcataggtgtggggctatccactgcagcttggtctacccactaggggctacacccctaaagaaaactaggagccatacactctttatagctcttgagctatgtgcccctccccctacaagctggtgcttactggctttgtcctgtgcagcacctgctgcgcccccccccctcacttgcagtccccaggagctaactgtgggggcccaagagaattgcataactggttgtaggcagagtagggggttgtaggtagccctgttctcttgtgtctcagaatgatagtggcctctgggtgaacttgcccgtgtcagttccttcttccctggagggagagaaaacagcacctgaggcaaaagcaaggaatgaaggatgcaggaagaggatgtggggccactgggtggaggagggcatggagttaagccagaggtatcgcctggagtcagggtgacaggtgacagaccacataaagactttagattttggtctttgtttttgttttgttttgttctttaatcaatccagacttcatgctcaggtctccacggttctgtgctgatccatgccgacctgactgagtgcctctttttcttctcttcatttccccttctgttgtaccgtggttctaaccccctttgggttgagcagacctttcacagaagtcccctaagaccatcatagaacatagatatttacattaccattcataacagtagtaaaatctcagttaagaagtagcaatgaaaataattctatggtttggggccaccacaacatgaggaactgtattaaaaggtcgaagttttaggaaggctgagacactgctgccctggccagttccccacctaatttgcaccgagtactttctatgctttctgttaggagggactcctctacctgtctgtgtctgactgtctattgggtcttggctctgttctgccatactataaaaaggagagttcttgagtgtctctctcgatactaatcatagtctcccattatgcaagaattcctatgtatacctctttgatccatgcagtaaaacacagtgtcttcatggggaggggccttgtcttttctgccccacatcattgtctctggtgcccagaactgtgcctggcataacatagtcttcaaccagtatttttctgcatgaagaaatgatcattatttttgtaatgagcaacatcaaggacttatccaaaccttactataatggggagtctccattttccccaagctcctctccccacttcccacccgcctctggtacctgggagttgacgatttggattatgtgagtttgtaggaagagtgccctgcagccctgggtgctagtctgatttcctcaaactcatccatgtacccagcactctcatggttcctggaacccgaggctgggaacgttgcctacgtgcggtttctgacaggcccattgttttacctgtggtttttccactcttgaagcctgtgcctagttctgagaaacttattgcagttccatgttgtgtaagggtggacctgctgccctccctgcagagtgcagcgtggaagctgataggatttccaaaggcagactgtccaggaattttgtactgtagttctgtgaataaggtatctggattcctgccatttagaataatatttacagaactgaaataaagaggaaggtgttcatggcttaattctgcaggcacccccccccaccccctttacgggtcattttgtatggagccaaatgctttctattcttcctaacttatctgtgtggctattgaacagccctaaacaaatcttcatggatgatagatggtctctaatctgatacagattttgctggtgaactctgtttgtttgagcaagtggggttggggtgagcttcacagaatctctgaagtttggggttgagatggtaccatcgtgtctcacctccatcagattggtcagtgttagggttcaaaaacttgtgcagatcttgctaattatgcttaaaaaaacccatagggaccaggaagtagttgtgtggttttgagacgttaggtctggcctttacctgagttgtcttagttagggtttccattcctgtgagcagacacaggccaaggacgacatttacttcgggctcgcttacaggttcagaggttcagtccgttatcatcgatgggggaacacggcagcatccaggcaacatggtataggaggagctgagagctctacatcttgttctgaggcaaacaggagaagattggcttccagggagctaggatcagggtcttaaatcccatgcctacagtgatgcaaatactccaagaaggccacacttcctaatagtgccactccctgggccaagcatctacaaaccattgtagcagctaataaagtatatcacttctaacaaagtacttactcaaaagaaacaatgaaaaaaacccccacagtttgggaatttaagtgacactatgacctgttccatttctgctgtgccagatttgggacctcctacgagcctctgattcctaaatggaacagatacttcaaggctgtcttcagtgacatagtgaatcacttctatgtgctaagcattgtacaggtttcaaagtgcagtgatgacattggacatatgatacataatcaacatgatctggcagggctaaaaatatgttctattggtgatacctagtgaatgtgtggtttattccattaataactgagaaaggactctgctataataagcctgttggccctgttcttttttctgttgtgtcagtgcacactggtgccactagatggacttcacaactaatggacatcttgtctcttgtagtggccaacagacctgtgatcaccttcatgaacttcactgggctgggtaccacactcacgttatactaacccttgtgtaccgtgtattttttatcttctctctgccttcctttttcctgtctctcttcctgcacattgccagcactcacccccattttccatttcctgtggcttacagataatcatgatgcggtcctgaggtttaatggggcacctacagacaacttccaacaggatgtgggcacaaaaactaccatccgcctagtgaactctcaggtaaggattcttttctgcagagagcacatcagaggaagatgactccggtgtgggccctagtgttgagcctgtccacatcaaagctgccaggttgattacgtttcttgactttccgagtcccagagatgtccctgaagaagggccagtgattccatggccaaccttgtgatgtgttgtccataaggtcctctccacgtgaagagtatacacaacggagctgcctagggttgaggggaacagggttttactttctcttgtaaccatgcagttgtgcctataatttttagacaagagaccagcagatcacaggacatccaggggagaaagagaagtgttgtgataagtaagcaaagatggtacagagcttgaggtgggccctaaaacactgcccaagtgtagggcacaacatcagtgccatagaagtctatgatgtactagaatctacgcattacttgatgaattttctaatccttctctaaggtagtagtagacatgttgctttctcaatactaataggaatgttagatttgttcttgccaaaaagttctgttagttaatttagtgggaaaaaaccaaactggatttatgcaaatagccccaactgcatggtagccaggcacagtggtgtgcatgatagtcccagccactgcgagactgagacaggattaagactccatataaagatagataaatagacagacagacagacagacacacacacacacacacacacacacacacacagagagaggggggggatagacagatgatagacaagttctgtactaagactgccaatgtattaaccccactattagcagtgatgtttgctcttccctcagcagacacagttgccttagatgatcctctgtggatgtataacctctctactatttcagtctgcctcttacggctatagggcctggaatcgatcagaatagtccaccagaactgtgctagtgttgtggcgtcttcctttccagcagcagggctccgtgtctttattcctttctctttcttttcggactcgctggagcttccagctgctggaactctgcccttcttcctgtacagtgttctttgcgtctgaggcccacggttgtaagaggtgaggtcaaggaacacaacttctgtgcgtgcgaacttatttcttgtcccgtcccctcccagtctttttttttggggggggggggagcagcatcttgcattattgtccagactagccttgacctctgctctcctcttcccctctctcaagtactgagagtcatccgaaggagtcaccatgcccagttttaaacctctgtgttattattttaatttaaaaacagaagttattttctatcctggcggtatctccagtgtcctcctacttccagggtctctgctattcggcctcagggatttatcattattttgtagagacaggatctctctcactggggcttgcggattaagccagtttgacttgcagaccccagggatctgcctgtctctgcctccccagtcctgaggttacaagagcatgcatctgcccagtctttcacatggctgctagggatgggagttatgctcttgtgctttcttcagcaagcattttaccaactgaatcatctccttagtcctgcattttgggggtttcagtatcactttctttagcaatcaaaaagatgcatgtgaagaaatagtttggctaacaaacttctctgatgcaagtggccttgagtttgatgtcaaagcggggcttgattcggaaggatactgatggaggcctgcctgagggaggaaccagcaggacagagatactcaggatgtgagagtctccttatcgggctgggctgaaggtggaaggaggcaggattcatgttgcctggtggagggggaggaggctagcctttgagtgctcagattaacacgtctagaaaatgtgatatttagttatgatcttttatcccatcctctaaaaatctcttcatatttccactggttttcttctcatgccccagacacaggaaatctgagctagagaggacaaagccctacaattccagctggggtttatgtcaaatttaggtatctgtaaagagatgtcacgtaggcatttacaagagaaagagagagagagacagacagacagagagatggagagacagacagacagacagacagagacagagaaagacaaacagacagaggcagagtttcatcaaagtgtatgtcttgtagttgaggtaggagaagaggaagtctgctaaaaggaatttcaaacacagaaaacctttgtccctaaggaatgtatcggcctgttaagtgaaccaagggaagaaggtaattttaacaatgaaagtatcttaagaatacagtaacaagatggtataattatagttcagtagcctacaagagtggctttccacagtgttgggatttattggatgccagtaaattcatactgtagccaaagctacagtggttccaatggcagtaacttaccaggtaattcctgctttctttggcagccctagccagagcaaacgtgggttcttttatccttatcttaatttttaacattgactttcaagtcacacatttcatatcacacaaaatatatatctgtctatctatctatctatctatctatctatctatctatctatctatcatctatctatctttctatcatctatctactatctatccatttatttatccatcatatagctacctatctctatctatctatctatctatctatctatctatctatctatctatctattcatctatctatttatatatcatctatctatctatctatctatctatctatctatctatctatctatctatctacgtgtgtatgtgaagaggttgaagagtgactgaaagaactaaatggctattgcaggggtgttcataggtttatgaaggcctacgacggggaaattgatagaaatgtaaggggcaagatatcagtgttaggcttcagggtcagaactgagctatagagtctagtggagctgtatagacaaaagggcaggagcaggtcaagatgaatgaacaggcaggtgggcaggtctgggtgggagaagagaatgtaggtagatggtaattctgttagactatcaaaagcaggactaaaccaagctgaaccctggagaacaatggcgagatctgccagttggtcctttgacatgcatactagggtggtcagcagctgacaggttgctgggggtcactgccactgtagttttaagtgtttgcctcgctatgatctagtgtatccagtaagttttctggtctgatttacctgatatgcctttaagatacctatgttatgcccttccttctcaattcactctgataaattgacagggtggcacccttcctactcccaggaataaatcgttcatcagtctgtgcatgtgagtggtgccggacatgtccacactggtacagagtcatcctccctcctcaagatggtgtcaaaacctccttgagaatggattctctcaggatggcacagactgatagaccactgttttacacaatgcagggtaacttggagcagggcactggcgtttctattcttttcatggtgtagatgagatggagctgagtaaatttaaaaaccaacacaggtagaaaggaagcctctggggaggtgcccaggaggaagccccccccaagcctgtctccctcctagaccaccactgtgaccagtagagatgacactattttgggacttataggtcttaggtgacttagagcttcaggtttaaatgggaaactggttaatttgggtcaatctgtgctgttagcatctataagcccccacttcccattcttaactccaggacacggcagctgtgtacacagtcctagattagtctagatagagatcaggtcttgctaattgctgtttgttatcacagggataaaagctcagagtagatggccaaggtcatcactacacttcctccttattgttaaaagcagcttcctctctggcaaagattttaaagcccagatctccccctctttacccttttaggagacagatattgaaaactagttcatttaaaacagcataacgggacatttgacttcgttttattattactacaaatacatgagacattcagtttacaaggagaaaatgctggggctagagagaagactcactggttagcagtgtgcactggtccagtagaggacccgagttgggtccccagcatctatgccaagtggctcacaagggtcatcttagaagacgctgagctctgagggctctagtgctcatgcacacacacctctagatgcaatttaaaatgataataaatcttaagaacaagaaaatatttactttggctcccagttacatgagagcctgtgctgagacagcacgccattgctcactttgtgtacgggactagagaaaggggaagtccaagtgctctcttccaagactcgttcctaacaaacaaaggcatctcactgggctatcccacccttcaatgttagtcataggcagggaggagattctggcaatggaacactcatcagaagcatcttgttaactgacccagccgaagagaaagggaactggactggttcgcatcagcttccagcaagcccaggccttgaagtcatttggaacagtttgtccacagctgatttctaggtggtatctgtcagcaaggtggaaatctgctaaatcagatatagactagggatagaagttaaagtcaagaaacttaaaggaaaaaaatattacatttgtagctttcaggaccctagtcctggtggttaggggaggaatcccaaagtgggggggagttgagttggggagggagtgatataggcacagacaactagggtgtacttatctagagtctgtttgatctgtgagaggtagatccaaaacggaacgacttccacaactccctgaagtatttttgatttttttttttagtttaaaaaaagagataaaaattttagatttgatagcgttatcattgttcacaatccgcactgaaatccacattgtagaaaaagcagctaattctgtaaacagagtagaagcatgcttatgagctagcagaagcgatgggtttgccttaaaaagtatggacatttgcttctctgtccagagggctgggtacccagattgagccgagatggttttagcccggtcagaagcagacaaccaaaggaaacgtcagatcttgagcttgtgactagtaatggtaatccgtgctttaccagtttatcagaattccgttaatcgatgttagaactctgaacttctgagatcttagtataacaacaacatcatagaaggggacggaaatttgaaacattttgtattctctcatttttttcatatatcttaaataacttcctaaggccttcagaacttacacaatattttacatccacagaagttgctttcttagacccctgtaacttacatagacttcacatccctttctttccgatataaatcatttgacagagacataagtagttattactgagagctgtgactgcagatggtaaaggggggaaggggatgttgatatcattagactacttcctgctgattggggcaccaagttccttggggcatgtctaatcttcattgtcaggatatctccaaccagccaatagcagcagcaagggcagcagctgctgccacctctcttggggctgaatatccgaattggtattcttttagtatcagaataaaactttgagtcataaatacagttcacagggacactgggaacttacttccccaggccttccatggcgcaccattacagattgtcacagttccttaggtgactcttatctaaatagctaacgattaacaaagttggcacagactaagagactaggcgtccattctttggtcagtctctgtcagcctggatagtccctggttaggaagacattccatggtctctttgccagactgcttaggtcactgacttactgcatcccatgataggaatattctaggttcctctgtttggtgctgatagctgcagctctaattcgttagccattcattcattcattacttatttatttgaagattacatattaataaactgggccgtggtggaggacatttttaatcccagtacttggagggcagaagcaggcagatctgtgtgaatctgagtccagcctggtctacaaagcgagttccaggtcagccagggctgttacacaaagaaaccctgtcttaaaaaaaccaaccaaacaaccaaacaaacaaaacaaaatgaaaacaaacaaacaaaaccaaaaaaaatccccaaagagcatattagtcgacatctaatataaagcattttagaaacttaaaatatgggctggtgagatggctcagtgggtaagagcacccgactgctcttccaaaggtccagagttcaaatcccagcaaccacatggtggctcacaaccatccgcaacaagatctgactccctcttctggagtgtctgaagacagctacagtgtacttaatatatactgatgagtgttccattgccagaatctcctccctgcctatgactaacattgaagggtgggatagcccagtgagatgcctttgtatattaagtattaatatatattaataaataaatctttaaaaaaaaagaaacttaaaatatctcatagccttataaatgtaaatatttaaaggaaatatctaactttttaatttaaagtttcaaaactcctaaatttcccttttaaaaaaagttaaaaatctgtctattgtaaactccaataatatatatatatataaatactctattttattgtaagagagacaaaacagggcacagccacagtggggacaaagcaaaaccaaactccaacagtgcaaacaactcaatgttcagtgtctgggattcactcatctgggcttcccctaagggcttgggtcccctctgtggccccaccctgggcagcacacacagacaggcacacacagcaggtctcctaggctccagctggctctgtttctggctgcctccatcccgatgggggacagcagctaagatggcaacagacaagccacatgttgcttatagcccaagatggcatcataccatatggttcctttaaggttacctatgtatagatttttaactgtcaacctctcatgttacaaattttaagttaacttttttttttgttacagattttacagatttttaaccatacccagtaaacatacaaattttgaggtacagaaagtttacataatgaatagtcttacagatcttgagctaaggtttacatcttagcaaaagttttaggcagttaaatgaaaccaataatctaattcctgttgttgttttgctttgctctcccatctctgtcacaaagtcaagtggcctgtctgacagaggacaattggaggttacccaagcatgcttgggtctacaggagggagagtcatagcccactccagagtcaacttttcaataaagtagagcaacattaaacaactttaatattatccatacccaaaagatatttgaatccctgccaaactgaatccagtgacaggaaagcttaaagataagaaatgcagagccctggccatcaaagccattgaggcaagtggcattggtggtgactggtgtttccagagacagcaaaaacaaagccagcagcacacacagaacacagactggtcacacactcagaggaggtcagaagcaaaacagagcatggactggcaaccatcatttatacatacatctgagccagatgtatcacatttccccctatatcccagatgtgcacaccagaaaacacagagtgcacacacacacacacacacacacacacacacaacagacaggcagacaaaactttatgacctttaactgggctcaaccaatttccattttgactcccagtatatgaacaacaagaaccaggtgggtggataacgttttgcattttgccttggataggaggccattaggtcctgttgaacccttcctcgtcctatattgggatctgaacagattcgatgtcacagcaaattactatgacttaccagaggaggcctctggtaggtggttactgcttttctcaggatggcagttggaatcttggagcatctctgtgcacaccttctgaggggacctttcagccctggagtcctggagtgtaggcctgactttagaatttgggtatgatcttcctgggggcctccagaaaatgctaactccattaggtgagaataacaatatatccacaatttttgagtcacagttaaagcaacctttattaaattctggccatgataatgggtctcaatcaggtccatacccaggattcccattgtatggccacaaagtacattattcatcaggagcttataaaggtttaaatccacaaggctacccacttcccacctttgtccaatcagtggcaagcatacatcctgaatgtggtcaagcatagtctgtgctgttgggacaaccaaattgtttacagaagcaattattaacttaaatgaacaagagagcctccagcaatccagatagttatctgcccttgggcaagtggggcttttatagatctcttaagcatagtaatttaaacttaaagcataatgttagccttcatagtatgtcacccgatgtataatctatgccgaaagatacccatttgttgttgagaagaatgtgtgttcttttggttggagagcatctccacatactagctctagttggcttgtgtgattctctccatttccttctcttatgtttattctgccctttgttcctttgagagtgaagtattataatggagggttttttttccaactcatggaaatcatattgcacactttttaatcaacagatgaaagaagtcacaaaggtgttatagggtttgagaggcccagataagtcaaatggagccttaattgttggcaaaattttcccaaacagatgagtgggaagcagccttgacctccagtcggttcaggttttcagggcaaaaaaaaaaaaaccccacaattgcgacatatttggaaaggcagttctggacatgtgcagcaagcacgccttatttactgaagtggacagatagcagttaaatgatcaggcagttaacccttaaagcccaggatcacgttgcacaggaatttatggctagtccagaaacctattttaccaagattgtttgagaacttaaagtatgcttggaagctcttccatgagatggcataactatacttcagtagcccacaactcatgaagtcagaggatacttagaaattatttaagacacaatacaatatataaaaaatatgaaattcatttaaagtactgctaaagagaaattttttacttctgaatttatatagcaaaaggtcagaaagataaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctctcatctgattggttaattttggttaattctcaaaacttcatcttggaaaaaaaaaaaaaaaaaactttactgcctatgtatgcgtggtggccagcggaagccagcgccaccctgcaacggcacatgtggcttcccacagttttgtttgtttttgatagttttacagagttggaaactaagccccgggttcagcatgtggtaggaagtgaccagcatagccatcctccagcctcgatggctccctttaagttccgtatagacaggtgttggctggaccaggagtgtctccatcatgtgtaaacacagctaaagtgaataaatgatgtttccttttgcggattgtttcaatgtctaccttttaaaattatttttacaaagtaacaggtttgcttatggaggttttgtaaatactttgttgaccctttcaccactcctgacacctcccatgtctctacctcccagccccaccctgcttaagcctgtctacacctggccctcccacttctacttcataccctgtgtattctaccacctttttctctcctttccttcaaatcatggtttttctccctcctgtgatcccctttctggttccctggccttgatattcactctctctcacagaaacggacacagaacctttagcggctaaggtgaggactaccacgtttgtctttcagagcctgggtttgcttcgcttaagacactatccagttcctacattttccagtgaattacatgatttttttttttcagctgaataaagttctagtgtgtacatacaatgtgtggtaacatttctactatctgctcatcggcatagtgtccttgccctgaacgttgacgataagcagcaatggatgcgaatgagcgagtactggttgtagctatagagttctttgggcatgtgtccaggaatggtgccgcaggctcatacagtaattctggctctacttttagcttctcaacgaacgtccacactgatttccatagttgctattttagttctcaccaacagtgaacaagggatcccctccccagcacaagtattgcttgtgacttgtttccttgatggtagccattctgactgcgtgtcttagttactgtttaatcgctatgaagaaacaccacaaccaagacaaacttataaaagaaagcatttcatagaggacttgtttacaatgttggcaggttaattcatgattatcatggtggggagcatagctgaatagacaggcaggcatggtgctggaggcaggttgcgggtgaagagagcttggaccaggtgtgggcttttggaacctcaaatccctcctccagcaatgcacacacctcccccaacaaggccacacctcctaatccttcccaaacaattccaccacctgggaaccaaacattgaaacatatgagtctatggggccctactacactagggtaaagtggaaatataaagcaattttaataattttaatttgtgtttttcagaacttgagatgttggacactttaaaaaatatgtaatggccaataataatataataataattgtttttactatggctttagtaatacaattagaaagaagatagactactacatcacgccttgattacccccgtcccccaggattgctttgcctatctaagttattttgtgcttccaaatgaatgctaaaattggctttagaataattctaaaactgtttttagagtatttctaaaattaattctgtttccatgaaaaatgagactagatttgataagggttgcattaaatcataagatggctattctcctgaaaactcctttcagttcaataactgatttaatgttttgtatttcatcaatattaatcctttgtcagatatagagcgcatgcgtgtgcatgcacacacacatctatatacatgtatgtgtgcgtgtatgtgtgtgtgtgtatataatttctccttttgtataggctgccttttcacttagttaactgcttccttagctgtatagaagcttttaattttggtaggtcccatttgtcaactattggcttattgcctgaatgactggaatataggttcaagaagtccttgcctgtgcctgtgtttcaaagtgttttctactttggctgactccgatttctggtgtataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaaaactgtttttagaatacttctaaaattaattctatttccatgaagaatgagactagaaatttgataagggttgcattaaatcataagatggctattttcacaataatgatttctccacatcatagtgtgggaggtcttcttgtattcttcaatttctcttgagtgctttaatgctttcatcgtcaaagtcttccacttacttggttaagcttattccaagtattattgtcatttgtcattattattactattaatttttcatgtgtatgagagttacttggatacatacaagagcatcatatgcatgcctggtacctgaggaggccagaagagaaaaggagtcactgcctggaacaggcagttgtgagttgtcaagagagtactggaaacggaaccccaactctctgcaagagcaacaagtgctcttaactgctgagccatttctctagccgccaccactaccaccaccaccaccatcatcatcatcactggaattgcacatgggattgtctctcccatttcttcctcactatgtttgttatcgctgtgtaagaggaccacttaacttgaatcctgttgctttgctcaaactgctgatcagttctaagacttttctgttgaagtctgagccccccccccattatagaatcttatcatttgcaagtagagatattttgctttcttcatttttaaatgtgtatccctcttacttggttatcttactgctctgattgagatttccaacactttattgaataagagtaggaagtggacattcttatcttggtcctgattttagtgctagtacattgtgttttcccatttttatagtattggtgtatagtttctgtctctctgtctctctctgacacacacacacacacgtgcgcacacacaaagctctgattatgttgagatatgttcattccttcagtgctgaatttcctaaagacttggtcagtgcatgaaacactgcttttacctcaaaggagaccatccgtaaatttcttcttgggccagtatgagtgaccatagtctaggaacaaatttcatattcacgtgtggaaatggtttcataaagtttgtatagtaccaggagaaagaaagtcataaatccacatgtttttcagtacattgctaaaatatcacataggcaggtgtcttagggttcccatgactttgaagagacacggtgcatgatgaccaaggcaagttttataaaggacaacatttaattgggactagcttacaggtttagaggttctgtccattatcattaaggtgggagcatgacagtgtctaggcaggcatggtgcaggaggagatgggagttcaacatcttgttctaggcagccaggagaagactggtatttgatgacagagtaagatctattcacagagggaactggtccattgtctccagtttcctggaagactttgtatagaattattattttgttcttgtagaaagctttcctgcaataagctcaatttatatatggcatatcgtctttgatatatggcatatctttttgtctgagcactgggaggtgtcttttaaagaatgtgcatatttcttctaagttacttaagtaactggagtgaagttgttcctaatagttcctcattgtcgtagtgtccatagagtctctagggatgccagttccattgtggtgattcaaatggttattggaaatcatggagacttaggagatagaaaactgttgctgaatttcacttgttcctactgactactctctgcctgagagactgtgaagagtccaggagttcagaagccaacaacagtaaaagagaactatcagttttctacctagggtcttaccctaccatttcactgtacaagcgtgggaaggatggcggaggcgaaaggcagcttgtacaaattgcatcaaaagtagcaacagaacctgcatagggcacagcccctctgacagctggtccaaagctctcccctggctttctaaggactcctccttgtgtctggtcttctcatcccctttaccttggttatcactttccttatttcttagctcgtaccttcgtcatttcgtgccctactatatcaaagggctatgaataaccttaggagacgttcagttgacgccaggtgaggttatgtttctgtgttctcctcgctgaaactgaaagcagcccaaagtgaaagggttaattttgactccgttcagagaaatgtagcccatcctagcagagagagcactgtggcaggaatggctcagtccctgccagtgaccagaagcagattggagagccagtcctcagcctgctttctcaagttcctcagccgcatttagagtgagtttcctcttcagttaaaagtggctggaaactccctcaaggacatacaaaaggatgtatctctttaaaatgtcctgtttctgtcaagccagtgaagttcccccttgactacccagaagtacaagctgccagataaccttctgctcacccaaggactggctctagattccttctgtttactttaacactttatgaaacttggagatattacaagactatctcaaacaaagagtgtgtatgctgttatccagactcagttatgaacagcaatttatgccatttgctatgtagtctgatcttttatcgtattttgtttgactgactaatttaatttgatttttcaagacagaattttcctgtgtatatagcccaggctagactcaagctcactctcctcctgcctcggactcttcggaagagtatcaacatgttgaacatgtgatagataccacgccctaaatacttgggcgtgtgctgtaggaaagcccaggttcatatttccttttgggtgctaactcagacacagatcctgcattctgtagctttgtccctttaaccccatttaatgtaaatatattcaaagttccttttaatattttagcatatttacattttgaaaaattatagttgttttttttttttaaatcttacttgggtttttccattgttccctcagtattagattagtttcatgtgttcctgcatggaaagttacataaaccacataagttgttgcctgtgaggggtctcttgtgaccaccaaggccagccagaaactcagttcctcgtgactcgggaactggtgatggttcagacttcaggtgtctgacaccaggtagttctaggcatatttaagtacagccctcaaatcctgtgtgtataacaaagcttaaaatatgattgcatcggaacccttgtaaagtacaagcggcatcttgcataaagataggttctatagattaaccaaggaagcaggctcaagggaggcaagctcatgatgacgggcctgggggaggacaacgcaatggtttaagataaacgtaagggccagggattgggcagtgcagcctgggcatgcagataacacagatagtgagtctacctctatggtcactatgttcgttcccagccttcaagatggaaacagttctacatctctccctttgcagagacagccctgtgtgtttaacattcctggcttccctgtgtttatctgtgagcacagggacctacatgcctcttacagttcccctgaaataacacacaataaggagactgtgtccatctattgtatccaacaatcactatttaattactcccctcaccccctctccgtaagtgacctctttaatacgtgttgttatattctgttcatcaatatttctttctctacttaacattaatagattacttttgtccaaaactatctttgcttcaccttgtggcaactctttccgcactctgggatcaacactcagaatcccattagagcaaggcttcttcttctttttaattgaaaaatactttttttttctgttattaaactgttatgcttctgtaagagcataacttacataaaagctttgttgtttcagcaaaagtgctgtagattgtagcacacagtgggttttacatctgagcctaggtttgggtctgggtctgggtctgggtctaggtctaggcagtttgtgattgctttccatggtagcccatactgcaaaaggttttgtatttggccctatggcggcagggaggtcctgtaatacaaaacgagtgcgaaacacctgaggttccttgggcatttgctttcgagttattttgtggttgttgtgcattctggaacctttcctattgctacacacccacggttatacacaaatccatgtaaggttgtgacagacaggttaagaaacgggttattacagtccaaacaaaacagtttgtgcccgccatccctcccttcctccttcccttccttcttttggtaaggactcaaagattgttattttttttcagtggcttgtaattcattactgttcttaattccttttgttgcaaattattccagatctggccagtggtggcttctttaaatctgtttttcttttccccttgtgatgtacacaccctcacatttcttccttttctttttatagcacttttgtgttttgtgctttctggtctagtgacatgttccagggcatttgctgggctttgagtccccaccattattcatgtggttgtaaatgaacagatgggatggtctgagccagagataaattccttggtaaatgctatccagtgaagagtgggaggcaggcaggtagtgcatacctggaatcccagctatgtgaggcaggcaggatcacttgagcctagaaattcaagtccagcacaggaaacacagtgagtccttgcctctaaataagaagtatacgagttgactctgtttgcctaagggtctacagtggaagacagtgggacgaaagcctggtcagttaccccaaatgactaaccagacactgttcaggcaaggattctcccaaagtggtttttcctccttgctatatgaaagccaagtgtagctgccccggggccctgttaatgcgctccttatgccgcacactaataaatggactcacctgaagtgaggttcactctaccgtgaaatataaagacccaggaactccctgcttcagtctcttggctctagaggtctcactctggacacactgggctgtgactgtttgcctgaccagaacctatgagaaaacgtgttgtctagagcagagccgagccctgaatgcaggaaacagctaatggtttgattcccatatgaagaattgaaggcgttgttcaggggcaccaaacgttgagaaaacggactttcctcgtgttgtcttgtttgcacagggactgactagtggttttcttctgttccctttaaactcataggctcttttttagtgaaaagtggtcccagaaaccattgtctgacactgctgtgctcactcctgacagagaagcattgattctccatcttttgagcaggtagagctaaggaatatatacatacttacattcacctcaaacagtatatacacatatatacatgttcatacacatatatacatgtgacaatatatatatagacttatttataaacatatttataggtatttgtatgtatatgtttacatgtactaaatatttatatgtatatgtttatatgtatatatagtatacatatatttatacatgtttatatacatacacagaggtatggatatacgtatgcatacacatgcatgcctctatctcacagcttcaagcacttagatctcttctttgatgttcagatgtatcttcacgtctattactatatctcacaaagcatactcatgcgtgtacacatatgctcacataggatactttattcggttcaaactgcaatagtagaataccacataataaaatccacggaagtttattttctcaaaatcatggagaccagcccaggtgatggtggcattgcagttggtttctggtgacagccagcttctcactatgatctcatttggcctttcttctggtacacagaagaacactccagtgtctctttctctggtgagaacatcacacttagtgaatcagggttccaccctatggcctcatttaaccctcagtgcttctgtaaaggccctggctctaaatacagactcactgtgaatcaggtttgcatcatttcaatatgacagggcatggccctacacaagggaaagtattcaaagtgttctaggaagaaagtgtcccaactagtcagtgttaaaagtctggatggtggagttgtgtgcaatcacagatgagtagtaactcctgtgtgtgtgtgtgtgtgtgtgtgttttctgtgtattagtatttgccacttaacagttgggagggctgctttgagcagcaacacgtttctgcctggaatagcctttttgtggcagatgttcatcaaagctccgttgctgtggggatggctgagtctcctcatcatggtctcacccctcccccaccacaatcctttgaactaggtcatgctgccttgtcaaatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctcatgggtctcagagattctttctttgaacgtcacctgatgggaatggatgtggaaaggttcagaactgtgccatttgagggatgtgggagggggcacagtgctgattggtagcttgtcccgtttctttctgggagattccagccctggctactttctgctctcctacccaaatctaccgtttctctcatctctcctgtctcttggaatgctttctcatgcatttcctgcagctcaggtgaacgagtggttgccgtgtgggtcagaggatgcgctttctataaattcctggctgttgtaagactgtcatgtgttcctgctggagcaggatggtcgtctggtgggaggctgcccttcagcttacatctgtctctgcctcagactcagtctctctgcactctgccttctctctggacttctctctattcactgacaaaatgatgctcccatccttcctggaattacctgatgtgacaccttaacctcaggcaacagtctgtgttctcatggcactggaccttgctggtgccagtgacagtagtgttttgactagccatctagcctctcgagctagatggaagactcatggtctgactcacaggctagtaagctgtgtgacttggggaaggaagttccttggcatctctgagcttattacaacttttcagaaatgggcatagtaatgcctcctaggaacattgtgaatatttttttgagataatgtttaaaacactcaggttatagtaagcatcattcaatggcacattgttgttgtttattataaagggcaacctttgtttctctcgaggggtttctgagaacagtcaaggcacagatggctgaaaaagtctgcagaagccaaaggaggctgctactagcctgagggggggggcagtgttaaggggtgtgtgtttgatatcttaaactggtcctctcagtcacttttcaagtttgtttttgccatatacaccatgcacttttgacaagggcaacatcatgtctcggctattctttgagatgagtgttttgatgattgatctcattgtgtgtatgtatgtgtatatgggtgtgtctgtatacatatgtctgtgtgtgtgttaaagggacatagctgtcctcactcttaaacctttggggctgcttttctttcctgttcactcatgtctcagatttgattcttaaaacagctcctattttttgtttgctatttttgagattacaatctaattacaacattttcccttccctccctctaaacctccccatgtactccattaaatccatgaccttttttctctaatggttattgcagtctctctcacacacacacacacacacacacacacacacacacacacacacacacacacacacacttattcctcagtgcactgttgagtgtatatgctgctacttgtgtgtatgttttctgggctgaccgttcagcactggacaaccaatcggtgtgctctctcctggggaggaacacccctcctgctccagcttctctgggctgcctggagttctttctgtagggtcgaagcccctgggcctttcctgcccaggctggcatgtttgctatgtctgtgttcagctcaggtttgggcagtcatgttgatgagacttcatgtgtatagctcctgacataactaggagacactctcacggcaaactccctgatcctctggctcttaaaatcttcctgcccattcttttgcaatgttccctgagccttgggtgtggtagtgttttgtagatgtatccactgggactgggctccacaactctgaattttgattggttgtggttttacctaatgatctccatctgttacaaagagttcctcgatgaggggtgaggactacccttatctgtgggcgtgaggacgaacgcttagattgttgttagggattatgcagggttagtaaagtagtgcttatagagtctcctccaaggaccactacactacgagcactgagtacttagctaagtctccagtaacaggcttggcatccctcttgttgtacttgtcttaattccgattagagaattgttggtcacggccctggtctgtgtgccattattgtacccagagagtaactgtgacttgttggcagttaacatggttcataggtatcaccgtgggactgttggtggctagcttcctttggaaacattcgtggcaccttctgttactatgaaggctagacctccgggagggggttgttcaggtcacttttagctcaaggggctgctggactctgtttccggagtccatggtgtgttccgtaagaacgacttccgttacgctgcctctcaggtgtaacatctgaagatttggagctaggaacctccaataagaaagaacttgtgatatttgttgttcttggtctgaattacctcactcaatatgatcttttctagttccatccatttgcctgccaagttgatggtctcatttttctttcctgctgaagagcattccatagtgtatatgtaacgtttctattatctgttcatcaattgaaggacatttggattgtttcaatttcctagctattttgaatagagcagcaatgaccgtggctgggtaggtatctgtggactaggatgctgagttctttgggcagatacaaggatacaaggagtggtatggctggctcacgtggtagacataagaagagagtaggtattattggtaaagacaagcatgggcctgggtctgttttgtatccaagtcttatcttccgtcttctgctgccacacttttcttattttgaaatataattcaatcagcaattccatgcgtgcagccctttaaacgtagattcttttttaggataaattccttaaagtgaaattattgaatctaaacacagtttttggtttaaggttttttataatgttttataaatgcatcccatcaaatactagcagggatctagtattctcagtgtatctgtaactggatccaaggtcatctttgaaaatgagccattattttcttatttcttctacctacctctgggcaagatatatgtcttagagttttactgctgtgaactgacaccatgaccaaggcaactcttatgaaggacatttacttgggactggcttacagggtcagaggttcagtccattatcatcatggcaggagcatggcagcatccaggcaggcttggtacaggaggagctgggagttctaagctgctaacagaattttgacttccaggcagctaggaagaggatattaaagcccatggccacagtgatatacctatttcaacaggcccacacttcctaatagtgccactccctgggccaaacatatacaggccatcacaatatggctgtaggactatagatctgtactgtttccactgggaccctttagacttggagtctgaaaccctttctagtccatgactgtcagctgttacaaaacatagtctaccctagcatggttcctttctttccattaaaggtgagcaatcaccatatgagatcctcctgaggctctaggcctcagttgctcccaacctgatgatgtaccaggtgttattatgagtcagatacacacaggtaaaagctcatgttatagcttttctctttctcaccatagttagtcaccacagaaaagcgcttcctgaaggacagtttgtacaccgaaggaatcctgattctgtgggacccatctgtgtatcatgcagacattccgcaggtaagtgagtctcccatctgccctcaggtttcctcacgctgctaggtttttaaactcacatgtgacttgagccattcctagctgtttgagttttaggcagcccactccatagggactggcatactcagaatccccccatccttgccagcgcctgcgcatgctttccctgggaagtcatgtgcatactccagagatggcgcatattgggcatggtggagactaggtaggagatatcctggaataggatgttcatcgctgtactccctcccgatgaacctccatgagaaatgacagtaattactgttaccccatcgatcatgtcgtcacatttctgctccccacttgcagtgtctaaaactcccctcattttgctcctgtaacactatccagaagtaggaggaagcctggtggctcccgtgtttcagatgggagagcagagcgtggatgggagaacttacctatgcttggttacctaactcagtagcacagatctgcaatgttgattcttttagggaagatgtgagccacgggactgctggattctcgggccttctggaagtgtctgctcagttttggttctctatgtaggttacacgtagtagtgtctcttggcatgggcaatggaagcctaaggagaatggcttagcagaagccacagaaagcactgatcttggtatgtttggttcttacatgcccactgatggctcttagctgtggctatcaccagtaccctcactccagtctgcagcttccctctgatctcagttataactcgagtctgcctgagtcaggtgaaagactctgagcccatagatacaatactttgtgctccaatttcctctccatcaacagtaagggtacctaggtgtgatggtcctggctactggaagctgaggcaggaggatctcttggcaccaggatctgaaggccaggcttggccaaatagtgagaactgcttaaaaacaaacaaatacacacagacaaacaaacaaacaataaacaaacaatggtgcagagatacccttcagatgatacagttcccacactggatgactctgaacttttcaagatcaccattccaacagtcctatagtcagagactttgttccaggccccgactggagcacccactaagggctgtgatttgatgatgttcgtgatctgccgcaagacaaggctgatcctctggcaagagtgtttgcgtaaggtttctctgctgagcacaccccttccttctgtttcagtggtatcagaagccagactacaacttcttcgaaacctataagagttaccgaaggcttcaccccagccagcctttttacatcctcaagccccagatgccatgggaactatgggacatcattcaggaaatctctccagatctgattcagccgaatcccccatcctccggcatgctgggtgagtgcgtgtgtggagaagacctgtgattgtttggtagaggactggctttcttcttcggtctcgttcatgcaccagaacaacttttctacttgtgcactatactaaatcttatcttacataaggtataatttttattcttaagaggtctgctgagggaacttagtcaggcatccaaggccacattcagtttgggccacaatgaggagactgccatcctgttgtaagagagaaggcccctggtagctgacggtcagagatttctatggaagagaggggagcttgacatgcagtgatagtgtaatgggaggcacacccaaagaggaggaagggaggagataggaccttggatggaataagcaagacccttgtcttaggcttacaattcagagagtatgctaaagcttactagtcaagtgatgttttaatgcaatatctttaaaaatcacaatgccagaaattataatgaacaacaacaacaacaaaaaggtttcataggtaactatggatagaagtggtaacattgctctgcagagtcatgttgggaacctgacacagacaaaagtttatcatacctctcctggctttgtggatgctttagttgaaaccatgagagaagctgggctagcttgtctagatggggtcatgtaggaaacgggaagcagatttggggtggactggggataagggtactgaatgctggtcaaagtctctcttcttaagctctctccctgtccctcagatcttaatgcccatccatccttccctccctttctcttgggatggaccactggggcattcccatgaatggacaggctgtctctgcagagggatggacactccttccatgggcaactgtagtgcaaacctttaacgagatgtttccagggactcaccactgtgcagtttatctgtctacttcccatactagagggctaactgtctttcacttatcctgtgggtctggcatggtaaaatttcccttagtaaatgagcagcttagttttctgctagaggcagggatgaaaagacataggggcccttgcagtacgtcagccccttttaccctctgcttcagcgttcgggtaggtgcatctgggctcttcctagagcttttagagcagcagtggttggtgtgctgaggaacagacttcctgttgccccagggccctgctgctgtctgcgttgcccctgccatacctgtcccctcctaaccacacgcctcccctctgctcccctctctaggtatcatcattatgatgacgctgtgtgaccaagttgatatttacgagttcctcccatccaagcgcaagacagatgtgtgctactatcaccagaagttctttgacagcgcctgcacgatgggtgcctaccatccgctcctcttcgagaagaatatggtgaagcatctcaatgagggaacagatgaagacatttatttgtttgggaaagctaccctgtctggcttccggaacaatcgctgttgagccaggcatcctcatccttctccataagtcattttatggctgctctcctggttaccactgcttgaaggagtgtttttattcaacaggcccagcctgcttcttgcactctagggaattttgttggcgagggttctggggcctccagtgtctgatggcaaggaggcagacccagccttccctgcaggcacagagtatgggagcccagattcttgccgtacacatttctcctgacaacatcctcctctcctttcacatgagtaggggaaagagccacatttctcaccagggttgccaaaactagactttgttttttccaactgaatgatgtcatcctaacaaaggagcaccttccgtggcttaaatctctccctaggtggtgatttcacatctcccagatcatgatttgtgtcagatgcagggtggcttcagggaggggaggcaaataattgggacacggtggggaagcctactcagttactctagagtaaagttgttcccaagggtagtcccttttgatccttaatcctgggtgcttatgatcttgcaaaggatcttgggtagctcacttcccactctccatggagacagaaggtacaaaacctcccatctgtccccaacctgatcagagttgagtaaaagagagagacacccaacaggcagctagaatgcaaacattccgtgcgctcagtgatttgggctcctctctgagagcgtgctgtctgtacacccagcaggggccagttctactgtgttcttgttgagcaagagcactggggaagctcttagaggaagaagagaaacacaccgtcttcttcagaagaagttttcactttcccctttatcactgatgttagaacatggaaacccaaggtatttttgttagaaagtccctacccacattggcaccaagtgctgccccacaggagacagcagattagtcagataggctggggctcttttattttattttattgttttagctgtctactccctaaccttctcctaattgctatcattactctcccttacagcaggcttccctcccaaattacttttaatcattttctgttttgcaattaccccaactttcgctgaccttatgggcccccccgccccccatgaaaggtctctcagggcatggggaatatggtttctgggacttaggttagaatcttaatcataactgattctcacaaggggtgaggtgtgtgatcacagattgccctgctccccctgcaagggagtagcattggtctctgggcagggaggacccaccctgtttggcaagcatactctcacaaggattttctgagacctctctacctggtgggaaaccacagcagcccactcagcccctggtgtgggagtgggttcagtgacttacagatcagaattaatgctattgaatcaaggtcactgagacacagtctactggattcccaaggctgtgctcacagggctttcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccttgctgcaggagagggcagtagagaaaagcagggcatcctttctgttgtgaggcatctgcatcatttgcaacgtgcaggagcctacctgtccttgctgcctgcacctcagggtgtgcagagcattgggctgcttggccgctgtgggggttaggtctagggaattcctggctcattataaggcatcaggactgtggatagagtgcccaggaagctgatgttccttcaagaggtcagcaagaggtacattagagatggagactacactgggtagattctagtttttagttcttattaatgtgggggagtaaattaataagtgtaatatgattctgatgtctgttagactttctctgtgctctgtaaatgtggatacttgagtaaagtggactacggagtggatgtgggcgtcactgttagtctgatgaggtatttagtatttgcgacaggtagtttaaaatctgtgactgagtgctataggaaagtgtctttctacgtgggcactgacgtcactagccatctatgcatcctaaatgcaggatcctcttgattccttctgccaatcaaatctctcattgctcttggtttccgggtttgtgtcagaaacttttaaaacatacctgttaattctaaattatccaaagattatgtgcaaattttaaaataaatatctttttcagaaatctgctgcttctctttatacttttctaaaggtaatgactgattgccacttatgtgtcccaaggagacacgtctggaaatcgagtgccctgtacttcaggagtctctggcattgatctccctcttcaacactccaggaaaaagtttatatatttactgtgatggaatctcagagatattgacagcttattgattttttttttgcccattcactcttgctagatacaagtaacgaagctatcatttatcgcacaccttaggagaaaggagaaatagaatagggtaaagaataaaagaaaaggctcttgctctggagttcaggacccttacatcagcggctcttaaccttccttacgccacagccctttaatacagttcatgatatgatggccctcaaccctaaaattattttcattgcttcttaataactgtaattttgctaccattatgaattgtaatggaaatatatatttttgatggtcttagatgacccccctattaaatggtcatttgaccctcaaagaggtttctacccacaggttgagaaccactgctttagattgtttagggcaataatgattttagggaatagctaagaatgtttgaagacaaaccctgaaaaagaacaggattttttttggggggatttctttttccctgaactgcttgatttcaagataagggcgtctccccaaatccttaatattgaattcctaacaccaggactctggaacctctttgaaaatgggactattagagatctagttatttcagatgaggtcatgcagcagtagggtgggcccgactccaggaatactagtgtcctcatgaaaaggaggaatctagagacaggcacacacagagaaaacacaatgtaatgttgaaggctgaggtcgcggtgatgtacaagccaaggaatgccaaaggttgccagaaaacccaccagaagctggagaagctgcctagaatagattctcccccacagtcctcagagaggctaacctcaatctgggagttctggcttctagaattttcagacaatacacctctgttgtcaaagccacacactttgaggtactttacacattatagcctttaagaaatcaagcctaatgcctcctccctccacacccctgcctttaaaactcctccctccatgcccctgcctttgaaactcccagctgcagcttcctgggcgagggaatgggaaagggcaacaggctgctcaggggtggtgcttactacccatctaggaccctggagaatacagtcttggatgctggggtttgtggggcttctccttcaggaagacaggaccctgggccaccactactgatgacatcttcatctgagtgttgctgattagccagagaacattgaagtgtctccctggccctgcatccaatgctttggcattgtgagctccttggaccaacgcatctccatgatgatagagaagcattatttggatcccatgggaatgggtgttgaaagcagaaagtagaaaaataattctacttggccaagtttccagtggcctggtgagctagtgggtgggtctctccatctgtgtctggagactggtttcttttgttcctcatcctggaatcggattctgtttttatgatatagatgctaattatgaggaggtggaaaaatggggtctcagtttctttgctgattgtaagaaggaagcagtgtgtgacacggtgtcgtggccctcagcacagcctctaggatgtactgtgatatgcactgtgaggcgaggcgaggcgaggctaggctaggcttcccctctcttgggaagcaggcgtgttccagtcctaaaagttcactccacgggctgggagattgccatcagttcaggagagcacgaagggctgtattgtgtcatagaatgctctcatgattctttatactcggtcctcctcagggttaattggagaacagattttgatagaaagagagaaataccattcaggccagtgagcacaggagcagctgctaccaggcactgggagatgtgtctcagggcttctaccctctgtgaaacagaagctgggaaggtgagcctgcctgcctatgtggaggtattttcagtaacactgacctggacagtagtgctatattcttgagcacccattcataacggcctggaagaaaatacatgcaattgtcaagtggagaacatggcagtgcaggtcaaggttaaggtggagtctgaagagcaaaagcacttcctgttgatgggaaataggcaagccttggtagacaccaaacttgaaacatgggtagaatgcaccttcctcctcttcctcctcctcctcctcatcctctccctcctctccctccttctcctctttttccccctccttctgttcttccttctcttcctttctcctcttctttttctcctttttcttccaatcttcttcctttcctccattttctccctccctcactctctttttcttcccccacctctggcaggcagctggtattacaggtacgcttattctttcctctcattgcctttcttcagggaggcaggaattgtctttttctaccatgctgtgtaccctgggctagctagcacatgaacttcccatctcactctagggattctgggattacagatacatgccacctaacccagctttttacctgaatttctgggattgaactctgtaagtcacgcttgctcagctaacatggtgcctactgtgtcatctcctggctctctttgcacttatctgactgtataatttcaaatgttctatcttcacatcctcggatacttttctgcctgtagtttgcggctgatgctttccattaaaacatttagctctgtttttttattctttattcctaggggctctcgttttcttatttctatttcaccactaatttcatattatttatcgattagaaatatgttatcctttcattagatgtgaataaaacaagtctttaaataaatatacattcattatgaaaactctcaacagatgcaccccacataatcaaggcttttttatgaagagcctacaactaaccttttctctagggacagatcaagtctttgctttaagatctggaacaagcagcaaataccatgcttgccacatcttttcagcacaggattggacatctttgaccaaaatggagttaccaggtcattcaagagcaattcagaatggttttaaaattttcaacaaatcattcaattttgcagctgaatcttcatgtagttctttaccgttttaaggggactattccgaattcatgggtggtcagttcacttattccttttataacttcattatctccctcagtggtgttctactgccactctcatgtgttctgtcataggcaccagtgcagggaaagaaagagcgaccttccagcctccgagtgtgctctttgttgctggtacaccgtcactatttgatcttgcctttgattcccgctgtgctagttagtggtccacaacctagccatggtagattccacagcctagccatggtagatttggctactgtgttctctggttgagctgggctggaagttgaagtcagtcaatggtgtgacgtgtaatccagtgacactatcagactgcctcttcaccatttggggactgaggctgggtagagaatggttgggttccaaggctcagcactgtctctggctttatgacttaacttgtcagtgtgcacagagccaaagtctagccctccacctttacacacacacacacacacacacacacacacacacacggtcttgggagctttccttccaccctatgatagtcttaagcagtgcaccaaggctgcttcaccaccgtgcctgggcagagctacatgttcccatgttccatgttaattgcttctctggccctgctttccaaactcaaggaaggttagttttggttgggttaaagactgaggactgggcttgggcagagacagatgttccctttgtgaataatgatcaaattggccctattctctggcctggggaggtttcaaggctagctgtggaagccagacaggtgtgagccaaggagacccactgactgcttacagagcgatgctgttggcttgtctccctgctgatatgaatgcaaagctactgccaaggtctgcatgctggtttctgtgagcctactacctcattctccagctgagccttggcattcatgagacaggacgatagagtgccactcacaaaggatccaagaatggtggtgagcccaagtttgcctctaattctctcctccctctataataaccacaggaatagtctgtgtgtggcagtgtgccagcttggaagaggggtaacataatcaacactgctcattttatcctctgtgcatgaatttttaattcaagtactttatcatcatcatcattattttacttattcacactacaccctattcactgcccccctgccagggaccctctgcatatccccccactctggtaccctggcacatcaagtctctgtgaagctaggtacatcctctcccactgaggccagacaaggcagcccagctagaagaacatatccctctggtttaggcaacagtttttgggatagcccctgctccagttgtttgggactcacatgaagaccaaactgcacatctgctacacatgaatgggcaggcctaagtccagtccctatatgttctttggttggtggttcagtgtcttagagcctcaggggtccaggttagttgactctgttggtcttcttgtggagttcctataccctacggaactgcaatccttcctcctattcttccataagagtccccaagctccatccactatttggctgtgggtgtctgcatctgtctgagtcagctgctgggtggagcctctcagaggacagccatgctagtctcctgtctgcaaacataacaaaagcaccattaatactgtcagggattagtgactgcccgtggaatggatctcaagttaggccattattggatagaaattccctcagtctctgctccatctcccatccctgcatttcttgtagacaggataaattttgagtcaaatgttttgtgtatgggttagtgttcctattgctctattgaggttcctgcctggttacaagaggtggcctcttcgggttccatgtccccaaatgctgtgaatcacagctaagaacacccgattgattcttgggtacctcccttatcaaggtctctgtcctttcctggagatgactccatacctccacacccttgtcagttgcagatttccattcattctcatggccatcgggccatctctcctgtcctgatcctgaactcccctcattcacttccccatcccctctctcacccagtttcctccttccatctgcctcatgactattttcttcccccttctcattgagattcaagcatcctcgcttgtgccttccttcttgtttagcttctttggttctgtgggatgtagcatgggtgtcctgtattttatgctgatatccacttagaagtgagtacctaccaagcacttcctgttgggattggtctacctacttaggatgatattctcaagatccatccatttctttacaaaattcttgatatctttgttgttaatagctgaataatatcccattgtgtagatataccacattttctgtacccattttttagctgagggacatcaaggttgtttccagtttctggctactatgaataaagctgctatgaacatagttgcaataaatggagagaaactaaaagcaattccactaaaatctggaacaagaaaaggctgcccactctctatatattcaatatactacttggagtccttttcttttcttttcttttcttttcttttcttttcctttcttttctttttttgtacttgaagttctaaccagagcaataagacaactaaaagagatcaagtgataaaattggaaaagaagtcaaagtatggctatttgcagatgttatgatagtatgtataagtgacccaaaaaattctaccagagaattcctacagctaataaacaagttcagcaaagtggctggatataaaattaactcaaacaaatcagtatccttcctctacacaaaggataaatgggcggagaaagaaatgagggaaacaacacccttcacaataatcacaaataatataaaatatatcggtgtaactctaaccaagcaagtgaaagatctgtattacaagaacttccaagtccctgaagaaagaaactgaagaagatatcagaagatggaaagatctcccatgctcatgggtaggcaggattaatgtagtgaaaatggccatcttaccaaaaaacaatctaccgattcaatgcaatccccatcaaaattccaacacattttttatagatcttgaaagagcaattctcaacttcatatggaaaaaaaaaaaacccacgatagccacaacaatccttaataaacaaacttccagaggaatcagcatccccgacctcaagctatacttgtagcttgagcataagtgataaaaactgcatgttattggtacagaaacagacacactgatcaatggcattgaattgaagacccagaaataaaccctcacacctataaacagttgatttttgataaagaagccaatatatacaattgaaaaaagaaaacatcttcaacaaatgatgctggtctaactgaatgtctacgtgtagaagaattcaaattgatccatatttattaccctgcacaaaactcaagtccaagtgaatcaagaacctcaacataaaaccagatacactaaatctcgtagaagagaaagtgggaaatagccttgaactcattggtacaagatacaatttcctgaacagagaacaataatggctcaggctctaggatcaataattgataaatgggacctcttgaaactgcaaagcttctgtaaggcaaaggacactgtcaatagtacaaaatggcagcctacagattgggaaaggattttcacacaccctacatctgacagagggataacatccaaattttataaagaactcaagaagctaaacaccaacaacccaaataacgcaattgaaaaatggggcacagaactaaatagaattctcaacagagatcacagagaaatgtttgaacattaaagaaatgttcaaagtccttagtcatcagggaaatgcaaatcaaaacaactctggaattctatcatacaccagtccaaattgctaagataaaaaaactcaagtgatagcacatgctggtgaggatatggagcaaggggaacactccacaaccactttggaaatcaatttggcattttctcggaaaacttggaataggtctacctcaagaaccagctatatcactcttgggcatatacctaaaagatgttctaccatcccacaaaggcacttgctcaactatgtatgtggatgttttaagttttataatcaaagtatcaaagtggatgtctttgccttgctttgggttttggctattatctcttatggtggtttgaacgctcccatacacttgtatgtttgaatacttggtccttggtagaactgtttgggatcaggaggtgtgtcactgggagtgggccttgaggttccaaaagactagactaactaacatccggttctctctctctccctctctttcttcccctcccctcacctttcctgtctctctctgcctctctctgtctctctctgtctctctcctctctctgtctctctgtgtctctctctctgtctctctctctctgtctcttccgtccctcccttgtatttgtgggttagaatctaagcactcagctctgcctgcagctgcgcctttactcttccatcatggattccaatcctctgaaacagtgagcttaaattaaacattttcctgtataagttaccttagtcagggtgtcttatcacagcaatagaaaagtaactaggatatctcctcaaagatttctcattctctttccatttcgtgggataattattgaaatgttgacttcaggccatcttaatactctctgattctttctgtttaatgttgcataatttgtagtatttaggtcactagtccttctatgccccccataatgtaatataccattactataaccataacattaatataccattattataaccataatgtgatataccattattataaccataatattaatataccattattgtaactgtaaggtgaatataccactgatcctatattgagcacttttcagttgggctactgaatatttcatcttttcttcaacttattaaatatttaaaacataattt

SEQ ID NO: 1700 - DNA, 2242 bp, Mus musculus
gcatctatctcaacaatttctctacaccggttccccttgctagggattttgggccacgaaagctctgggtttgtctgcctctgttttgtggctaaaagctgactctgggcacttcaaaaaagatggtttttgatcatcctgtgaaaaatgagccttggcctccagacctagtaaagtaaacctctttcccatggagaacagtgctggctcctgaggacctggagggcccaagccccagaaggattagccagaagcaggcttggttcctgctccgatcagtggctctcctgcccgtaccattcattatgattcataccaacttgaagagaaagttcagctgctttgtcctggtctttctcctgtttgccatcatctgcgtgtggaagaaagggagcgactatgaggctcttacattgcaagccaaggtattccagatgccgaagagccaggagaaagtggccgtggggcctgctccccaggctgtgttctcaaacagcaaacaagaccctaaggaaggcgttcagatcctcagttaccccagggtcacagccaaggtcaagccacagccctccttgcaggtgtgggacaaggactccacatactcaaaacttaaccccaggctgctgaagatctggaggaactatctgaacatgaataaatataaagtgtcctacaaggggccgggaccaggagtcaagttcagcgtagaggcgctgcgctgccaccttcgagaccacgtgaatgtgtctatgatagaggccacagattttcccttcaacaccactgaatgggagggttacctgcccaaggagaacttcagaaccaaggctgggccttggcataagtgtgccgtcgtgtcttctgcaggatctctgaagaactcccagctgggtcgagagattgataatcatgatgcggtcctgaggtttaatggggcacctacagacaacttccaacaggatgtgggcacaaaaactaccatccgcctagtgaactctcagttagtcaccacagaaaagcgcttcctgaaggacagtttgtacaccgaaggaatcctgattctgtgggacccatctgtgtatcatgcagacattccgcagtggtatcagaagccagactacaacttcttcgaaacctataagagttaccgaaggcttcaccccagccagcctttttacatcctcaagccccagatgccatgggaactatgggacatcattcaggaaatctctccagatctgattcagccgaatcccccatcctccggcatgctgggtatcatcattatgatgacgctgtgtgaccaagttgatatttacgagttcctcccatccaagcgcaagacagatgtgtgctactatcaccagaagttctttgacagcgcctgcacgatgggtgcctaccatccgctcctcttcgagaagaatatggtgaagcatctcaatgagggaacagatgaagacatttatttgtttgggaaagctaccctgtctggcttccggaacaatcgctgttgagccaggcatcctcatccttctccataagtcattttatggctgctctcctggttaccactgcttgaaggagtgtttttattcaacaggcccagcctgcttcttgcactctagggaattttgttggcgagggttctggggcctccagtgtctgatggcaaggaggcagacccagccttccctgcaggcacagagtatgggagcccagattcttgccgtacacatttctcctgacaacatcctcctctcctttcacatgagtaggggaaagagccacatttctcaccagggttgccaaaactagactttgttttttccaactgaatgatgtcatcctaacaaaggagcaccttccgtggcttaaatctctccctaggtggtgatttcacatctcccagatcatgatttgtgtcagatgcagggtggcttcagggaggggaggcaaataattgggacacggtggggaagcctactcagttactctagagtaaagttgttcccaagggtagtcccttttgatccttaatcctgggtgcttatgatcttgcaaaggatcttgggtagctcacttcccactctccatggagacagaaggtacaaaacctcccatctgtccccaacctgatcagagttgagtaaaagagagagacacccaacaggcagctagaatgcaaacattccgtgcgctcagtgatttgggctcctctctgagagcgtgctgtctgtac

SEQ ID NO: 1701 - protein, 445 aa, Mus musculus
TSFPWRTVLAPEDLEGPSPRRISQKQAWFLLRSVALLPVPFIMIHTNLKRKFSCFVLVFLLFAIICVWKKGSDYEALTLQAKVFQMPKSQEKVAVGPAPQAVFSNSKQDPKEGVQILSYPRVTAKVKPQPSLQVWDKDSTYSKLNPRLLKIWRNYLNMNKYKVSYKGPGPGVKFSVEALRCHLRDHVNVSMIEATDFPFNTTEWEGYLPKENFRTKAGPWHKCAVVSSAGSLKNSQLGREIDNHDAVLRFNGAPTDNFQQDVGTKTTIRLVNSQLVTTEKRFLKDSLYTEGILILWDPSVYHADIPQWYQKPDYNFFETYKSYRRLHPSQPFYILKPQMPWELWDIIQEISPDLIQPNPPSSGMLGIIIMMTLCDQVDIYEFLPSKRKTDVCYYHQKFFDSACTMGAYHPLLFEKNMVKHLNEGTDEDIYLFGKATLSGFRNNRC

SEQ ID NO: 1702 - DNA, 59838 bp, Homo sapiens
ccatttacttgttgatgaaaccagttcagttgtcccataggaagtcctaccttctggatttgtctgataattttcctttggcgctatttgacttgttcttctttcttctgtatttcctaaaaactggaattgtgtatgacagcttgataatatacagattaaacattttgggcaagaatttttcataggtggttagcagggcgtggtggtgcacgcctgtgatcccagctactcgggaggctgaggcaggagaatcgcttgaacctgggaggtggaggttgcggtgaacagagattgtgccactgtgtactccagcctgggtgacaaagcaagaccttgtctctaaaaaaaaaaaaaaaaaaaaaaagaatttttcataggtgcttcatgtcacgtcacatcagaaggcacacactatctagatgtctcactgttaatgatgctaaaagactgatcagggtcaggtcacggctgcttgactcacgagaggtgttttgattttgctttttaagagcagcagcgtgtctatatgttgatgggagtaatctttgagagagggatacttatcaattaaacaaaggggtgaggttttctagaacaactttcttaagtaaacaataatgtgtaggatctagtggacaagtgttggttattgcaagtgttggacatagccagttcatctatagtaatgaggcatatggacataaatgcagataaagggggctctgttagggggtttgaggaagttctaatctggcagcttttgttttctccatgaacaagtagcaaattcatcacaggagagggagattgaaaggaggaagtcaagtagtgggcgagtgccagatgaatagactggacaagtagcatgtgatttctgaaaagcattaaggacctcctggcagttagggatcgcgaacttgaagtgaaatcagtaagcattgttgtacaattttctctagccatgctcagttgcatgtttgctggtgtggagcagaacagagggttggatttaaccaggattgagttttagccaatcatgtgtgatcaaagagggcaaaggactcattttaatgattttgaccatggaatttaagctgtgtaggaagggaagtaagaatatgaggaaagtgaggaacagtgacaggtggaaggattaaccacagaagcttgttggagttggggtactagttggaataggctgcatatagacaggagtggtaattggagatgggatgcctgaactcaagattatggaaggtattgttgggaaataacaagatcagagatacaactctgggagtgagtggccgtggtcacaatcactggggtagaggagatcaaaggactgtgaggccagaggactagaatatcctaaaagtggatattaatatcacaaggagttatgatagaaacagtgttggagctaaaatattcaggcaacgaagcacggtattttgggtgggggagaagatggctgcagccaggtaagtggggtcataggtagcgctgtctgcacagggtctctgtgaggatgacatgcattgatgcatgtgatgctcttcactttgagcctgacaaatagcatgtgttagaggttcagtctaacacttgctagaggcaacaagtgttagaggttcaccatctgagtctatgtggctccagtgagtagagcttaaaacactgggtttatagttattcattttttattttattttttagacagagtcttgctctgttgtccaggctggagtgcagtggtgcaatctcagctcacttcaacctccgcctcccggattcaagcgatcctcctgcctcagcctctcaagtagctgggattacaggcgcccgccaccacacccagctaatttttgtatttttaggaaagatgaggtttcaccgtgttggctaggctggtctcgaactcctaacctcaagtgatctgcccgccttggcctcccaaagtgctgggattacaggtgtgagccaccgtgcccagctgcaacactggatttatttttacagggaagttgattttcattaactttaatatatttctaagaggcagagctactcacacagttgtgtgtggtctggggcggtagtaaattccctgtcattcagtgtatccaacaggcaaaatgaacatttgcaatgatggtgccgtcaaggtgattctggcaactgaaggtgatgggtgggtaggtgggagggagtggctgtagcaattgaaggcagtgggcagtggggagggatggtgtcaggagctagcttcattcttgcattcagacatgactgaacatttcctagttgtggcccaggagctctcaatctggttgggacagatctgcaaacagataaatgtcacatagtttgatgaggggaagaataggcaccatggagttatgctgatcatctctgtgaggccaaggaagcttgagagtcaaggagcacttgagctggtgttggaagctgagtgggcatggccccatgggaacagcacaggaaaccacactttgctgaagaacttcttgtgcagagctgcaaaggcatgaaagagtcttcgacatttagagtgccattctacttaatctgggcaaattatttatcttccctgtctcagtttccctgtttgtaaaaatgggggtagtaatggtatccacagaggaagggatggtgactgttgtaatccctttgagtggattatctttttttttttttgagatggagtctcgctctgttgcccaggctgcagtgcagtggtgtgatctcggctcactgcaacctccacctcccgggttcaagtgattctcctacatcagcctcccgagtaactaagattacagacacacgtcaccacgccccgctagttttgtatttttagtagagacgggttttcaccatgttggtcaggctggtcacgggcttctgacttcaagtcatccacctgcctcagcctcccaaggtgctgggattacaggcatgagccacagtacctggccgagtggattattttacttgattctgtaaatcacactatgaggtaggacttgttattattactatttctattttatagataaagatgtcttaaatcttgggtcttaaggggttgagtaacttgctcaaagtcaggtagctggtgaaaggcagtttgggctcttgtcttgataaatctgattccaaagcttgtattgttcatccctaagctatagtcagtgcttggcacatagctagtgctaaataaatggtagctattattgccaggattgctaaagtttctcacccagagagttgagggttctgttatcacttctacagctggttgaagatcagtagtgctgctatctcatcagcagcagggactatttttggaaagccctcatcacctatgataaatctagatagttgcaccacttttgtttcaattggttgatttttgaaaatcaaaaatggagagtgatttttatcttcttagagggcaaggttttttgagcagatgcagttgatgtaagggaggaagagctgggattgatgtacttttctgttgtctgtgggctgtatcaaacaaaaagtttcatgttctggctgccagctggaggatggcagcaaaccagcattcacaggcaagaggtatcatccaaaagtctggtgactgcccacagtgttttctacagggggctaagaaagagcctcttccatgagtgatgccaggagtaagagctgtgaacccgtcacccatttattcattcaacaaatgcatactgagagcttattaagtgctagacattcatctagtgtctagagatactccctggaaataatagagaagaaggttgacaagattcctatttatgaagcttatatttttagtggaaggagacagactaatcaaatactaaatgaatgcctgcataattacaaacactcatgccacaagggaaattcatgctgtgaaaatgtcagagggataactatcagagaaattttctgactcttccaaggatgctgcccagaaaaccgtccttctttgagctgatgaggagagccccaaatgttttgacacagggcagagtggcacctctcactttttccctggtagtcatacctagggtttgcctgcctgccttcctcctggtcatgaagagctggggttctcccaacctgaattcctagccttcaacagaggattttctcttggttcatggggtgaagtcaagtatgtccatatggcttcctcttagttctgttaatgctagatctcctaggacaggccttgcagccaggttaatattgtgcaccaagttgatacacaaggttgaagtgtattttttagtattgcccccaagagttttgccttaattattcaagtaacataataaaaataataaaggaagttggctaggcgtgggggctcacgcctgtaatcctagcactttgggaggccgaagtgggtagatcacctgaggtcaggagttgaagaccagcctggccaacatggtgaaaccccatctctactaaaaacaagtattagctgggcgtggtggccggtgcctatattacccagctactggggaggctgaggcaggagaatctcatgaacctcgggggtggagcttgcagtgagccaagattgcaccacttctgcctgggccgacagagagagacaccatctcaaaaacaaagaataaaataataaaggaattcaaactgataagaattaatctttcatcagtttatccgtcaatggtattcaagtctcaaccatttacattttttctagacagttggatatacatatcttttaagtcaccatctgagtatacaggtaacattttctgttttgcttttttcattttaagattttaagtattttctcccctattactatataaattcatacacaattatataaattatttcaggtggctataccatgcttttcttatttccttattgctggatgcttagttgttaacagattttcaccttgataaataagctcgacattaaaaatttttatttttggcagtgttattaggaaagtttgtagtgcttaacatctacttcaaaaagttagaaagatctcaaattaacaacctaatattgcacccagaggaactagaaaaaaaatttaccccaaagctggcagaaaaagaaaaaaataactaaaatccagagcaaaactgaacaaaattgagactcaaaaatccatacaaagaatcaacagaaccaaaagttggttctttgaaaggataaacaagtttggtaaaccattagctagattaacaaagaagaaaagagagaagatacaaataatcacaaccagaaatgacaaatatgacattacaactaatcccacagaaatatgaaagatctttggagactattaatacctctgttcacacaaagtagaaaatctagaagaaatggacaaattcctggaaactcacaatctttcaagattgaatcaggaagaaattgaaacctgaacagaccaatatcaagttctgaaattgagtcagtaataaaaaacttaccaccaaaaaaagccctggaccagataaattcacagccaaattctatcagacatacaaaaaagagctggtaccagtcctactgaaattattccaaaaaagtgaggcagacagatccctctctaactcattctatgaagccagcattaccctgataccaaaacctggcaaagacacagtaaaaaaagaaaaccgcaggccaatatccctgatgaaaataaatgcaaaaatcctcaacaaaacactagcataccgaatccagcagcacatcaaaaattatttcactgtgatcaagtaggcttcattcctgggatggaaggttggttctacacagacacattaataaatgtgattcacctcataaacagaattaaaaacaaaagccatatgatcatctcaatagatgcagaaaaagattttgataaaatccaaaatcctttcatcaaaaaagccttcaagaaactaggcatcaaaggcacatacctcaaaataataagaatcatctataacaaatccacagccaatatcatactgaatgggtaaaaactggaagcattctccttgagaactgaaacaagacaaggatgcccactctcaccacttctattcaacatagtattggaagtgctgtccagagcaatcaaacaagaaaaagaaataaaaggcatccaaataggaaaagaagtcaaactgtctctctttgctgacaatatgattctatacctagaaaactataaagacactgccaaaaggcttctggaactaataaacaacttcagcaaagtttcaggatacaaaaccagtgtataaaaattcatggcatttccataaccagtaattttcaagctgagagtcaaatcaacaacacaatctcatttataatagtcgcaacaaaattttaaatacctaggaatacatctaatcaaataagtgaaatatctctccaaggagaactacaaaactttgctgaaagaagtcatggatgacacaaactaatggaaaaacatttcgtgttcatggattaaaagaatcaatatcattaaaacagccacactgcccaaagcaatctgtagattcaacactgttcctatcaaactaccaatgtcatttttcacagaactagaaaaaacctatcctaaaattcatgtgtaaccaaaaaagagtacaaataactaaagcaatcctaagcaaaaagaacaaactcagaggcattccagtacctgacttagaactgcactgtaaggctacagtaaccaaaacagcatggtactggtaccaaaacagacacatagactaatggagcagaatagtgaacccagaaataaagccacatacctataatcatctgatctttaacacagtcaacaaaaataagcaacgggggaaagaactccctattcaataaatgatgctggaataactggctagccatatgcagaagaatgaaactagatcccttccttataccatatacaaaaattaactcaagatcaattaaagatttaaatgtgagacctcaaactataagaatcctggaagaaaacctaggaaacaccattctggacatcaaccttgggaaaggatttatgacaaagtacttaaaagcaactgcaacagaaacaaaaattgacaagtgggatctaattaaactaaagagcttttgtgcagcaaaagaaactatcaacagaataaacagacaacctacagaatggaagaaaatatttgcaagctatgcatctgacaaagatctaatatccagaatctataagaaacttaaacaattgaacaagcaaaaaacaaataacaacattaaaatgtgagcaaaagatatgaacagacaattctcaaaagatgcatataagctgccaacaaacatgaaaaatgctcagtatcactaattattagagaaaagcaaacaaaagcacagtgagataccccctcacgtcagtcagaatggctattattaagtcaaaaaacaccagatgctagggaggctgcagggaaaagggaacacctacacactgttgttgagaatgttaattagttcagccaccatgaaaagcaatttggagatttctcagaaaacttgaaaacagaactactattcaactcagcaatcacattactgggtatatatccaaaaggaaataaatgtttctaccaaaaagagacatgcacttgtgtgtttattgcagcactattcacaatagcaaagaatggaatcagcctaggtgcccatcagtggtggactggataaagaaaatatggtacatatacactgtggaatagtacacagccatgaaaaagaacaaagccatgccctttgcagcaacatggatgcagctggaagccattatcctaagcaaattaataatgcaggaacagaaaaccaaatgccatatgttgtcacttataagtgggaactaaacaatgaatgctgatagacataaagatggcaataataaacactggggactacaagacggggaaggctggggaaagagctaaaaaatgaattattcagtacctgcatggcaggatcaatcataccccaagcctcagcattgtgcaatataccaggtaacaagcctgcatacataccccctgaatctaacatataaattaaaattattttttaaaaaaacccttttcttctttgtgtgcgtattgctttatagaactcatattctttatctcattaatcctctttcatttgtcatcagaactatgtaatgtagagaatcattttacatgtggggaaactggagtatgtaatcttttgaattatttatgaattatttatttattcactcttatttcctagaagtacagtagcctggtccatggtcagaagctcttaattctatggcctgaatacattctagaaaggttacattaatttatatgatcctttgaatatatatcgatttaattataatctgtccagcaatgagtattatcatgtagaaaactgcggacgaatgtaaattctataaactagtttctcagtattctagttgcccctcttgggtttctctcatgattaaccataactttatatgcttgttaattgtgctttttattttgtgattagtctgttcatgttgattacctctttattttgggagacttttattatattaaccctttttatattttgacttttcctttttattgtagttacagtatttttcattgtatagatgttgaaattttcttgcaactgaatgtattaaacttttcctttgctattttcctacatcgcatcaaaagaagaaagagctgacaggtatatatttatatttttagctgttttttgttggtttgtttagagacaggttcactctgtcacctaggctggagtgcagtggcgctcatagctcactgcagcctctaactcctgggctcaaatgatcctccctcctcaacctcctgagtaactgggactacaggcatgcacgcctggcttatttttagctttttaaaattacatttttatacttttgtacattttttcaaagtcaaagaataatggatgtacattttagaaattttggaatatatgtaaaattataaaagatgaaaacatctattattaccattctgggtgtacttttttctagtactttttcctagtactttttcacgtttttttaaatgtattttttttctgaatttggatagtgtttaccgttttataacgtattttttcagttacaattatactgattgaactttcacatattattaaatattctttgaaaataaataattttttgaaaatctgtatgaagtttatttcaggatggacctaattactccctgtttacctccaagccagcaattaaacaacctgttcttcccaggttggtccatggtggccgctttagctttctagcccattcttatctggtgtcaagtctatttctttttttttttttttttttttcttttgagacagagtctctctctgttgcccaggctggagtgcagtggcgtgatctcggctcactgcaacctccgcctcccgggttcaagcaattctcctgcctcagcctcccttgtagctgggactaccggtgtgcgccatcatgcctggctaattttttttttgtattttagtagagatggagtttcaccgtgttagccaagatggtcttgatctcctgtcctcatgatcctgatccgcctgcctcggcctcccaaagtgctgggattacaggtgtgagccaccacacccggctagtgtcaagtctatttctaggctatctgtgctgttcacagatccagagcattgcacctttaataggcttttctctctctctttttcctgagccctggaggcttcctggattgagacctagcctaggtctgcataagcacctttccatcttgttaatgtttaacactgcctctgctggaaaacagctctcacctcctctctttctgtctcttattttttgcctttgcagatgagttttgatcatcctgagaaaaatgggccttggcctgcagacccaataaaccttccctcccatggataatagtgctaattcctgaggacctgaagggcctgccgcccctgggggattagccagaagcaggtaaggaacacacagaggcatgggctagcaaaggggtacattcctgagtaaaagctggtgtggcagatgtcctggcagggaatctcaggatctcagtatctggctccagctttgctgttttctttttgtatgtattttttagtcctctttaactgctgattcaatgtgggtttcattggggggtgtagagaaatggcttgtccatttctattaactatataagatttaagttattctgtatttcagtcaaccattctgagtacctactacctgccacgaatgcaactggtactgagtatgtcatgacgggtgggtcgggacaggatttccttgctttgagcattgatttctgccggttcagtgttggccagttctttgaaggtgatgatgcaagtcgctgtgttcttcctctagaagcctcgtgatgattgtaaagattctctgatacaattgcatcagttcaataatctttcattgagtatccgctctggtccaggcactgtgctgggtactagggtttcagaaaggataccaggaggagttttccttgagcagcaaagtcaggcatgaaaagcaagcattacaaagcactggctggcagcaaaggggagcagggatagtgcggaaggggaggtggcctccactgaccttcagaagcagaaaggtgatgctgtcagagctggcaggcacatggacaaggagaaagagtgcagcagtgcagacacctggaggcttaacacagtctggtgtaattggaaaattcaaagcttagtgtgtttttccaaaacatttgtagagaaaagtttgctactcttttccctcggttgcgccatttagagaaagtttcttcagcctctgccttcttcagacaatttgagagatgagaaagggtcttgcagttataagtgcctgtgaccagaaactccagccacctggtggacttggagcctcaaccaagggtggtgtcaagggaccacatgagcccttatgtgagatttcagatgagtgccctgaggccatgacagagcacaggctgtgaaggctgaggctgtctgatggttgcaagactgtcgctagacccagctgtttggaggaactcttctttcctgggaaaccacaccttggagagtaggtactgggcagctgctgcctgagcctccactcctgtgacagtgaatcaggcccttcctgccatcttgtttcattcagacatgtgaaagtcaggttctaagtccactatttccaaatcactcatgcaactttgaaaattatttgtatttccaaacctcactatactcagctataaatggagctcataaaatctgctgtgcttatctcacgggagtataataggtctgtaaaaccttaccaatacggaaagtacctgagtgttaccactcagtgcacagcagggatggcaggtgcagcactgatggtgaaggtggcttgtctgcgactgtctgacagacgaagttgcctctctagtgaccttgagtccgacttgatcacactgacttctcactgtcccttatcacagatgcatgtccttgggtggaaagatgatgaacttttagagtcagacagacctgggctggaattctggttctagaactgacttgctgttgacattggagaaaccctataaccttgctaagtctcagttttttccatttcctaaaataggattgtcaatatctctatcatagtgttgtagtaaaggttcaatgagatattgcaaggaaagtgactaccacgtagtaggccctccttaaatgctactttccttcttttctctagttcttcttcagttgtcatatggtcatgtgattacctgtgttgggtgtctgcggaaattgaattccttagtttctggtaatacaacaagcttccacccttcacttcatgatcttctatctgaattcttcttccactgtgtacatttaatcatttccacaacttcagcagcccaagataggagcccatcgttcccagagtcactggttcctgaggtctgggatggtggaagcactgctttggttggtactgccaatggattccaggaatgagctggatgtcagttcatggagaattcccagggaagagcctggagctcagggctgctgagtcatggctgtggcttcacactgctgtcttcactacccgtatcacctccacatggcccccaggctgagctgctgctctcctgtctctgttcagaataccttctgtgcctttttgcttatctagttcaaatccaatgaataccatgctcttgttttgccctcccaacactctgcaaatcacatagggcagagataattattctgaaaaactcaggggcagaaatattaagtgacctgcccaaggtcaccaagaatggggataagaacccaggttttgtgaacacccagtccagtactcctactaccttttcctgatatccttaggagcgggatccatgggaagggacctcagacccctagtgggttagcaaaaccccggaggtgattgctttgatttattattgtaaataaacccagtgattggggaaagaatgtaatgttttccaaaagatacagacattatttgagttcaaagtgcttccagtttccattcagttacacaataaattctgagaaaacaaagtaggtgtttactcagaaataaagagactattcagtctctatttgctcagtgaaatctattttccagagcttcttgcagttctgtgcatgttgtactggaaaggacatgggttatggaatcaaatccacttcgatttgaacctcagtgcaaccatttcctcagctctgtgagcttgggcacttcccttgacttcttagagcctcaggttgctaatccataaaatggagattataacacctttgaagtgaaccctgtacaggttaggagatgcccttcgtattagactatgctatgcgtggtgcccccagagttgtgtctcatggtggccctggttatggtgaagttaagtgaaataacatctagcgtgcttaatgaatttttgtttccatttccttagttggctacatgtctgctatcttacccagaattcctagcctctatcatgaggtgagtcagcttcctgtctcagcagtgctcttcttgcagggcactgcacaaaactgtggtggagataaccctcgatcttctcatgcaggagtccagcatcgcagcccttagagagatacatcagaaatctatggcatcatctataacgagaagtctttttctggccattttgaaggggtgttgggccacttactattttaggaagtttaggtctggtgatgtaaaacagtcagcctgcttttttttattctatttttttttcaagcatgcatggcttcatttaacaaatgttacaaggccctaggaactgagtgatttgcaagatgtggtttctgacttcaagaaactcagagtgcagtcagagaggtagaccaaggcaaccagaaactaatattcagcatagaaaaagtaatgatgggaggacatataaagtgttcatggctcaagaggaagaagggagtggaagagtggaagaggaagagggactgctgtccacgttcaaagcccaaattgagtctgacttttgtcgagaattgcttaacaggctgcagaggtggccaggaggtagaccagggctggaattcaagtcacctcatttcaaatctattgctcagtccatcgctccgcctcatgccacattgggtttttctttacatcatttgtttttccttgtctcactttttttaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcggtatgttctggggttgttctgtgaatggcagtgcttattgggactggctgggcatattgatggtatgggagacaagtggcccaagtgtggctcagcggaccagtggagtgggcccagggcagtgtttttttcagagtcacaagtgacacagagggagttgaacagatggcgctctaggcccccgcatcttttatcaattagaagagcttcattattgtttcctaatatttttagttgatatataataattagatatatttatggggatattttgatacgtgtattcaatgtgtaatgatccaatcagggtaattagaatatctatcaccttgaacatttattgtttctttgtgttgggaacagaatagttttattttcatctgttttaaatattggaattgtgtagaagatttcatttgaaaaagagagttccgctgctaccaataatcaaaagcctacaattgacctttgaaaagacttgaagcatagatctgcacatcatttccaggttctgaaattctgttgtttttcctgattagtggaggactctattggcctcaacaacctgggtaattttcagcttttctctttgaaaagatttaattgggtcagtaattcttaactgggggctatggaccaacttcagagggtcatgaatccctgcaattgcgtgcaaaactgtctgtggattaggtgtgtagaatgtatgtgtatgcgtataagtgtgtccgtgcatttttccaggaagggagtttgtagactgcagtttattctctaagggatctgtgacccaaaaaagtttcagagtcactggtcacaacatattaatttgcttttcttgaaaccctttgtagtgaatcaagatagaaagtctgtctatatttgtaaacctgtgtaacagagagccttatttctcttatgctgaatgtgttttccattatttgaaatgaatcagctaaagaaagcaaagcacaggaagctttgctcctctgtcagcctggaggtactggagcaggtgaggtcatacgtctccttttttatttccttcatttgactgccaggaaaaatggtctgaaacccagcacaggctctcaaagaaaagtaggcccaaactggattctctagagcagaaagaaatggtgagatcacagtttctacctccccaaataggcagctgccccgctggccggccccacctcaacttctgcttttgtatttttggtttttcttggactttgttttcaagaaactaaatgtgattggtttttgttcatccataatggagctaagtttctttcttctccatttttgctgcttatgtagcaaatgtttgggatatcctaggtattagctgatccttcttcttcatgtcaagttaatattgcgtgcctggctgaaattgtactgaagtttgagacagggcctgatagctctgttaattagaactacagctttaattttatgcactccttaaagatttggggtgatttaagtaaacattaatacaaataatatttttctatagattgcagtttcaacttcaaaataaggatttccacagaaggactttgatcctgagatgtaatcaaaattgcatgttagacttcgaatgttctgctgttatggggtatatatcctcttggcattttgtctaacaaatattttaagacattcatatattcttttatttattcatggattcatcaacaatacaaaggggaaagggaagggaaaggccctttgttgaagcccgagttgcaggcagcgtgccaggcccatacacttcctcctgcatctggaatttgttgagtctcttcccaactactggatggatcagattatttcaaatggttttcttttacaaataacattgctgacaaggtttttgtgcagataacttaggtaaccactattgacattcaacagggaaatatcctcagaagtgaggctagaagacacgagtaagagacattttatgacttttttttttttgtccatagcaagattttctatcagagagagtgtaataacatactctgcctccagcagtctcacaaaccagccaatggtgggctcagtcattttcaattatttttgatagtttactcatacatgttaagtatcctagatttgctggaattttcatgtcaaacagtagcataattttaaaacactatcatcaatacaagtgatgcttattatgcatctgctgagttcctaacatgccttgctcttttcatcctcccagaagtcctgtgaggttgataagattattggtctcattttgctggagagctaaatgcggaggctcaagtggtcacacaactggctaatagcagactgaggtttgaaagcagagtgcttgcttcaaagaccccactcttggcacctctgctgttgtgcctcataataattgtagcttcataataaaattcggtgtgattattcttttattatgttaaaaattttcttctattcttgtctattagctgtcctagagagaaagagaagggtattctgagttaaggcaaaggcaagaagcaaaggctgcacggggaaaagtgtgtttgggcatcacaaataatcctgtttggacggcatgtgggtccttgtgggtgaagatgggtgaggaacgaggccagaaaggtagctaggcattagctcttagagaacgttgatagtcacaataaggactttaggtttcattctttaagccatggagagccctaggaggtttttgaacaagggagacttctcacttctctatgagtccctgttttgtactctataatgtctccattattagggactattgccacaaccaggtcagaagtgccaggcctgcccaggctgtggtagcagtgatgaagagaaaggaccttacctgagagggctcatgaagtaagaggcagaacttactatctagctggaaatgatcttgagtgagaggcaggagccaggatgtctagcctgggagcaggctgtatcttaccaaggggagcatgcttccagaggaacgcagattccactttggatgttctgagactgaagtgtgtgtggatttccctgggtagatatctatgctgttgagtacttaattctagagaaggatcagatatcgagatagatttacaagtcatttgtatcaaggtgagataatggttataatccagggaagaagaccaattagaaaatctagaaaaagatttacatttaaaggacaaagaaaagaacagggaaaagtcagaagggtcagagaccggctagaggagaactaggtgtgcaccatacaatggaaggcaaagggggatggagtttgagggatgttggctgttggtatcaaagtctgcagaggtgggacatattcttgggcagaataaggactgagaagacacctgtgaactgagtagcttggagaacatgatcagttatatcaggggtcagcaagcttttcttaaaaggccggatagtaaatagttttggctttgagggccatgatgtctgtcacaactactcaactctgctgttgtactgcagaagtaacaatagatagtagtaaatgaacaggcctggctatgttccaacaaaactttatttacaaaatgagggatgcaccagatttgtccttcaagtcatagtgttttgttttgtttttgacggagtcttgctctgttgcccaggctggagtgcagtggcatgatctcggctcactgcaagctccgcctcccaggttcatgccattctcctgcctcagcctcccgagtagctgggactacaggtgcctgccaccacgcctggctaattttttgtatttttagtagagacagggtttcaccgtgttagccaggatggtctcgatctcctgatctcatgatccgcccacctcggcctcccaaagtgctgggattacaggtgtgagccaccgcgcccggccaagtcatagttttttttttttttaactctgatctatagtatgtctgttttcttcaaccggactcagaatgtaattttccataaatggttgtaggatgtattaggctaacttgaaaatataaaagcgtttggtgataaattgtgataaaatttctttcataataatttctagctatttagagttaactacacctagaggcagtggattttgatgtatttatgaatttactaacttgagctgattctgttgaattttctaagcgtgtgattgtataatctgaatacagtgatgcatttattttttcttctcctaatttgcctctttttctgagctctaattctaagttacagagaggtggtagtttcttttttctgcagcctttccccctcgctaggcttgtttgctgggatctcagtagttgtggatttctcttggtgatttcttagaggcctatttgagtttgaaagttcaactttcaattagcagggaggtttgacaaacaggatttttttctctttaagtacccaagtcagtttaaagttttctttttaaaaatttgatatataataattgtacatatttatggggtacatgtgatattttggtacatgcatacaatgcgcaatgatcagattgggtaattagaatatccatctcctcaaaaaagttttctcctttgattggcttttttcttttcctttcttttttttttttttgagacagagtcttgctctgttgcccaggctggagtgcagtggcgtgatcttggctcactgcaagctccacctcctgggttcacaccattctcctacctcagcctcccgagtagctgggattacaggcgcctgccaccatactcggctaatttttttgtatttttagtagagacgaggtttcactgtgttagccaggatggtctcgatctcctgacctcgtgatctgcccaccttggcctcccaaagtgctgggattacaggtgtgagccaccgtgcccagcctgattggcttttttcttagaatcacgtccaaacttcatacctgggcccccatgtccgtgtatgatctggttcctgccaacctctgtaactgtatctttgatttttcttcccctcactccttgtctacagtcaagtccctgccctcattgtggtcctgacacttgctgcatcctctgactggtggacttctctgaacccttcccaaggctggccatcctttgggtctcagctccaaggcattccctgaatcatcactctatgaaggaaattccctcagtgtctctggcacacagctcagcttgttagtgtcacagtgtttgtcacaatccgaaattatcttatatgtaggttgttgtccgtctttactgtctatgtccgtgcagtagaatgtaatatctctgagggcatggaccttgtctttgttgctcacaggcgtcgtctcccgtgtctaaaactgtgcctggcatagagtaggtgctcaatcagtatttgttgactgaacaaaacaattctcctttcttatggtcaacatcaagcatctgttctaacctaagccttctgtgctggatgttctccagtggcacctccaaatcccactctcacccttttccatctggctctgtccctgagaaattgaatttttttttttttttttttttttttttttttgagaatgagtcttgttctgttgcccaggctggagtgcagtggcacaatctcggctcacgctaacccccgcctcctgggttcaagcgattctcctgcctcagcctccagagtagctaggattacaggtgcgtgccaccacgcccagctaatttttgtatatttagtagagatggggtttcaccatgttggtcaggctgatgtcgaactcctgacttcaggtgatccacccgcctcggcctcccaaagtactgggattacaggcgtgagctactgcgcccagctgagaaattaaaattttgaactgcgttaattggcatttctcactctctggattttctctgggactggccaggagaagcagtggcattaaagctgagaagaagactaaggtcagggcacctattccgccatgtttcgccttgcagagtaaactcaagctgtatctttctcttgactgaaggtctcagatcctgccaggaggccgtcccagtcttggtcctgctctgtcccttttcccttcagttctatgagatccaagggaaggggcagaaccaggttgggatattgactccctcaggctccttcttgcccggaggttggcaatagctgtgttcctctcctaaaggcaacagctcccgacaggtgtccctcctcagctcagggtctccgctcatcaggccacagtagacctggggtggtaatgacaccctgcagtcatcaaccctggggctttagcctattccgtgttgatttctttaaactctaccccaacttggtaagtagtccttttatgaatctctcaattactccattggagcttctcatctcttttctactgggattctcaccaataatttattcatctgtgaaatggaaaagttgactaactgaagtttctgatggatctgtgtttctcatgcaattactactaatccctttcgaaccagtgactgattctgacaaaatgtgttgtaattctgagttgtgtaaagatatacctcctgccctatgtgcacttcagtgtacctgccctgtaagatgataacagtttggactgtgcccttctcagataattttcaaaccattttgatgaaattttgccctaggattgaggatagggttgtgttgttttcatgaatgatgtttctgtgttcctgaggtttagtacatacattggaactgaaataaagagagaggctttcatccttaattctgtggatatcctctttctaaatcatcttgtgttcagtcaaatgccctcacttccccaaatcctgtgtggataaagaatgatccaaaacaaacctgaataggacaatagaggattcagctgacccccagatcccgtgtagatttcagtggtgagccccaaacttgcttgaccgagtaagattgaaagaagttctcataggatcacaggatttggatggctccttaaagtcttcagttccctccttcatcagataggtcaacgtggggtagagaaacttttccaagtcttccaaacactgcttaaacagttgcaaagacaaggagctagcccaggaagcttttaggtttttcaagatggcctgtttgattttgactggatttagtacattgtttctgacaatggcttacaaagaaagagagagagagagagagagagagagagggagggagggaaggaaggagggagggaaggaaggaaggaaaagaaggaaggaaggaaggaaaagagagagaggaaggaagttagtttagctctctgacctcctcttccatttctgccacaccagttctgtgactcttccctgggcctcaggttcctaaatggaacgcctgggggttgtcttggatgccatagttaaatcctgtccatttgctgagcactgcatgcttttcaaagtgcaatggggtcctttgcacttgtgggatacactgaacatatggtagtgttttcatttttctgacagagatagaaatataatctactggtgataccaagagaatatctggtttgctgctttgataactggagtagctactccactgtaagtagcacactggctttgttcacttttctgtgtgcccaggcacaagcgaatgtctttgaatgggtttcaggaatgccacagtatggcccccttcagcccttacagtggctggcagacaggtggtcatctctgcctaggagctttacctgagcaccacacaaatactgccatttcgccctgtggatcatgatggggtaaagatggggaagcattattcccttgccccctcccccgcctctcgtctttctctttttctgcatattgccagtgctcatcacctcttttctgtttctttgtggtttatagatgatcatgacgcagtcctgaggtttaatggggcacccacagccaacttccaacaagatgtgggcacaaaaactaccattcgcctgatgaactctcaggtaaaatttcttctgtgcagctatggagtaagagaaggaccacagtgtgggctctaatgtggaatgtatctactgggagcatatctaggctgccaattaagtctcttgatcttcctgagttcctgattcctcactggagaagaagacaatgattccatgacccaacctgatgatgtgtttatttaaagaaaaaccctttagtattagtgtctgctaatggaggtgtctggtacccaggaaagtagagttgagctgtccttgctgctgcaaggtcatacctggaggtttacatgagggacagcagagcgcagaacatccaggggagagtggggagtgttgtgaaaagtgaatgaaacaatacacaggagagcactttatgaaccgtaaaatgctatacaactactataagacagtgtcaccatgtaattatgtgtaatatggcactagaattcatgtactatttcataaattcccctggataattaggttcccggagtattttcaggtagcacatgccgatttctcaatactaagggagacttgagaaatattcttgccacagggttctgttagtatattttattagtgggaaaaactgtattacacatatatatgaaaatatcaaaaattgcacaatagggctgcaacctgcccatctcacaaccaccaacatttgcctttttctgaataaacatatgtgctctgggggtttttatgtcagtatttagtctgcatacttccctaggagtcctgggcatggggtggatcctggaacagatcagaaatgccttttcagcagtgtctgtggaatgtgtgtttctttccttctctactagggctccacttccctatatctgtctcttcacttccttactttcaggaactcaccagctaggcagaagctgcttcctgcatagcccactttctatttgaagcccacaaccttaagaaacttttttttaaaattatactttaagttctagggtacatgtgcacaatgtgcagatttgttacatagatatacatgtgccatgttggtttgctgcacccatcaactcgtcatttacattaggtatttctcctaatgctatccctccccttgcccccaaccccacaacaggccccagggtgtgatgttccctgccctgtatccaagtgttctcattgttcaactcccacctgtgagtgagaacatgcggtgtttggttttctgtccttgtgatagtttgctcagcatgatggtttccagcttcatccatgtccccacaaaggacatgaactcatccttttttatggctgcatagtattccatggtgtatacatgccacattttcttaatccagtctatcattgatggacctttgggttggttccaagtctttgctattgtgaatactgccacaataagcatacgtgtgcatgtgtctttatagcagcatgatttataatcctttgggtatatacccagtaatgggatggctgagtcaaatggtatttctagttctagatccttgaggaattgccatactgtcttccacaatggttgaactagtttacactcccacccacagtgtaaaagcattcctgtttctccacatcctctccagcatctgttgtttcctgactttttaatgatcgccattctaactggtgtgagatggtatctcattatggttttgatttgcatttctctgatgaccagtgatgatgagcattttttcatgtgcctgttggctgcataaatgtcttcttttgagaagtgtttgtttatatcttttgcccactttttgatggggttgtttgtttttttcttgtaaatttgtttacattctttgtggattctggatattagccctttgtcagatggataggttacaaaaattttctcccattctttaggttggctgttcactctgatggtcgtttcttttgctgtgcagaagctctttagtttaattagatcccatttgtctattttggcttttgttgccattgcttttggtgttttagtcatgaagtccttgcccatgcctatgtcctgaatggtattgtttaggttttcttccagggtttttatggttttaggtctaacatttaagtctttaatccaccttgaattaatttttgtgtaaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgaggcctctgttctgttctattcgtctatatatctgttttggtaccagtaccatgctgtttcggttactgtagccttatagtatagtttgaagtcaagtagcatgatgcctccagctttgttcttttggattaggattgtcttggcaatgcaggctcttttttggttgcatatgaactttaaagtagttttttccaattctgtgaagaatgtcattggtagcttgatggggatggcattgaatctataaattaccttgggcagtatggccctttccacagtattgattcttcctaaccatgagcatggaatgttcttccatttgtttgtgtcctcttttattttgttgagcagtggtttgtagttcttgttgaagaggaccttcacatcccttgtaagttggatgcctaggtattttattctctttgtagcaattgtgaatgagagttcactcatgatttggctctctgtttgtctgttattggtgtataggaatgcttgtgatgtttgcacattgattttgtatcctgagactttgctgaagttgcttatcagcttgaggagattttgagctgagatgatgggtttttctaaatatacaatcatgtcatctgcaaacagggacagttcgacttcctcttttcctaattgaataccctttatttctttctcttgcctgattgccctggccagaacttccaacactatgttgaataggagtggtaagagagggcatccctgtcttgtgctagttttcaaagggaatgcttcagtttttgcccattcagtatgatattggctgtgggtttgtcataaatagcttttattattttgagatacattccatcaatacctagttcattgagagtttttagcatgaagggctgttgtattttgttgaaggtcttttctgcatctattgagataatcatgtggtttttgtcattgttctgtttatgtgatggattatgtttactgatttgcatatgttgaaccagccttgcattccagggatgaagctgacttaatcgtggtggataagctttttgatgcactgctggatttggtttgccagtattttattgaggatttttgcatcgatgttcatcagggatattggcctaaaattctctttttttgttttgtctctgctagactttggtatcaggatgatacttgcctcataaaatgaattagggaggataccctctttttgtattgattggaatagtttcagaaggattgatacaaagaggtttgtacctctgctagaatttggctgtgaatccgtctggtcctggactttttttggttggttaggctattagttattgcctcaatttcagagcctgttattggtctattcagagattcaacttcttcctggtttagtcttgggagggtgtatgtgtccaggaatttatccatttcttctagattttctagtttatttgcatagaggtgtttatagtattctctgatggtagtttgtatttctgtgggatcagtggtgatatcccaatttatcgttttttattgcgtctatttgattcttctctcttttcttctttattagtcttgctagcggtttatcaattttgttgatcttttcaaaaaaaaaaacagctcctggattcattgatttttttgaagagttttttgtgtctctatctccttcagttctgctctgatcttagttatttcttgccttctgctagcttttgaatttgtttactcttgcttctctagttcttttaattgtgatgttagggtgttgattttagatcttttctgctttctcttgtgggcatttagtgctataaatttccctctacacatggctttaaatgtgtcccagacattctggtatgttgtgtctttgttctcgttggtttcaaagaacatctttatttctgccttcatttcgttatgtccccagtagtcattcaggagcaggttgttcagtttccatgtagttgtgcagttttgagtgagtttcttaatcccgagttctaatttgattgcactgtggtctgagagacagtttgttatgatttctcttcttttatgtttgctgaggagtgctttacttccaactatgtggtcagttttacaataagtgcgatgtggtgctgagacaaatgtatattctgttgatttggggtggagagttctgtagatgtctattaggtctgcttggtgcagagctgagttcaagtcctggatatccttgttaagtttctgtctcgttgatccgtctaatattgacagtggggtgttgaagtctcctattattattgtgtgggagtctaagtctctttgtaggtctctgaggacttgctttatgaatctggatgctcctgtattgggtgcatatttatttaggatagttagctcttcttgttcaatcgatccctttaccattatgtaatggccttctttatctcttttgatctttgttggtttaaagtctgttttatcagagactaggattgcaacccctgctttttttttttttgctttccatttgcttggtagatcttcctccatccctttattttgagcctatgtgtgtctctgcatgtgagatgggtctcctgaatacagcacactgatgggtcttgactctatccaatttgccagcctgtatctttcaactggggcatttagcccatttacatttaaggttaatattatgtgtgcatttgatcctgtcattatgatgttagctggctattttgcccattagctgatgtagtttattcctagcattgatggtttttacaatgtagcatgtttttgcagtggctggtaccagttattcctttccatgtttagtgcttccttcaggagctcttgtaaggcaggcctggtggtgacaaaatctctcagcatttgcttgtctgtaaaggattttatttctccttcacatatgaaggttagtttggctggatatgaaattctgggttgaaaattcttttctttaagaaagttgaatcttggcccctactctcttctggcttgtagagtttctgctgagagatctgctgttagtctgatgggcttccctttgtgggtaacctgatgtttctctctggctgcccttaatattttttccttcatttcaaccttggtgaatctgacaattatgtgtcttggggttgctcttctcgaggagtatctttgtggtgttctctgtatttcctgaatttgaatgttggcctgccttactaggttggggaagttctcctgggtaatatcctgaagagtgttttccaacttggatccattttccctgtcactttcaggtacaccaatgaaacgtagatttggtcttttcacatagtcccatatttcttggaggctttgtttgtttctttttactcttttttctctaaacttctctttttgttttatttcattgatttgatcttcaatcactgataccctttcttccacttgatcgcattggctattgaagcttgtgcatgcatctcgtagttcttaagccatggttttcagctccatcaggtcatttaaggtcttctctatactgtttattctagttagccattcatctaatcttttttcaaggtatttagcttccttgccatgggtttgaacatcctcctttagcttggagaagtttgttattactgaccttctgaagcctacttctgtcagctcgtgaaagtcattctccgtccagctttgttctgttgctggcgaggagctgcgatcctttggaggcaaagaggcactctggtttttagaattttcagcttttctgctctggtttctccccatctttgtagttttatctacctttggtttttgatgatggttttggtgtggatgtcctttctggtgatgttgatgctattcctttctgtttgttagttttccttctaacagtcaggtccctcagctgcaggtctgttggagtttgctggaggtccactccagaccctgtttgcctgggtatcaccagcagaggctgcagaacagcaaatattgctgcctcattcttcctctggaagctttgtcccagtggggcaactgcctgtatgaggtgtcagtcggcccctactgggaggtgcctcccagttaggctacacggggctcagggacccacttgaagaggcaatctgtccgttctccgagttcaaacaccgtgctgggagaaccactgctctcttcagagctgtcagacagggacgtttaagtctgcagaagtttctgctgccttttattcagctatgccctgcccccagaggtggagtctacagaggcagcaggcctggctcacctgcagtgggctccacctacttcgagcttccagggctgctttgtttacctactcaagcctcagcaatggcagacgcccctcccccaccaggctgctgtcttgcaggtcgatctcagactgctgcactagcagtgagcaaggctccgtggtcctgggacctgctgagccaggcacaggatataatctcctggtgtgccattttttaagacagttggaaaagcgcagtatttgggcgggagtgtcccattttttcaggtaccgtctgtcacgacttcccttggctaggaaagggaagtcccctgaccccttgcgcttcctgggtgaggtgatgccccaccctgctttggctcgtcctccatgggttgcacccactgtccaaccagtcccaatgatatgaaccaggtacgtcagttggaaaagcagaaatcacccgtcttgtttgtcgatcgcgctgggagctgcagaccagagctgttcctatttgaccatcataagaatatttttataacgggatagaaattgaggaacttaacttatttgtaagtggtcaccatcttgtttttttgttcttcctctaataccttttaatttttttttaagaaaatcactttctatcaccgtcacatcttctagtcacctctaggtgcttccaatgcctgtttgttgttcaaatttatattttggcttttggtattacttttattattattattattattattatttgagatggagtttcgctctgtcacccaggctggagtgcagtggtgtgatcttggcttactgcaacctccttttcctgggttcaagcgatcctcttgcctcagcctcctgagtagctgggattacaggcatgcaccaccatacccagctaatttttgtatctttagtagagatggggtttcaccatgttggcccaactggtcttgaactcctgacctcaagtaaccacccaccttggcctcctgaagtgttagtattacaggcgtgagccatcgtgcctggcctacttttattgttactagaagagataggattgaaaggaatggactggctagcaagaagctctctggggcaaatgacagttgagctagactttgaaagatgggcaggacttggggaaatagcaatagccgggcactccagaaagtggaattggcaagacagaggagaacaggaaatgagggaggcgttacaccactccaagagtagtgtaatgatcactcccctattagtgatcaggctggagtgcagtggcgtgatcataggaaatgagggagacattcagatacccctggctaagttggaggtggaggtgtagaagaattggctggccttgccccgtagagagagatgaggctggaccttcatggctgcttgtgctctggcaagtgtggaaattcagacagagggttaggaccagctttgtccctttcccttctcatgcctagtcaggaaccctggagctggagagcactttagggagcactaaaacctcatctccacttctatataagatgctacctaaatatccaggagagatgttcatttactcttaattaattcattcattcaacaaatgtattcagtattgagtagactgtggcagtcagtacataaactctatagttagcctgcttggggttgaaatccagctctgtctcttactagctgaaggatcatcaagttacttctctctaaaaaagggagaataattcccttacagggttgttgtgaggtgtaaataagaaaaatctgtgcaaagcacttagaacaatacctggcacatgtatcaataaacgttaactgcacttactattgatatttgcagacattggtaggggagggtacaattgtgagcaaaacaggctcagcctctgttcttatgatgcaatcaaatagttttacaaataaataaatttgcaaaaaagaactagagaagagagtggtcaaggtactaggagagccctgaaaggggagatttgagctattcaaggaggtcagaatccctaagtaggtggtacttggctgtgtagaaggaatgtgtggatgttgaaaagggtgggataagagcttttcaggaagaggcaacagcatgggtacagttttgtgtggaaggaaatgggggactggaaggactcaggaagaggtgagtatatgtgggactatgtggtgagagacaaggctgaaagcaagaaggagtcaagccatggtgctgcaccgaggcatcttcttttttcagtgggggtaggggggttggcctgtcacccgggctggagtgcagtggcgcgatctcagctcactgcaaacaccacctcctgggttcaagcgattcccctgcctcagcctcccgagtagctgggattacaggcgcccacaaccatgcccgactaatttttgtatttttagcagagacgaggtttcactgtgttggccaggttagtctcaaactcctgacctcaggtgatccacctgcctcagcctcccaaagtgctgggattacaggcgtgagccacctcacccagcagggtgagacatcttctttatggcatgatcagatttgcattttgtaaccatcactggctttcatctgagcagaggggctgcagtagatgaagacacatagttaggaaggtcttacaagtagtctgggttagatacgctgatagcttgcacaagagtaggggtgaaggtgaatgtgagaaaagaatgtatttaagggctgcttgcgatttgcagtcaacaggttttaatgtcgcattagatgtgagaagtaaagggagaggggccaaaggtgcagctcagtttctttcttgtgtaacttggcagctagaagttgaaattagaagtcagccccttatccatggtttcactctctgcagtttcatttatttgtggtcagctgcaggctggaaatactaaatgaaaaattccagaaataagcaattcagaagttttaaatgacacgttgttctgagtagtgggatgaaatcttacacatcttactttgtcccttcctcatcacaggaagaaggatgggtacagtacaataaaatattgaataaataagcaaattcaataaagtagcaggatccgaagtcaacacacaaaaaatattcattttttctattatgtgcaataacaatgaatgatctagaaaggaaatttaaaaaacaattccatttacaatagaatagcataaaaaagcataaaatacttaggaatgaatttaaccaaggagttgaaagacttatacaatgaaaactacaaaatagttctgaaagaaattaaaggagacacaaaaacctggaagacatcccatgttcacagattgaaaaaagtattgttaagatgtcaataataccgaatatgatatgcagatttaatgcaatcgttgtgaaaatccaaaagatatttctttttttgcagaaatagaaaaagctatcctaaaatttatatgaaacctcaagggaccccgattaaccaaacaatcctgaaaaataagaataaagctggagttctctcacttcttgatttcaaaaaatacatatgttacaataatcgagagagtgaggtacaaagacaaacatataaaccattggaatagaataaaagtccagaaataaagtcttgtatatatgtgtaaatgatttttgatgagtgtgtcaggatcgttcaatgaggaaaagacagtctttttaagaaatgatactgggaaaactggctatccacatgcaaaagaataaagttggacccttacctaacaccaaaaataaaaattaactcaaaatggatctatgacctaaatgtagaccaaaaactataaaactcttagaagacaacatagggcaaaaactttatgacatcagatttggcaatgatttcgtcattattacaccaaaggcatacatacgtaacaaaggaaaaaatatacaagttggactttatgaaaattaaaaataattgtatatcaaaagatactctcaacagagtaaaaagacaccacacataataggagaaaatatttgcaagtcatctatctgataagggattaatgtacagaatatatagaacactcttcaaacaacaataaaaaaaatcaaattacccaatttaaaaataggcaaaggacttgaatggacgtttctccaagatatacaaatggttagtaagcacatgaaaagagactcaactcttttttgctagggaaatgcaacccaagaatacaacacagcaccacctcacccccattagggtggcttctatgatcagaaatcggaatccgtgggcactgttgatgggaatggaaaatggtcagccactgtggaaaacagtacggcagtgcctcaaaaacttaaaaatggaattaccgtgtaatctaataatcttatttattggcgtatatgtacagaaattgaaagaagggtcttgaagagatattcatacccccatattcagactactcttattcacaatagctggactgcagaaggaacccaagtgtctgttgatgttgaatggatacacaaaagctggtttatacatacaataaaatattattctaaaaaaggaagaaaataccgagattggctacaacatggatgaaccctgaagacattatgccaagtgaaataagccagtcacacacacacacacacacacacacacacacacacacacacaaaatactatatgaatgtggttgccagggaatgtgaggtgggagggggaatggggagttactgtttaatgagtatagagtttcaattttgcaagactgaaaaagttttggagatggtttgtggtgatagttgcacaacaatacaaatgtacttaatatcactgaactgtacacttaaaaatggttaagatagtcaatgttatgttatatgtattttaatacaatttttaaattggaaaaaatgtcagtaggggagacagtcacagaagtacaaacactgtatgattccactttatatggaacacctggagtagaaacaaagtagaatgatgtttgccaagggctaggaggagaaaggaatgtggaattgttgtttaatgaatactgtgattcattttgggaagctgaaaaagttctggagatggtggtgatagttacacaacaataggaatgtactaagctgaatacttaaagttgctaaaatggtcaattttatgttatgtatattttaaaagctttcttttaaatcaacagggagaaaccagttgatagagggagaaagtgaatatactaaaaagaggagaaaatgattagttacccacaacatgatggtggtggagccaaagcgtagtggaggatgaaccccagcaggcgggagtcagagggaagaaggtgcgagtggtgtagctggaggcagtcagtattagaaggatgagagggcttctattttctctgcaaagtggcatgcaaggccaagtcagaaggaggctgagggggaaagaggttttagtagagaaggtttgaacaaagagatttataattgtcattgaggtgagtgggaccgtcagtaaacctgatgaatggagtaggatttccaggccatgctgggctactttgaggttgaagagaatgaatttagagagaaaccaatctctgtttgatacatggatggtaggatctggaggtgagcaggcagcagcaaagaggagaggggagaggggaggagccctccctgagcactctcttggactgcggaggctacctactctctgagcacttcttcgtgatgattcagtcttcctcactgtgaagaacgaaaccccagtcctgcaaagatttgaaactgtatttaaggccaaagtaaggttgcctgggaattaagagtactggagtcaggcaggctttgatcagatccctcccccaacacttcctgtgtgagtgacttcagcaagttgctttactttacctttctgagcctcatttcccttacttgtaacacagaaatatgaatagttactatccagggtttttttttaggatcaaaggagttactatgtgtggagcatgtcacccagaggctggtatgcagcaagtgctttgtaaatagtagcgatgggcactactgaaacctgaatgtctgcctctgcctgtttgcgaatgactccaccttcccaaatcccaacagggaaggtgagtcagcttgagaccacttgagaggcatctagcagaagggaggcaaaacttctgttaaaggataatttttagggaaaaaaaggtaagatgatgactctcatacagatattaaaaatgaattcatcatgaagattttattttactcgtatgatggaaccaggcagatattacaactggttcaaaggaaaagtcaaagcaacacaaatttggagtaaaggagttgaactagtttttctgtgagataaggcagggggaggggagaaatcaattgaaactctcctgggcagcatcctgcccagtaggcacatgtattagttgcctacaattcacaaagggttgcgaaatagctcccgtggaatcagaatctgacagggaggaagagtgtgctcagaaaatgcatggctttctactgaagcagatttttttcccattacacttctagatctctgtgcaccattgtgccagggctgcgaggaaggtggcccacttcccgggatacactacccaccctcaagagagcctttcctgctgcttcttaggcaagtcagctctcttttctcacctcctgtaagcaacactaagtatctggctgttcctttcgtactcgagtcctggccgctccatgacagcacttgtggtggtactgaactgtgatggacactttctatcattgccctttcttaccttgatatcctaaaaagctggtggtctgtcttctctatcttttgtcctggtcagttatcctaactattttgtgtctgtttctgtggattagtaaacggggtccccacccccactccacaaggagaacatctggcacccagaagtcactgagagaatagctgttgctttggtagaattctgcctctgagtggcttgttcttttcccagacggagaggtctcctgacagcagctctcttctttttcttttttttttttttgagacagagttttgctcttgcgctcaggctggagtgcagtggtgcactctcggctccctgctctgcctcctgggttcaagtgattcccctgcctcggtctcccaagtagctgagattacaggcatgcaccaccatgcccagctaattttttgtatttttagtagagacagggttttgccatgtttgccaggctagtctcaaactcctgacctcaggtgatccatctgcctcagcctcccaaagtgctgggattacaggcatgagccactgcgcctggctttagcagctctcttctaaagccatctggacccacatttgttcagctcccctcccttggccatgatgaaggcatgcaaaacaaaaaaggcacttttcttattgagaaggtggctttttatagagaatggtgtcatactgttaggtttcaggccagcagacctagtcaggcatgtgacacttctgtgccaggtgtggctatgagagtcaacaggaaaaatgatatatgtaaatggacaggtctttaaataaatgcagttttgactataagagtaagaaggtttctgtgagactcaactcagtacctcctgtaccctgtgggcctgagagaggagacaatgggacaagaagacccagtggcttccttggaagcttttgtgctagctggagagagaagacctacttcctatatgcctagcaacagtccacactgactggactgcaaccaggacatttccagattactcagtggggcttatcttgaaataatagttgatgccatttgttaaatatattatatataccatctaagggtcttacatgccttctctcatttgatcttcatggcaaaccctgtgaggtatgaccaccaaccaccattttacctcagaactcaggctcccagagtttaagttgctcacaggagcccagaaagtaagcgacagaggtgggatttggttctaggtgtttgccaccagcactttaaatcaccaaagctttctggaagctccaacttttcttctcaagatactgaaagacaggtatctggatgggttggcagggcgggtgggaggtgggcgagatttccatcaacaacgggtctaaaaccagcgatggtgagctgggtgattttgatggaacccctgccatacagtctattaatatcataattggagctaaaatttaatcatgatggcaatcatgagttctggggcttcttgatttgggccagcagacacagtctcagtcactagttctccgaatcagagaaaggatgccttcaggctgtgtcttcacatggcttttcctctgtgcgtggtggaaagagagagctctgcgggtctcttcttgttgtaaggacactggccccattggattagggccccaccacatgacacatttaatcctaattacctccctcacagccctatttccaaacagggtattagtcacattagggattagggcttcaacataggaattctgggggcacacaattcagtctataacagagggaaaacagatttgagaagaaaaaagtccaaaatatgcacagtggtaatatctgaagatgtgcgtgcgtgcgtgtgtgtgtgtgtgtgtgtgtgtgtgtgtttctattcttgcattttctaactgtccccagtgagtatttgttactttctaactgagaaggttactttaaacagtgtcttgagcagcagcactccatgccctggtgtagccttttcctggcagatgttccccagggctctgctgctctgccaatgacttattctcagcatgaactcctcccctgccccctaagaggatctccaaacccaggtcacactccccctgcaggtaagtacaggcgtttgagaacagctttattcttccaggaacagctggtcccctcagcagggccttacaaggtggttatgtctaaataaggcacctgaggccaggagatgtgacatggtccatctaataccatggagtgagttagacacagagcaggactggaacccatgcttccaattccccatccagttttaaggcaatcttcttttctttctttctttctttttttttttttttttttttttttttgagacagagtctctgtcacccaggctggagtgcagtggtgcgatcttggctcactgcaacctctgcctccggggttcaagcgattctcctgcctcagccttctgagtagctgagatttcaggtgcccgccaccacgcctggctaatttttgtatttttagtagagacgaggttttactatgttggccagggtgatctcgaactcctgacctcaagtgatctgcccacctcagcttcccaaagtgctgggattacaggtgtgagccactgcacctggcaaggcaacctttttttttttttttttttttggtagaaaatctttgaacttcatatagatggtgttaatgtgggtgagttcagagccatgtgtaaagttccaggaggggagtgcttgctggcttctcccttatccctcaaccagatcccagccccagccactttctgtttctcttctctggataaaactatcattcatcttcacctgtttctattttcatggattactgtctcattcatctcaagtagctcaagtgaatggctgtttttccattggatacaggaagactgagggtgacctgaccctcatggtgtgcttgcttatttgaatgtctgatggttttatgggtgtagtcctgctggagcagaaagaatatctgttaggagcctgcctctgggctctggttctaactgtgccacaaactcatcgtagccttagacaattctcttgtctctctgggcctcagtttacccatctggaaaatgatgggtctgaatttaataccttgagtatcatccagctgtgacatactacaactcaggcaagaagcaaattctcctgacactccatactcctatccagtgttctctgacgtccttccccaagagctgtggtaccctaccctgcccacattatgtgaggcattatagcacataggttagaagtgtggtctctgggccgggtgtggtggctcatgcctgtaatcccaacactttgggaggccgaggcaggtggatcacgaggtcaggagatcaagaccatcctggctaacacagtgaaaccccatctctactaaaaatacaaaaaattagctgggtgtggtggcacatgtctgtcgtaccagctacttgggaggctgaggcaggagaatcacttgaacctgggtggcggaggttgcagtgagccaagatcgtgccactgcactccagcctgggcaacagagcgagactccatctcaaaaaaaaaaaaaaaaaagaagtgtggtctctggagctagacctaagaatccaattcagactctcttacttactgactgtgtaatttggacaagttacttagcatttagcatctctatttctttaatcataaaatgaacatattaacacttacttcctagggctgttgtgaagataaactgagttgaggtatgacagtacctagcatgtagtaagcatcattaaatggtgtctgttgttttcacatattgtaaagaagaaagcttcgtgcatctcttggaatttctgaggacggtgaagccacagctgggaaagtctcagggagccaggagttgctggcctcctgctttgcatactcaaaattgctggaaaggggctatagcagggggagacattttttaaaaatcccagttattgctattcctcatgagtatgtatatatcacctggcatcagtactctgcatagaaagaagcatagctaaagaaaagacactttgcttttaatataacagctgttttcaggggaatagggtggatgaggatagggagtactggccctctgtcctcaggcctccctgtcaccagctcagtcacgtctatcttacaaatccccatctagcaggaagcctgctctgcccttggactatagacctgaagggctgttgttaagttacaacgttcccagtggaaggaggacagtacttaaaagttacaagatgtgggttctgttcttagttcttatggcctgtcagccagggaactcctggccagtagtctcatccttgaacttcttctttttttttttttttctcaagacggagtctcgctctgtcgccaggctagagtgcagtggcacgatcttggctcactgcaacctctgcctcctgagttcaagctattcgcctgcctcagccttccaagtagctgggattacaggtgcttgccaccacgcctggctaatttttgtatttttggtagagacagggtttcgccatgttggccaggctggtcttgaactcctgacctcaagtgagcccagccctcatccttgaacttcaaatttccaccccaccttactcccacaggcatataccagttgttcctttttctctgttcttatgcaggaaatggcctgaggtccaggagtccccttggtcccctttttccctcactctcaacattcaattagtcttcacatctacagccgacaattgtaacttcttttctttactccattatttcttaggtgacaacaggagcttctttgtggtcttcttttttctaaaaacactaattcagaactctagcatgtttagatcttccttacttaaaaccctttcctggtccccataacctactgaagaaatcctaagctccctggcttggcctctgtctacatttctctgatctcttccagctctttctctgtatcctagccatactgaactacttgcaattcccaaacagggtacacactgtactagttgttcctgcaagagacaggaacacacatccccccacactagcttaacaaaacaaaaaatgcatttctctctcatgcaaaagaagtccaaaagtagacattccaaacttaatatggtgttccagtgtcagaatccaagttctttctactttgtgggtttgccgttctcagcatatgacttccactttatggtccaaaatgactgctcaagctccagccatcacatccacatttcagccaggaggaagaaggaacaaggaaaggcataaccttgcctctaaggatagttcctggaagccacacttgcttacattccattggccagaattagtcacccagccatatttatctataagagaggctatgaaatttttttatttcagggagtctattttaggttgccatgtgcaaaagtaaaaaccagaggtgttggtggtcaaggaagaaatagcgaatggatgctgggtaacatctggcagtctctgccacacactcacacattcaggggtttgcacgtggttccccgtgtctcagacaccccctctctcatgcttacagtctctgcttggcatcttcttttttgccccctaacacttgctcttttttttttttttttttttcgagatggagtctcactgttgccaggctggagtgcagtggtgcaatcttggctcacggcaacctccgcctcctgggttcaagtgattctcctgcctcagcctcccgagtagctgggactacaggcacccgccaccatgcccggctaatgtttgtattttcagtagagacggggtttcaccatgttggccaggatggtctcaatctcttgaccttgtgatccacccgcctcggcctcccaaagtgctgggattacaggtgtgagccaccgcacccggcccaacactcgctcactttatggccatcctcatactacctctgttgttgcaccatcacagcgtgttaaccattgttcaattgtccacctttcccactaccctgtgacctcctggagggcagggactgtgtctttcctttggctccttagcacccagtatagctgcacaatctccagccaaggtagaccgaccaccaatatttcttgtctcaaagatatattgaggaaatgagagtatattcttcaggcttccaggaacttccttacatctgtaggaaggtatgggcatggggatagctcagtgattgtagaggctcgtggcagattgcttgctattctttgggttgcacacaggccgtctctcttgccatagttttttccagatactgcagtgacattgattaggtctcagccttggcgatgtagactgaggtggagagggattattgtcatgattcttgctttcgtttcagtcagttcttgatttgatttctgccatttattcctctcaatttttacctgggcaacatcatctcccgcctgctttttaaggtgaatgttgacagctgatttcatatattaattctggctttcttaagagggacatggctcccttcattcttaagcctttggggctacttttctttctcattcactcatgatctccatttgatccgcaagacagctcatatttgagagagcagagcaaatgtgttattcccatttcaccgatcagaaaatgagggccggccgggcgcggtggctcatgcctgtaatcccagcactttgggaggctgaggtgggcggatcacgaggtcaggagatcgagaccatcctggctaacaaggtgaaaccccgtctctactaaaaatacaaaaaaacccccaaaaaattagccgggcgtggtggcgggcgtctgtagtcccaactgcttggaggctgaggcaggagaatggcgtgaacccgggaggcggagcctgcagtgagccgagatcacgccactgcactccagcctgggcgacacaggctgtgtcgcctttttttgagactccgcctcaaaaaaaaaaaaaaaaaaagaaaaagaaaatgagggcctagtaagattactcttatttgctcaagatcataggaaagttagtggcaaagccaagagttgatcctggatccttttgtatccaagaccagtatcttttgcaaatacttttctttattttgataaataattaacatttacatgcattattttcccccagaatttgaattttttcttaggatagattcctaaacatggaagtattgagtcaaagagtataaatgtgctttaaaaaaaatgctcttaatacattttgcagaattcttcaagcaaggttgtcacactcatgtttaaggcaggtataactacccatgtgcaggccagcccaggagccagtgtggtggggagaggccataaccagccattgctggttccctcagccagcagaggcacacatgagcttctcaccagcccggtgagggtctcctgttgggaggtgtgcatttttgcatgcactctggcctctgcacacaaactgaatatttcatctggtgctcaaccacaagcacagccatctgttccgtgttggaacagatgtgttggactgtgttggctgtgttggactgtgttggctgtgttggacttcgtgagagagcctatgtcagtctccatcaggatgtgtatgtagtgtactggactctctaggtgattgaaaggattccagagataattttgattatatgagtccctgacttcagactccactcttgtgaccaccacacaagctgtgactccaggaggctgggatgccgtgctattttcactgtacccttgcccccgtaatctcaaagcctgactggatggaaccctttctattctatggctagtggcttgtgataaatgtcctttcaggtcaacacagtgcaggctggtatctttacctttctttcaccgaagttaagtgctgcaccagaacttagaagcctcatggggctctggggcctcaggctgtaccttgtgctatgtcagctattacttcatgtcaaacatttgcatatgaatgttcaagcgacagcttatctctttcttcctgcagttggttaccacagagaagcgcttcctcaaagacagtttgtacaatgaaggaatcctaattgtatgggacccatctgtataccactcagatatcccaaaggtaagtgggtgtccgtgggaaataggggttgagtttcctgtctgtctacagattttcctgatttcctaggtttttaaagtcatggctgacattggctattcctaaaggctgggtatttgagttttagggtaccccatttcatctggactagcagattcagaagtattcctgtcctataccagctactctctttgccgtgccagcactgccaggtattgtctcccagttatagtatttactgggatagtggctggagttcccagcatctggggtagattgttcattaatgcaattattcgtgatgagcatcagcagaactcgagagtagttgccgttactcctgtaaataatattagcacacttttatttcacacttccaatatccagaattcttcccatttcactctcataacaatttaaggagatagatggaagtgtggttgttcccattttacagatggggaaattgaaatgtggagaatgaaagtcccccattccaggacttgatttactaagcagaaggcgcagatctgcaacagcagctctttccggggaaggagacatgagtggcaggcctgctggattctaacctctctggaatagtcctctcactgttaatgcatgtcagttgacctctccctgatgcaggctgctgtggcctcaggagcatggcctgagaagggcagagagcactaatcttgggacacttaactcttaagttggatctaccaatgcctgacaggctctggcgacccctggcaccctcactatctgactttcaacagttttgcactgatctcacttagaactcaaatttgcctaggtcaggacaaggactctgaacccatagatgtcctatgctctagttttctcccctttaaaaatgagagatggggccagatggtacgtggggctcttttcagctctgagagtgttcccggactctgatcctgaagcctgaagctgatcttgggtcgccaagctcaactctcccccaaagcacaggctataggctaggccccaccctgctatccagtgaaacctgcggctggaagagaaacctgtagtctgctgcaagaaaagggctgtgcctcaggagcaacacttgttgatcctttcccctccccatgtccactgatgaagatgactcctggggggagcagctcactggcccatttctcccttgagaggaccacttctttctttttcagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtgagttcatgtcggggaaaagaccttgcatgtttgtttctagaagagatgagctttttttctggggtctcattcagtcattcgtttgttcatttgttcactaaacaattgctaggattctgctctgcttgtagaccatgccaagttctatctaaaatacagagggaaatcagatagaatcctttttcctgagggcatctattggggaggtcaatcagatgtctgaggcaatattcaatttgtgccagaagggagagacaacctggtgtcataggagagaggacaccttctagctggacagttgcttatagcctcatggaggaagtagtgttcggtaggctttggagaggggagaatttggcagaggaagatggagggaagggaagctatgaacaggggagggaggtgggaaaatgaggagcggggctgcacctcagacgaggggagcaaggcacttttctcaggtgtacaatttaagggcgtaccccttaaaaactcagtcatcaagataaataatatttcactacagtatcttcagaaaacacaattaatgtaaaaattatgatgagtgaaatatcaagtatttaaataaagataggatcagtaacagtgctgtgcagagtttattggaacaatgctggccaggggcccccttcttggattttctctacatctcatcattcagactgtggagtgctcctgttccagctgtccctttgcccagctaagggaagaaaagtcttccctccccaacactgtttcatgcaaatgctataaggaaaaatctgctcccaaatagcaccatccaagaggttctgcaggatgtcacagtgctagaaagtgctaactacacatgatgccactgtctcctcaatcagctcagtaatcttgtcctctttctccaaataaattattccatggatacattcattggctgattgatggagtcatttaatctactagcatttagggaggatctattattcaccaggccctggcctaggtgctggggattcaaaggtgtataaccctcacacagccctgcatcctaaggaacactgctgggcttggcttgctgaaacttagattgggaatcacagtcataaatagaaactccagagggaaagctctccaaatttggggtcatgagctgctgaacccactgggcagagctctggggtgctggggtgggttgtcaggcatgactcacctctgctcccctctccaggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaagctgcttctctcttcttatttgctaaatgaacaactgctgattgccaacttttatctccaaagaggacacaactgagatcctgaaccccccagtccttacccactggctcctctagccttagacttactcctcagtactccaggaaaagaaatgtgaactttactggaaggatcacctctttgaaatattcactggtttactgatttttttatttttattttttgttcttgcctggattcacataactaacctgttgcatcaaagaagagatggagtcgggcagaaagcagaacataaggaagatccttccctcggtttccaaaactctaaaatccttaaatgaatgatgtcttaaaaggatttaaaatgtttggacacaaatcttgagaaggagcatgagttaggggagagaggataattcctttctcctgtgaactgcccacccccttgttacaggttgaattgtgtccccccaagatttggatgtctgaagtcctaacccccagtacctcagattatgaccttatttggaaatagggtcattgcagatgtaattagtgacgatgatgaggtcatattggaataggttgggcccctactccaatatgacttgtgtccttttgaaatgtggaaatttggagacaggcatgcacacagggagaataccatgaaggctgagcccacagagataccaagcacctgcaacctccactcccacccgactagtagggttctcactgacaaagcccgactttcagtgtcttagatactgttcttagaaagtgcttcatggcctggcagtgtgctgaacccataccagtgcctggcctctagagccatgagcaagatggggagaaaggacacacaggactcagagactgccacctcctttctagtcccaggtccttgtcctctggatgtccttggtttccacttccttcatgacccccggcgcagccctctgggatgtgttgtaatgtgacagaaagtggctctaacaccgctttccactctcacttaggccaggaacactcgctcaggaatctcatgctatgggatgggataatggcatcagctcaggagagaggaaaaggccttctcagtacccctgaaatcccaccacccaaagcattgatgtccccatccaggtgttctcaggattaatcagaaaacaagtttataatgggaagaggaattctctttgacccagtgaatacacattaaacagccatcatgtgcctggcactgggaacaggatgaaaacccacagcacctgcctcccaaggaaatggagggccacaggaatgggcctgccctgcctgtggataggtattatcatactaatgtgagattagtggtgttattttctggaaagctaaacctggataacactgctattgttaggcacacatccataactacttagaagaaaaatagtatgcaaatgccaaatatgaagacgtgataatacaaggtaaagtaaaataatggtgttatagaggagatagtcattttaacggggagatttggggagtcttgaggatgggcaagattcttttttctttaagtaaaatgcaacttctgattatgaaagtaatacatattcagtgtcaaaagaacagaaaattttaaaaagagaaaaagaatcatcttccacatccatgatccaaaggtaacctctaccagcagtttccaatcctactttaaaaacaatatttttatacaaataaaaacccatctttttatttaaaaaatacattataaaaatgcctgtggatcattaaggactttttgaaaacaggctttgtaatggttgaatgatattctatcataaggatgggttacagtttacacacaacttgttcctagagttgagcatgcagtttatttacatttgttttctccaaaataccaaatatataagcacatgttctcatctctgattgtatcctgaggtgaaaagtgggttcatggggtgggctgggtactattttcccctcaggaattgtggctgggagactccgaatcatattgggggaacttctggaacagtcttacagaattagaaacagacagaccaggggtgaaaccgaaggcagcattataggattgctgggaactctgttactttctctggttaattattttgctattttttggtgttgtttctccatacaaattagtcataaggacctccaatatgaagatctgtattcgttatatatggctaacaaatgacttcaaaatttagtagcttaaaacaaaagtatattagtttgctaaagctgccattacaaaatgccaccgaccgtgtggcttaagcaacagaaatttgttttctcgcagatctggaggctggaagtccaaagtcaaatcgtcatcaggattggtttctcccgaggcctctcttgttggtttgcagatggccacccgcttcctgtgtcctcatacggcttctcctctgtacacatgatccctggttgtctctgtgtccaaacctcctcttagaaggagaccagtcaaattgcgttaggacccaccctaacgacctcattttaaattaatcacctctttaaaggccatccctccaaatacagtcacatgctgaggattgcggattaggacttcagcatatgaattctgacgggacacaattgagctcataacaagcaataaacattattttctcacacagttactatgagtcagaaatttacgagtcatttagctagctacttctggcttggggtctcaaagattgcagccaagatggcagctagggcttcattatcatcagaacttagtatagtatatatcctatatttcattcttttcttttttcttttttttcttttttttttttttttttgagacagtctcgctctgtcaccaggctggagtgcgtccttgtcgcgatctgtgttcactgcaacctccgactccctggttcaagcgattctcctgcctcgcctcctgagtagctgggattacaggcacgcaccaccatgcccagctaagttttgtatttttagtagagacggagtttcaccatgttggccaggatggtcttgatctcctgacattgtgatccgcctgccttggccttccaaagtgctgggattgcatgcatgagacaccgcacccagcctataccctatatttcattctgcctttcaaactaccaagttttctgttgccttatgttttacaatatactttaacctatatttcctctcttatcagagtcaggaatgaaacagtatcttgtatttttataagataagaagtttgacacacttttattttttaatcacccatccttagtttttattaacattagaattttggattcagaatatcattgttctttggaaaataatttttggtaatatcattcggctttataatcaaaattacaatgtatttttaaggcacatttctattttaaattggttaattactcagcatttacccttttatacatgacagctccattctttttgagacagggtcttgctctgtggcccaagctggagtgcagtggtgttatctttgctcactgcaacctccacctcccagatttaagtgattcttctatctcagcctcccaagtagctgggattaccaagctccgttctttttctttctttctttttgagacagagtctcactctgtcacccaggctggagtgcagtggcgtgatatcagctcactgcagctcccgcctcccggggtcaagcgattctcctgcctcagcctcctgagtagctgggactacaggtgcacgccaccatacccggctaattttttgtatttttagtagagatggggtttcatcatgtaggccaggctggtctcgaactcctgacctcacgatcaacctgccttggcctcccaaagtgctgggattataggcatgagccaccacgcctgactgacagctccattcttaatgccctttatttgcttcatttatcgctctgttgtagtacatcttcaaataattttttcaaggatacatgaatccttgcatatctgagaatgtctctttttaatacatgaatgttgaattgcctgggtgtaaaattctagaggtaacatttttttcttttaaaacactgtacagtggaatcattctgattcagttgcaaggttaaaaaattagcatagaaggcaaaaatcatgcatagaagttaaaatcactctgaatttaattccttaaaatgtccatcataccagggctgggcccttggaaactcaaaagcctaggatgatcttctatttttgcctttgactgaagttcccctttctctgaagcagagaaggccaaacatctgctagcaaagcaaaagtttgaaattggattcttgttaggcaaaacataaattattctatgtagttatgtagattggtcccaaaggcccaggccttggaagaagtctgtctgcttgaaaggaccaccaagcaaagtcaactaagattgagcaccatgtgttctgagaagctttccctgattctgcagcccctccccgctaataaagctttggtaggtgcccctgtgcttcccttttccattctgtggttgtctccgcatacgttgcattacagtaaagtaatgtgttgagcctccttgggacagggctttggtctgatttgtctttagtgtctttggaagatgaagatgggccgggtgcggtgactcatgcctgtaatgccaaggagggaggatggcttgaggccgggagttcaagactagcctgggcaacattgggaaaccctgtctctacaaaaaataaaaaaagggttgggtgtggtgatgccctcctgtggtcccgatacttaggaggctgaggtgggaggattacttgagcctgagatgtcgaggctgcagtgagctatgatggcaccactcactgcagcctgggtgatatagcaagactctgtctaaaaaaaaaaaaaaaaaaagatgttgatgattgattggttgaaagtttgttaaactaacaggaagatacagtattctagaaacacaatactaaccaatttccttgggttctgttattgtcagataaacttcttaattgtgccaacgttgtgacttcaaaaactgtacatttcacattgaaaagaaaaaatcaacagagaacatttcatccctaggtgtttcatgtcctgtgctaagcgggccggtgagaagcccaaggtaatatgcatcaataaacccactttgtttctaaagcaaatgctcttgctttctcagaacacatcacctcagccttccagaggaataaaataatggtaagtttaataaaataattaaataaccaaatccttactgatggggtcttagtggtcagagagtattccacatttctgttataatatcatagcttcacagaccctttgtagattcttgtgtcacagacaatagtcatttactctaggaagcttatcctgtgaaattctattttctcttatttatttccttttttttttgtatttttttgtttttttgttttttttttgagacagggtttcactctgtcacccaggctgcaatgcagtggtgcaaactcggttcactgcaacctccacctcctgggctcaagccatcctcccacctcagcctctcaagtagctgatattacagatatgcaccaccatgcccggctacttttttgtatttttgatagagaaaatacatttttgctatgtttcccaggctggtcttgaattcctgagctcagatgatccacccgcttcagcttcctaaagtgctgggattacaggcttgaggcaccacacccagcatatttctttaaacgtataaaagggactttcagtgagaaagaaaaatacatccggaggatgtgccatattttccttttattttaattacaaaattacttcatgtttattgtgggaaaacatagtagtatagataaaaggaaaataaaaacacactttgttacatttctttctagaccaaaatttgctatgtctctcttaagagtgaattaaaagagcttcctgtcatttatttatcttttacaacttcctctgcatagtggaggtggcacaacaaagcccgaaacattcctagaatttcatttccaggcagcttaaactaggaaattagtgtcgggggtgtgccaattcttttctgcactaaaaaaaaattttaacagtgtgtatgattggcacaaaataaactgcacaatttgataaattttggcttatgtatacaactgtgaaaccatcaccacaatcaaaatgtaaacatatcacccattaaggttgtttcttcattcccctgtaaccccttccttccatccctccctgctcctccctattcccaggaactttctgttttctgcactacagattagtttgcatttttcagaattgtatataaatgcaaccatacagtatggaccctgtatctatgtcagtcagggttcaacaaaagagagtagggtgggggtaaaatatatgtatcaatctgctacaggaaattggctttatgcaactgtggcagctggtcaaggagtctctttaaggctgtttccatgtctgatgctagagctggaagtctactgggcaaaaagtcaagacgatcacaagtgggctggcatggggaagcatgagctggagcctcacaaggacaggctgaaactcttgtccattcttgttgcctctgatgttggtgatgagggtatcctgcagaagccagggcgctttgtcacagaactaaacacatacatggtcccaaagtcagaaaaactggtgaatccaagggtaggtagtagagcaactgtaggcccagatgctgcttcaaagtagctgctgcctttttcccaccgtctaaagtcccttgttgctaactctgataggaaacatacaggaagtagaattcttggacagtttagactggccaagtacaacattacaaatccatcacttaaatcacagactttttttttttttttttttcagacaggatccggctctgttgctcaggatggagtgcagtggtgcaatctcagttcgctgcaacctccacctcctgggctcaagaaatcctcccacctcagcctcctgagtagctgggatgacaggtgcacaccactctgcccggatactttttgtattttttgtagagacaagggtctcattatgttgcccaggctggatgacaggtgcacaccactatgcccggatactttttgtattttttgtagagacaagggtctcattatgttgcccaggctggtcctgaactcctgagctgaagcaatccacctgcctcggcctctcaaagtgctaggatttcaggcatgagccattgtgccggcccacatactctttttttttttttttgtccagcttcttttactcagcataatgttttgagattcatccatactgtagtgtatattaatagcttattcctcttattgctgagtagtattccactttgtggatataccatatttgtataacagttatctttgttgttgaacatttggattgttttctagtttggggatattataaataaagttgctatgaccatttgtatacaagtcttttatttctgctgggtgacttgtaggagtgaaatggttgagtcatattataggcatttagttaatttttaaagaaactgccatattgtttcctaaagtggttgtactattttaaatttccaccggcagtgcataaaaattttaattctgccacattatggctaaccttagtttaagtctttttaattttagacatcataatcggtgtgttatcttattttggttttaatttgcatttccctaatggcatataatgttcatcatcttttcatgtgcttatttcctatccattttctttgatgaagaatcttttcaaataatttgtccatctcttaatggacaatgattgtttattgttatattattgagtttttaagaatttatatatttatgtataaatttatataaattatttatatattatatttatatattctagatacaagtcttttatcaggacttgtgatttgtaaacattttctctcaatctgtggtctgtttttttcattctcttaaaaatgcctctaaaaaacaaattttaaattttgatgaagtccaatttatcttctattgatcatgtttttggtgtcataactaagatgttttggcctaaccccaaggttataaagatttcttttaaaagtgttacagttttagttacatttaggtctatgatcctaattttttttgtattggtgcaatgtatggaagaaagttggggtttttgcacatggatattcaattgttccagtacaacatgttgaaaagaatatgctgcctccactgaatagcttttgcacttttgtaaaaaaaaaaaaaaaaaaaaaaaaaatcaattgaccgtatatgtgtggatttacttctggactttgctctgttccattggtctatttgcctatctggatgctagttacacactgttatgattattgtagctttaaatttctttaaattttttttggtggggggtatagccgggcacggtagtacatgcctgtagctccaggtacttgggaggctgaggcaggaggatcacttgagcccaggaagttcaaggatatcttgagcaacatagcaaaaccctgtatcaaagaacaacaacaacaacaaaaattgggagggtgagggtatctttggtccttttacatttccacgtaagttttagaaatagcttgccagcatctataaaaaaaagcctgctagattttgactgagattgcattaaatctatggatcaattcaggaaaaattgacatcttaacaatagtaagtcttctagttcgtgagtgcagtatatttctgcacttatttaggttttctttaatttctctcagaaatgctttgtagattctagtttatgagtcttgcacatcttttgtcagatttatccccctaagtatttcatatttttgatgctgctgtaaatgtttgtttttaatttcaatgtctgaatgtttgtagctagtatatagacatacagttgacttttgtatcttgattttgtgtttagtgatcttgctaaatttagttctaggggctttttttgtaaattctttggttttttcttttttttttttaaataggtagtcatttcatctgcaaaaaaagacagtttcttcttgcattgtttctggtgaaaaatctgctgccatccttttctttgttcctctgtatgtaatgtgtctttttttttttttttttttgagacggagtctcgctctttcgccaggctggagtgcagtggcacgatctcacctcactgcaacctccgcctcccgggttcaggtgattctcctgcctcagcctcccgagtagctgggaccacaggcacccgccaccacgtgcggctaccgtaatgtgtctttttaaaaatttacttttacttatattatttttaattgacaaatcataattgtattacatgtatggaatacaatatgatgtatacacatacacatacatgtggagtgattaagtcaagctaattaacatattcaccacctcaattatttgacattttttgtggcaatacatttgaaatttactttcttagttattttgaaatatacaacatattattgaatatagccagcctggtgtccaatagatctcaaatcttgttcctgccgtctagctgaaacttcataccctttgaccagtagtaactccccattctctcactcccctgactccagtatctggtaaccatccttctattttctacttttgtgaattcagcattcttaagatttcacatataagtgagatcatgtggtatttatctttctgtgcttggcttatttcacttagcataatgttctttagatgcatccacgttgtcccaaatgacaaaattccattctttttaaaggctgaatagcatcattctattgtgtatatatgcatttt

SEQ ID NO: 1703 - DNA, 4162 bp, Homo sapiens
cctttgcagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 1704 - protein, 406 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 1705 - DNA, 26345 bp, Mus musculus
acacagtagtagaaacttttaaactttttattgtttgggtcgggggctcggggtggtcgttcccaaccttaagggctgtgtcctgtgagccttagtttctttctctgagaaacaggcattcctgagcatgcgttgattaaggggcaccagcttggggtccagggctgtagggcaccatgtgtaccccaggatcccgtggccagtttcctggtttgggatgggttggagccattaagttgtatgttttaagaggcctaggtctgatttagttcaggttgattcaattatgtcttcatcccttttgaggtggttgaataacttgacatgagattaaggccaacaaaagaggaggcagggtagccacagctgctggccatgcctggcaactaggtaggggcctcagggggcctttcacctctctttgtaagagaaaaacgtccacagccttcttgactacttttcccagagtaaatcgaccaccttggtaccaaattggatatcagatgttaagtttttgtttcgagaaggattagtaacaggtctagtttcaaaaaaaaaatttttttttttttttgtagtgacaagtgcagagaactaaccttactgctttctgtctggggagtgtatctatcagaccactagttggtgcttagttactgtgctgagaacttttaaggtgtgtccttactggtagatgacttttccccctcctgctggagaagtcgtatttattttagatactgttttttcaaacctgtggagcctggtggtatatttaggctatctggttattttggttttaattttgaatcctgatttgattgagtccctccaccatgctgccagctttccagttatgtaagtataaaatccaagaggcagtgacctctgaagactgagttgtggatagttagcattagtcatccctgggaacttccatattttggctctttagactgcaccttggtctgtgtgcaggaggaggaagcagggggaagacctgactggaggaaggccacgtttctttactcctttcatcctcactccatctccacactttgcagtgtgatttcctttagtgggataactggcagattgaaaagatcgacactccctgattgtcttggcttcgcattatcccctttcacttcttactttaaaaaaggaactaagataccacttagaaaagttttccctttatgctgaagaatctattttaataatagctctctctctttttctcccctcccaggtggtaggggagggagagggggagagaaagttctgactctggcttcttcacgggggagggatttgcattttctttgttagcctccatttttggcagagaaacttggggtggataggagcccctaatcctttccagtgggcttgttttggaggaaatctgaaaataagacataatcatcaagtctcttataaactgatgaaataattgaggcctacagtggccctcgtgactcaggctctgtctcctggcagataagtgctaatcacttttctccctcaacatcacttgagtaggaaatgctgttttgccacagcagggctgccatcccccacccaggagccctcttcattcggagctgcctgattagagctggggttccagatgagctcctttttcaccttatcaaatggcaggcttttcctcactcgttccaaacatgatattggttgacaagaactttggagtagttttaatgacccttgactgcctaaaacacaggacgtcataaaatatctgctgtgtgactgctgtgaacacagatgactggggccttcaagtactgcataggaagctgggtttccaggcggctagaaaagcattattcttcgattattcagtctcatgtatgctgtgtggcctgcattttggatttttgaggtcactagctataatttgttttaaatggctggatcctgattcctcattgcagttttaattccgtggctatgtgtgtaattaataatctggaaagtggaagctgagacatcaaaagtggcttttccatctttggaatcagaaagaacaacttcaggcagtttgggtaaactgttgactattagtatcaaaatgtagttagtagatcacagctgagcgtatggaatcatttctaatttagggttatcaaaaaataaaaacctggaggaccagctactcaaactgaattaaaggatttctatcctaataaatattgtgaaccaggataggtttagctacaggcacgaaagcgagctgtgaatgtggaggagcctcagatctcacacttcacctcctgatttttcggggaatggctgttaactagtttaaatgctcgtggaggaaggtgtattattacacaagggaaatgtctttggccttgctgtgtagggcaagtctggtggaatatcacttaatggcctccttgtgggggcactgtagaaggagctgaaaagctggcctttcagttaggtgatctggattaaggttcttggccagccagtaatatagccaggcaaatttgcaatggtatgcgggccaaagggttttgaattcagaccacgagggcagatagaaatcttgccttgaaggaagttagtgggggatgggagaggggtacactaccattttctcctaaaacctccttctgatgagcaagctcagctcttggatatgtttagcttccacagaaatgggggactgtgtgtgtgtgtgtgtgggggggagtccctgttagccagctgctaccacagattacccctttatgctgtgctgcctgaagagcttccacttgagcgcttgttgactgcagctttctaaacaggctgttgcttcctgcccaggctggcaacattaggagctactagaaatttggggccagtttggtaattttatgataaaggtgagaaataaattcaatgaacctggcgaggcagctgagcaaaggtgtacgtgcaggggtgagtcctcttcctggctttgttctttagcgtttccagttgactttggcctgcccacccccgggtcaggctggttctcttcagggtgactgtggtgatggttcagatctaggagtgctgagtggccaggtggctgtaaaacagttatcatgggaagaagtcatttgtctgacactctggatggtccagtgctcaacaggacaccaagcagttttggtggcagtttttatttcctagtagtagatgatttaactcttaacatgtaaatctttccagcaatgaatggtcttatttattaaaaagaggttttacttttatttagtttgagatgcaagcaggtaactagcatttatttaactttatggtaaatggaggaaggggcagtctgaggttgaggacagtgcagcctgggcgtgaagggtatttctgagctcgctttttacttgaagtagttaatttggctctgatttagactctgcccatttaaccttgggcagaaacttgggaaaaagtggcttagtatgtagttcttggtgccacataaagggcttacagtttgatgatggtgtgcctgtgtgtgtgtgcgtgtgtgcatggatgtgtatatgtgtgtatttatgtgtacagatgtgccaggaacatggacactgagtcactgtagtctctagtgttgatagcctaggtaagtgtggggtttgctcctttaggctcctgaaaccctttccctctatgcagttggtcctggcagatctcaaagcacatgacatgtacggttgccctgaacaagcagaagttaactgtgagaaacttgggacaccaatgctccatcttgtctacttgataattttcaagaatgtcatttgtcccataagatgttttaaagcagatcaacatggggcatttgaaagcttgtttacagataagtatctttaggttgataatattgaaagtaaaactggatacttgagcacacctgaactgattcgtggtgagtcaggcagtttccagtttattaagaaagggttggagtttatgtctggcagtcctctgagctcattctgttggagttgggtgtttctgtaggacttggaagaaattgggctgctttgcccaggatcttctcaccttgccttcaagtagtgtttgacctgtgataggtggccttatgatgctgaatttaaactgagaattgtaactacccccccccccccctgctaggaaagttggcctggccatttttcccttggaatgttgtggaaagatcaaaagagttccaaggtttaggggccttggagatggcccaaaaggtcaggccacttgccaccaacaccaagcctgatggatctgcattttggttcttgggacatacatgttggaaggagagaactgacttcctacaattgtctgccctttgatctccacatgcattctttcccccatacatacacaatatatataggttttttaaaaatggcaggtttgattgttcctatagactgtgtagaagtaagttagtccttctacagggtcagaaaagaagagtaggctaacatcctttgctgctttgcagaggacttgaggtgtttggtctgtgtgcacttctgagcattctgtgtgtgcctttagaggctagaagagggtggcctgtcccctgtatctggagttagagattgctgtgagctgctgtgtgactgctggaaactgctcctaggttctctagaagagtaatccgtaatcggtgcctttaactatcaagccattgtctccagccctaattttgtacttcaactgggaattgtgggtggttgtgacacatgcttttaatttcaaaatgggcgggggaggggttgtaatggagtggggggcagaggtggatctccatgattttcaggccaccctggtctacagagcatattccaggacagcccaggctacacggagaaaccctgtgttgaaaaaccaaaacaacaacaggaagaaagaaggaaggaaattaattgtccagagcctagttgtgtgattcgagtgccttaaggcgtttactagagcatctcttacctgagtgaagggttggagcccatggccgatccctgcctgtgagagccctaaatgctgtgtcagcagacagttactcttccctcctgacttggataatctttactaaacgtgagctagcatactcaatgggaagagcacagatgtgttgtctgaaggctgtgggcatatttatggactcccagtccaagtgcaggagtggtcacaagtggtagttccctcacttaactcttttgagcagtttatcggcctttgcagtgtcttgtataattgataactttgcagtcaggtacttactggtagaattcaatgtcactttagtcacacatcagtgtctagttagtgactttaagtaagaatatcagacatactcgagccgtgaaagccatatgcttcttactgagtttcaaagattgttgtatataaaagagtgactgagtaattttcatgggcgttaagcctcagcgtgctctcagaatgtaaggcattctgagtgaagccctggccggctccagagctgtgggactggaggctggctcagtgcatcctttacaggaatgaagattgaaaaatgtttttaaaacagacatttttttcaaagtactttttttttaaggatttatttatttatttatttatttatatgagtacactgtatctgtcttcagacacaccagaagagggcatcagatcccatttcagatggttgtgagccatatggttgctgggaattgaactcaggacctctggaagagcagtcagtgttcttaacccctgagccacctctccagccctgtaaagtactttttaacaaggttttgtggtgagaatccttgccttcctggcattcaaagttggattgcagtgatgttcttaaatcctgtcaaaaagcagtccttgaagcaccccctggggagtcctggtgcctcttgcacttcaggaggaaggctagaacattttgggaaagctacatttgcttgcacacttgaggaagagggaccacttgttaggtagtaattacagtagcacagctgtgggtaggtttgggaactccatcctgcaattctttcagagcttagcaagttggcttgaattggtgcccaccggatcttttgcacttgtacttttagttattttgttgccttacggttgagcaggagtttagcaacttctcactgaggagggtgagggtgagcacctgctaccagattttggtggccctcaggaggggacaagctcagggggtacagtcgtctttgtcagggcccagacctacacatgttatgctggtgtagcccggtgctctgcagctggccgcactctggcctcaactcagctcagggatagctttcagctttatattatagggaagaaatctgggagaagccaggtttgatggtgcactcttttaattccagtgctaggtggcagaggcagtctcttgagttcaaggccaagcatggtctaccatggaactgagagttctaggacagccagactgtgaagagaaaccctgtctcaaaaaacaaaaaactaaacaaaaaacgtggaggctggtaagatggttcattagttcacatggtaagatggttcattagttcacatggtaagatgattcattagttcacagcactgtcttgttttttcagaggacctgtgttcagttcctagcatccatgtcagctggttacagctccctgaaactcccaagggatctgacatccctctcctaccccaccctcagtgcatgtacacaccacacacacacacacacacacacacacaaataaataaataaacaaaaatgtattttaaatactattacagcttggttgcagagagtggtcagtcatggggtataacctctgacttatggttcattttagcatcagaacaggtggcagggactataacctgagacatgtgtcctgcttcagtcctggtttctgtcaaagttctgggtattttttaatccagtgccaggtactagagaaagcagtgggcagccagcaactctgtcctttggatctccaaggtgttattattattattttttatatttgaaaacccttttaaaagtcttttaaaaccatggtagagaaagataatttacagcaaatgggaatttaaaatttgccttagctttattttaaatttcttttttgtcctctctctctctctctctctctctctcttttttttttctccatacagggtgtctctgtgtagccctggctgtcttggaactcactctataaaccagactggcttcaaactcagaaatctgcatgcctctgcctcccaagtgctggaattaaagtgtgcaccaccactgcccagcttttaaatttgtatttcctcataggctggctttagatgtagtcttgagcgtggtgggcttgtgtgggacaggcttgcatttgagccttcacatgctgaaacaaaagctgtctaggacttgagttgagcacagttagactagtgagctgttgtgggaccctcaggaggaggaggaggtgcttccagctttgccttccccacctgactgcctgcctgcctgggacagacaggtgcttcctgtggctgtgttctactccctgcatggtcagggtttgagccagggcttggtaaccttttccaaagggaccttgcagaggaatgatattgttccagaagctgaggcttgacagtcagtggggccctccctcctgtctactgtctcctgtgccctaactcaagcacggttactttgaactcttttgagatagggtttcatattagttcctggttggactggaactcactattggatattgctactttttttctgccattaaaaaatggttattatagcgcttcaaagaagaaaggacaccttgtaactgactgtattccaggtgcagtaaaccctctggcacggagcaggacccggtcagcagggtgtggtcttgtctttcccgactatgtacttaattcttcattgaacatctgcctgggttgtgggcgtctgcttagtgattgtgtagaaatctgagaatgctgccagagctttggttgtgtggagctgtcctcggccatagacagcgtatagtgcttgtccaccttgctgtagtgttaaccacagaaagtgcaccctgggttgagttcactttgtgacaccttgaaagtcctgacttaggctggaccttagttctcaggtctctgttatgtcataggatggtaaccactccaggtacttgtcctccattgtgatagcaacaaaggcagaaactaagataaagcactgccagcagcttgctcctcgccagtctgtgtcctggagtctcacagctgctcactggctagaaggggaagagccagcttcattcatgactgctgagggctgggagcagagagggggaagagaggaccgtggcaggtgctctggtgcctttttgtttccttgggctgaattcacaaacttcataggaaaagaggcagggctgactctctgtgctgtgaaggacattgacttttttagggattaaatcttcaggagtggaaactggagtccatagagtctaaagccactcccttctccctggccagtggctcagtggaaggcgaagtgagatgggtaggaggtggattttctgaaggaagaatgagccacacagccaggtctgaggaggcctgtttgagatgtggaccagagccgggcgtggtggcgcacgcctttaatcccagcacttgggaggcagaggcaggtgaatttctgagttcgaggccagcctggtctacagagtgagttccaggacagccagggctacacagagaagccctgtctcaaaaagccatttaaaaaaaaaaaaaaaaaaaaagagaaatgtggaccctgaaagtaagtggcctctgcatctagtaggtcatttcccctttgaagctcaaccctgcactgcagcatcaagtgcctggaacaacagggtcctgggctatgcgtaatgaaggagaggttcctgtgtcatctgctgagggtttggacctgtctgattttgtcagctcattttcataacttcttttttgagacagggactcctccttatgtagctctgtctatgtagaccaggctggctttgaactctcagatccacctgctccttcctcgtgagtgctgagattgtaggcatgctctaccgtgttgtgcttttgtaactcctgtagtcactgggtaggagacaggtgtatatcttggtggcatcccagacagccaaattggggacagttctatcctaaagtttatcctctttgttttcgagactgtgttttatgttgatcaggctttgaactcactgttgtagcccaggctggccagcctatcatcgccccttcctgtttaaatttggcatttatatttcagtgagcagagctctgccttaagtctcctgactggttgaaattctactcacttagtaagtgtatccactgggaaatatgctaatgatttaattaacaaacatgtttagcaggctgcattatggattagttaaaggtgaggcagttgactctagtcccttttgtggagaagatcatgtgactcataggccaagccctgttcctgagccttcctcactgagacttgtttttttcctttcagattttggaaatcccttgtcttcacattgccgggatcaacgtcttgctcaactgagccactcaccagtggagatggacagagctgttgccctcgtgctgacgcacatctgactcacagcctggggcagcttggatgccttgtttgtgcaaagagccatctccatcactgagctctcccaagctccggaatatactcgtccctctgaccttagaggtgctctgattttgacacccagggctcttagaggttctgagtggtgatatctcacaggcggccttattctaactgcagagatcctcagcagatagtggattacccatcctgtcagaccctgaagtggttggcagcatgccgacccagtccctcctcgtgtacatggacgggccggaagtcctcagcagctctctaggctcccagatggaggtggatgatgctgtgcccataaaagggccggtggcagtccccttccgagctgctcaggagaagagcatggccgtggcagagggccacatgcccctggattgcatgttctgcagccaggtcttctctcaggcggaggatctcagtcagcacgtgctgctgcagcaccggcccaccctctgcgagccagctgtcctgcgtgtggaggccgagtacctaagtccccttgataaagctctggagccaacagagccagcattggagaagagtggcgaagaccccgaggagttgagctgtgatgtgtgtgggcagacattcccagtggcttttgatgttgagagccacatgaagaagcataaggactccttcacgtatgggtgcagcatgtgcgggaggagattcaaggagccgtggttcctgaagaaccacatgcggacacacaatggcaagtctggcaccaggagcaagcttcagcaaggcatggagagtccagtcaccatcaatgaagtggtccagccgcacgcccctgggagcatctccacgccctacaagatctgcatggtctgcggcttcctcttcccaaataagcagagcctcattgagcacagcaaggttcacgccaaagaaactgtccccagtgccagcaacgttgcccctgatgaccaccgagaggaacccacgtccccgagggaagagttgctgcagtttttgaacttgagacccagatcaactgcaggtagtacagtgaagcccatgacctgcatacctcagcttgacccgttcaccacctaccaggcatggcagttggctaccaaaggaaaagtggccgttgcccaggaagaggtgaaagagtcaggccaagaaggaagcacagacaatgacgactcatgctcagagaaagaggaactaggggaaatatgggttgggggtaaggcggaagggtctggaaagtccaaaacaagtaaaagcagttgtccaggtctctcccaagacaaagagaagcctagacatgctaatagtgaagtgccttctggggatagtgaccccaagttgtccagtagcaaggagaagcccacgcactgttctgagtgcagcaaagccttcaggacataccaccagctcgtcctgcactcgagggtgcacaggaaggacaggaggactgatgccctgtcacccaccatggctgtggatgcaaggcagcctgggacctgctccccagacctcagcaccactctggaagacagtggggccggggaccgagaagggggctctgaagacgggtctgaggatggactccctgacgggctccatttgggtgagtactctgctgcctcccgggcagcgagcgtttgctgcagggggctctgggagtcaggctatcatctccgtgctttgtggtagcactgtgtagtctcatagaagcatcacaggcctttttaaatgtctttaataaggaggtgagtgtaaaaggctggtccaaaatcccattatgaaagggctctgtatcttttgctcccagaggacttagtttttatggtagtgcaccatggggatgctgctggctgcttcaggcagtgccctgaggaggccatgacctggtgcagagtgctaggaattatgggaccgagacctaggactttaccagctgtctggcattcacttccgttgttatacaggactgcctatcacagccttgttaatgctttcacctacatgggtttctggtgctcccaaaagggtcagggaggcttcctcagcgtccactactcacgcagtgggactacttgcccagtgtactctgatcgctttggtgtttgtgaggccagtgttgatgagggagcttctgacgtggtcttttgctgcaatccagaggtgggggcccacttctgaacccgctccatgaatttggtgttaatagaaaaaagcttttgtccagtctcctgactgatgtgagcctagagcctttggagtaaatatacctgtttcccatcttgctgcccaccccacttgaaccattgtttgttagttaaagtaactaacactcctgatgtgtgggcatggcccatgggttccttctaacacttccagatgtgtgtggccactgggtaggtagtatgttgcaagtcctctctgagaccagagtgagtctgaatagtaaaatctgtcagccactgtgcatgtgaaccagcacccagttctttttctggtcactactgcattttaggaacgttgctttcatgacactcggagcttagcatatctcactccttagtccccagaaaggtaaagatacatggtgtccatgatgtcatgagaatgtcaaagatggcctcagcacctgtgcagttctgcagcatcagcactgtggatccctaaagtcgtttactagtcattgtacctggtggacaacttggtggggtcctggggtaggcgttttggcctggcttgccataggtgggagtgctggagtctggctgcggttcctggtgacccattatacattgcccgacctttccttgagatttccctgtttgcaaaatcgaatcatccactttgtggcatcctcctaggctgagctcagccttagttacaaccctgcacagaacagcatagtccaagtcccaggccgtaaggcaggtgccagatgttgggaaggccacggcctgtgtgttacagaggtatccctagccatttgcatgtgatgtagcgaagctcacactgtgacagctcaaggcagggtgagctgtgggcagagttgtgagtgcagtggacctcccccactgtgctgccctccagtctgctttactcttacttttaagaagttgaaagagaggctgtgatgacttttcaaagcctcttagaccatcttagggagtggtgtggtgtgtttatggatccccttccctaacaggatctgctgtaatggaggtggtccagtccatccactatgcctgtttttgcccagctgtgtgggtcacctgcctttgggagttagtaacagtgcagcatttgacagagaagggaagaggcctgtaactgaaaataaagttttgtaaggcaaaatttagtttagttttggaccccaggtggggacgtttgtgtagttgtgattgactgccctgctccaccatggccctgatctagacttcaagagatatacctcccagataggactgacagagactagtggagccatcttatcttcacggatgcacattatttacaagttggtgggctggtgagagtggaaagtcccagccagtttagttagtctgtcctcagtgggtccttctcatggggcacttcagccttgcctttgaagtctagtaagccaggcctcttttgaataggagattgcttggaaaccacagatttccatctccccaaacttggctaaattttgatcagctttcctaggtgcttgcccaaagccaagtctgggctgtttctgaggttattttgtgcttgccgccctctagtggtagtttctatattcccagcctgttttctgctggctgttgggaggttttatatcacctccaaatactggttctgagttctggcagtttttctgtccagtgggcacacatctaccttaagcatgaaccagttgtaacggctgccaagtgtcaagaacagaaagtgcctgtcaggtttcatctcttaaatggtcattcttaggatggaagtacaaacctctttagggcaccacaaccctaagacacagggtagtgcagagcctggtggcacacaactttagtcccaacactatggaggcagggtagggggtgtttgtgtgtgtgtgtgtgtgtgtgtgtgtgtgtgtgtgtgtgagttctaagccagccagggctatctatataccttgttcccaaaacaaaagcacacagtctaagacatgaaaggctgcccggtggcattttgtatgttattttaggctttgaaacttctaagcagagctaaaataattctttaatggtttcccccaaatgttttgtgttgagaacctggagtctgaattcttgagtcccgcacttggcctgactgacaccattatttttgtttctgctttaagataaaaatgatgatggaggaaaagcgaagcccctcccgtcctcgagagagtgtagttactgtggcaagtttttccgttcaaactattacctcaatattcatctcagaacgcatacaggtaaaggactggggttttaaaacatgtgttgactacaacaattgtgtgctgctgtgtagttcagatggctttagtgtgtggtgtttgcagctgttgtatgtctacaacatcactgcagcttgaatactactggctcctgttttgaggctggtttatggttaccatatcttaaggcaaactcgtaatgttttgaaatgccacatttgaaaacccttttatgactttggagtgaagcaagggtgtatttggtagtttggatgtaggtgcagtgatggtgcgggtgagaaggtcgaggcttccatgacctgggtacaatggttagtccactgtgctgaaaaagtgcgcagatgctgccgttgggcagccatgaaggttgggtcagttaaagcgtgctcttactgggaaccaggtttacattttcaattgcattgcactgggggcattggtgccctagctgtgaggattggcagagggaacagcccatgtttggtgtcatagcttgcttagcttgcagagttctattggcacctttcctaaacatcatgatacagtggcatatctcgttttaggtgaaaaaccatacaaatgtgaattctgtgagtatgccgcagcccagaagacatctctgaggtaccacttggagagacatcacaaagacaagcagccggtggatgctgccgctgagtccaaaagtgaaggccggagccaggagccgcaggatgcgctactaacggctgctgacagtgcgcagaccaaaaatttaaagagatttcttgatggtgccaaagatgttaagggaagcccacctgccaagcagcttaaggagatgccttctgtcttccagagtgttctctcaccagcacacagcaacgatactcaggatttccataaacatgcagctgatagtgctgagaaagcgaggaagagccctgcccctacttatctggacatgcagagaaagaaagcaggggagcctcaggccagcagccctgtctgcagactagagggggttgggtccttagcacgggaagctggccatagggagaagatggatcaggatgctgactacagacataagcccggtgctgactgccaggacaggcctttgaatctatcccttgggccgctccacgcctgtcctgcaatctctttgagcaagtgtctgatccccagcattgcctgccccttttgtactttcaagaccttttatccggaagtccttatgatgcaccagagacttgagcacaggtacaaccctgacccgcacaagaacggcagcagcaagtctgtgctgaggaacaggcgtaccgggtgccctccggctttgctgggaaaagatgtccctcccttgtctggcctgcacaagcccaaggccaagactgccttctcaccacactcgaagtccctgcactcagagaaggctcggcagggggcctcggggccaagcaaagcaccccagacttcaggaccagacaacagcactttagccccaagtaacctgaagtcacacaggtcacaacccaatgctgggggcaccagtgccaccaggcagcagcagtcagagttgtttcccaaaggtggcgtccctgctgctatggataaggtgaagagacctgagccaaaactgaagtccctaccagcctccccgtctcagtcccccctcagcagtaataatagcaacggttctgttgagtatcccgtgaaggttgacggcccatgggcacagcaagggagagactactactgccatcggaattctggcagtgccgcagcagagtacagtgagccacatcccaaaagactcaagtccagtgcggtgtccctggacacagagcatgcagggaccaatggcagaaggggctttgagctccccaagtaccatgtggtcaggagcatcacctccttgctaccaccagagtgtgtgcgcccaccgcctgtgctgccccacaaagcccgtttcctgagccctggggaggtggagtcacccagtgtgttggctgtgcagaagccctacagtgcctctggacccctgtatacctgtggacccgtgggacacgcaggaggcagcccagcccttgaaggtattactgtaggcactactataggttggggttgagttctcaggtgcaggcaaccaatctaccatagctagtacaaagcaatggattatgggccatcagagcttaactttacaggattaagtctaaggaaatgtagaataaaacaaaaataaaaataagataaaagtagttcctttccttgctgttgaagtccaggtgctggccggtcatggtggagcacacctttcatcccagcactgggaagctgagacagttggactggtgggagggagttcaagcctaacctgggctacctagatctttctaggacaaaagaaagcctgagagccactgaaactttgcttagggttgtcaccccccaaccccctttccacactcacacgcccgtttccacacatcggtgggcccttggcctggtagaagcagagagagtaggagctccttcctgactgaagagactgcatcagccgagtgagcggtactggtgcactgggtgttgctgttggtgtgttcctgacaggttgtcttgtatgcagtggtcaccttgttgctgacgtggagttctcatcgggaaacatttcttttcccgtgtttcatggtttctggtgctttcctgtgctcggaggaggtagaccagggtgttctcttgcagatttgtattgagggtttgagtgctctaaagatcactaactgcaccacttgtaaagcccagagagctatcagtttagtgcattctgggtacatcctgctaggaacaaaagcaagtgttttcatccactgcagtgaaatggctcagagttgtcatgaagtagaaacctgtgctgggtgggtactggagccaaagcactctgccaactcagctacctcctcagcccagacttagtgtttgctgccggtgggcttaggtgtccggtatcccacggtttaagtggatgggttgttttaagtgtctttcaccccctttcctcttctacagagttgctttgtgcgtgtgtaggcttccctgctgtgattgatgtctgagtgagcacatagcacagctcccttctccagacccagggctcggctcttactgactagtgccattgttgctgttcactttaagtatgtgagtgccaagtttatttattgttttcaagataggaattcactatgtaaaccaggatagcctcaaatttctagatattccccttgctctgcctcttaggtgctgggtttaagggcaaatatcaccaggcctggcatatgtggtttttgtttcctttaaaaaaagacaaggtctgacattgtgtagcattggttgtcttcagctcaatagatactgcctgcctccacctcagctctggggttagaggtgtgctcggcgttctttcttagtctaaggggctacactggggagtgttgtcatcaaggcctggaagtcacctctccctctcttcaactaggaaagaggcctgtgtcacatcagcacctatctaacagcatgctgcagaagagaagctatgagaattttattggaaatacacattaccgaccaaatgacaaaaaaccttgacttctgattcttggggggggaaaaggtgagcattattgtccttaaatacattgtgttggttttacttgaataataccaaattcattttctttttcaacttctaaaagtgattattactgttttagagtgacatttgtttgtggattaatggatttgtgctcagtgtgggtgggtacacggacagtgctgttcgggatagcccctgtccttccccagggggaggctactcccatcctcgggctcagcagcaagtgccatctaactggccccatgttttttttattcattaatgctttattttttattttatgtgcattagtattttacttacatgtatgtctatgtgagggtgtctgcttctccagagctagagtaacagctctgagctgccatgtgggtgctgggaccctgaccctgacctgggagagcagcagtgctcttaaccactgggccatctctccaggccctcctcccccatttttgttttttaaaaagatgtttgaaaatttataattgctggatggtggggcacatgcctttgatcacagcatttgaggcagaggtaggcaggtctctgagttagagaccagcctggtctacagagccagttccacgatagctaggactacacagagaaaccctgtctttaaaaacaaaacaaggagccagtcgtggtggcgcacgcctttaatcctagcacttgggaggcagaggcaggcgggtttctgagttcgaggccagcctggtctacagagtgagttccaggacagccagggctacacagagaaaccctgtctcgaaaaaccttaaaaaaaaaaccccaaaaatccaaaaagacaaaacaagggctggagagatgtctcagtggttaagagcaggactgttcttctagagatttgtttacatacagtccatagctacttccctgccacaacagtgaaattggattactgtaggtctgctgatcttaggctggagccacacactctaagccagtgtgaggagataggcctggctctacacagaggtgaagctaggcctgctgtcttagttcagaggtgattgaaagcattgtgaagccctggcctgtccaggcagaggtgtttccctcaggcctcacaggcttgatggacacgagcttcctgagctcagggagaggctgccagcgctgtcagcctgtgctttaacatgtcacagcccgggcacaagggcgttggcattcctgggcccttcccttccccttttcctgtgtgagcatctgaccaagtacctcaccctcactagttaaagatcttttaacactgagctacgtctccagctattttgattttcctctttgtggactggtcttgctgtgaaagctaggttggctttgaacctggcaatcccgcctcagctctctcagtacaggtgagccagcacacacacctgtgtccccttctgagtggggcaggtgcaggtgccagatgggatgtaccgagtactggggtctggttcctggtataattatcttgttctcctgagtagtccatcagctctgtaggttggagtaagtggaaccctttgcatgtcctcatctccctagatgtattcgcgcatgctgtaagatcttacgattctgctcatctatttgcatctgtcagtgaatgtgcctttggagaccaaaagaaaggctgttggctccctgggagctacaggctattgagctctctaacgtgggtgcggggatcaaaacttgggttctctggtagagctggtgtggtagctgcggagcggtctctacagcttatttcttgcaatcctttaatgattgtgtgttttctaatcactttcaatgctttcccattaggtccctggatgcaagtacacacttccacggaatcatacattggttcatcttctgagagcgcacaatagctactgaacaagctgtgactgaactgtacatagacctgagaggagcagagaaggaacactacattctctaacgttctgttaacctttgtaccaaatagcaataaaaacgagtgggagccgttgggcggtgcgccagagggactgaaatctattttgtccctaaatatttttttaaagaattgaccaaataagttttttttttttttttgcatacttgagcgctgctgaaaagaaatcatttggggtagggtggggtggggtgggcaggggatgttgtaaagcttgcacctcaggtaactgtaaataccgacgtggtaaacttgcttgagtactgtgtgtctccctcatggagtgcgaggatttgagcattttctgcttctttatgctttttcatttaaaacatgttttaaagcatattctcactgagtctattgtttgtcttcacattgctgatggaacgaaatgttgacactcagtgatgtgctgtgcatcttgaggtcagcaggcactaacctggcaccttttactccagctggtagagctagagctaatgtgtacaggtgtcctggagccccagcttgctgcctggggtcttcggggggaggggggcttttgagtgggtgttgcctacagagaagctgcctctgtagagtggccgatgtcacagagagccaggctccatggggagccatctaagttcttttcttttggaagattgggtgtctcggagagttgccatatctccttgtgtgaattgcgtgcttggaagcaatttttaaagggagtggaaagcttagggaaatcgtttgtatttggagtcttgctgtgtctggtattggaggtgtggacaccttgagtctgggtgagttgctgctggctgagccctcctggcaggcagggagagaagacgcctgggcctctccattgtttgtttcccagggtgatttcctcagtgcacaggcagctcgagatggagggaggacagccaccaactagctcactcagcattttaaacttgagttcctttgatatctgagtttattcaacagttcttgggtttagcaaacccaaaatattttattaagaaactgtttcaaagataaatttgcactgctcctttttcttgccccacccctcctgatgggacaaaagggtgaagagctcaaagaaccccgactcccccctcccctcccacctcattgtgtaccatgaggggtccttgggaaatgtcttacctcttgtgttgaatggagacctgggttgagatgtgtctgctcttgtaggaagatcttttgtatcaggaacatgtacactaggccctgttcccgtccacaagctgagccatatgtacataagctagactgttttcttaggtgtgcacttttatagtctgtttttgaagattaacacatttgcaaggtgattgacaccatctttgcctaaatgcagtgagtgtacaggaagctcgttctcgagacagtacatacaaatccggagggggtcacatagactaggggccagaaagtatacctgtatttaaaaacgaaaaaaaaaaatcaccaaatctattagaaaacaagtccgagtgtgtaatgctgaaattttggggcctttcagatttctctagctacattttctgaatgcatgaaaattccaggttttttttttttctttcttaagcagcccttgtgcttcagtatgtccttgtcatcagtattaactctgggatactccgggctctgtgtctttccctgtgaggcgacagtacatgtgagaagaggtacatttgttggatttttgttaatgtatttatttcattccagtttgatttattttaattgttgatacttaagttgtcagtagacatgctttatttatgatatatttcagcttaaagttatgttattatatgtggatgtaaatatagatttggtgttttacagttctggtgtcgtggttttcattgtgttcctgctgtgtgtgtgtgtgtgagtgagtgtgtgagtgagtgtgtgagtgagtgtgtgagtgagtgagtgagaggtgggggtttggagggccggagggaacgagaacattcagggcttggttttctctttccttgtgggtcctgggaatcaaacttaaggttgtcaggtttgcagaaatccttaaacccactgagctgtcttgcctgggtcctctttccagttttaaatttaagttttgctttattatttaaaacaaaaaaagtttttttgtatgtgcctttggaggttagagggtgttacatccctgagaactggagttacagatgtttgtgagccaccatgtggtgctaagtacagaccctacctgctcttagcccccagagccagctccccccgccccctcggggatggcggttggaagcactcagtactttcagctcccttcccacccttcctggatttctttggagactgcttctgtagcacactgtatagcccaggctcccatcagattgattcagcatgtggcttcaaacttgctatcttgcatctgttttccaggtcctggggttacacccctggtttctcctgggtttttggaaagcaaacctcagaatttaactttaactgggaactatggttatgtgagtgtgttgcctgcacgaatgtgtgtgtttccatgtgtgacagaagagggcatgggacacccagaactagggttatggatcattgtaagctagcctgtgggaaccaaaactgggtcctcctgcagggccgtctatgtctccagcccctgctggggccagccatttcctacgtactaacttctgccagactatgtattttgtggcttcctcaaaaataacttcttacatattatgcccattgcttttgagccaacagaactgggatgctagtaagtcaattgatgagtttcttgagccattttttccctagccctcctctacactgagacactattgtagacaccgagcccttggcctggatgagtcctggttttgtcagtttggggtttcattgccctcatctctaacccatgtcattgaactgacaagttaaacttcaaagtggaagtgggtttatctttcctttttttggtttttcgagacagggtttctctgtgtagccctggctgtcctggaactcactctgtagaccaggctggcctcgaactcagaaatccgcctgcctctgcctcggggtttagccggaacaagggtgagtggattcctcccctgcctgtgttaagcctgtgaggctgtcgagcttaacagtgggttaaggcaagtcagaaatgtgcccgtcatacaaggttaccccacctttctgcttaagctttcagtggcccaaaatgaaagcccaaagtgtgggaaagatgtttttgaagttccatggggctggagaggtgtgtcagtgggtaaaggcgggtgggcagtttctgccaaattgatgacttcacttgcatccaaggtactcatggtggaaagagaaccaacttctgcaagtaagttgtcctctggtttatacatgcgcgcgcgcacgcgcacgcacacacacacacacacacacacacacacacaaagctttgtaaagaccagtgatatgattcattgttaaaaaacatttgccctccaaacatgatgacctgagttaattgctggttctcatacagactcacataaaataaatacaattaataaaatgtaacagtatttaaaaggttccattggtcatctattgaaactataaagaagaccatgtgagtgggtggggctcggtagctgaggctgaaggaggaagattgtgaatcccaggccaatctgaaagtaacaaaagcaggacccctaaacttgctttgtgactcggaaatactgttagaactaagactgagtttctgactgcctcctgacttagtggcccctcgaccttcaggaatgaccccggagtgaatgtaccattgtgggtgacgctgtaagcagctggccactctgaagcccagagtcttatctggccagtggcagtgtctcctggtggcccagtgtttactctgagttttgtggcctcaccttttgttgtgaatagaccagtgtcttgggttcttttgtattataaagttaaaaatatttctaagtgtgtgtatctgtgtgtgagcacccacaggggcccaagctggaggagcttcatggcgaccccggatgggtgctcctgactacggctctccagcccaccctttttgtttactttaaaagacttatttataattacatcacgtgcatgtgaatacccgatgcgggcagtgggcattggatcctttgaggcagctgggatctgccctgtgtggttgctggcaattgaactccaggtcctctggaaaagccgtaagtgcttttaaccactgagccaaagtttctcaagtccttaattatgtgcatgtgactgcgggtgccacagaggccagagcgtattccgtagagcagcaagcactctgaagggttgagctctctccaccacgagaaatggagagggttagaactcactttgagcagggagagggggagggtttttatttttatttttttccttgttattttcatcttttagggtgtggagcacgtgcacacacccacacacacccacacacacccacacacacacaccccttactgagttaccctgctctccagctcttgcctgtccacagtctagtctgactttcccagtggtccgaacagggggtgttctgtgtgataattagcaccatgacttcagcccactctacataatgcagtgctccatctgcattgacctttgtcgttgttgccccagaatagcaaaattgttagaaattcggcttgtcaggtttcactagacctgctgggtcaggcaccacgtgggtggggcagcacctaggtcctttgcagccagggactgggttgtcctaggatcggatccttcctgaggacagccatggactggactccaaacggagcagagagcagctgtctagatcataaaggtgaacaatgtcatcctgcagttagctcaaacatacacatctttgaaaacttgccctggttgtcagttgtgggtgcgggggcaagggaatggtcttggctcctgctggagccattggtggtgacacttaatagttttaagggaagagcctgcagatcttgttttgctatttcccccagcggcatcagaaacccagtttaatttagaaaaagaacaaaccaggctgagaaggttgccagagtacttgcttagagcgttaagccctggcaggggagagctatggtgggcatgtccaacatacattgttattagaccgaaggaggctttgtctccttgatggcgtccttgatggcatccttgatggcgtgcctatgtcaacagcaggcattccaacagcgtcattcactccggtctgctcactacctgttaggatgcctccaccttctgcctagcagtggaagcgggcaagttgtcctgtggcggctcatccccagaatcccagcgtgtgggaggtggaggcaaaaggaccgggagtttaagcctggtctgtctcaaaaagacaacagaccagccagccaccaataaaaaccccagtagatggtcctggaggggaaaactttctaaccctgagaggaggagcctctggtcctccatgcagcagtgtgagagttgaacctgtctcttctgctctaccatgcctcctcctgtctgtcacttaaaaagatgatcccagggttctgttccgagtaccctgcagctcacaagccaagggttgatgcccgcctgcatgagggctttgtatgtatgtatgtatgtatgtatgtatgtatgtatgcatgtgcacctgtgtgcgtggtgcttgaggcctgaagagagcatgcgatcccttggaactggagtcacagatggttgtgagccaccacgagtgggtgctaggagctgagctcttcctccggaagaacagccagtgctcatgaccacagagccatctctccatcctgtagggcttggtgtgtgcacatgtgtgtgtgtgtgtgtgtgtgtgtgtgtgtgtgtttgccaggtatggtggcttaagcctttaattccagcatccagaaggcagaggcaggtggatctctgagttcaagactagccaggtctatagctctagttccagtacagccagggctgtacaaagaaaccctgtctcaattcaccccccccaccccaatttaaaatttgttttaatctctttttttggggggggcagggtcttaatgcaactcagggtggccttagactatcatgtagctggggacaatctttattggcctccaccttgactgacggttgtggctcagttgctatcttattctgtccaaattaatacactcaaatcttacaactgtgatacagggttgtgttttaagtttccctatgtgtctgacatttttgttaatacgtatcaatctcgtaagtttaggaacgggccaaaaatctttcagtccaagtaaacggaagcttcaaacctttgccacac

SEQ ID NO: 1706 - DNA, 3016 bp, Mus musculus
atgccgacccagtccctcctcgtgtacatggacgggccggaagtcctcagcagctctctaggctcccagatggaggtggatgatgctgtgcccataaaagggccggtggcagtccccttccgagctgctcaggagaagagcatggccgtggcagagggccacatgcccctggattgcatgttctgcagccaggtcttctctcaggcggaggatctcagtcagcacgtgctgctgcagcaccggcccaccctctgcgagccagctgtcctgcgtgtggaggccgagtacctaagtccccttgataaagctctggagccaacagagccagcattggagaagagtggcgaagaccccgaggagttgagctgtgatgtgtgtgggcagacattcccagtggcttttgatgttgagagccacatgaagaagcataaggactccttcacgtatgggtgcagcatgtgcgggaggagattcaaggagccgtggttcctgaagaaccacatgcggacacacaatggcaagtctggcaccaggagcaagcttcagcaaggcatggagagtccagtcaccatcaatgaagtggtccagccgcacgcccctgggagcatctccacgccctacaagatctgcatggtctgcggcttcctcttcccaaataagcagagcctcattgagcacagcaaggttcacgccaaagaaactgtccccagtgccagcaacgttgcccctgatgaccaccgagaggaacccacgtccccgagggaagagttgctgcagtttttgaacttgagacccagatcaactgcaggtagtacagtgaagcccatgacctgcatacctcagcttgacccgttcaccacctaccaggcatggcagttggctaccaaaggaaaagtggccgttgcccaggaagaggtgaaagagtcaggccaagaaggaagcacagacaatgacgactcatgctcagagaaagaggaactaggggaaatatgggttgggggtaaggcggaagggtctggaaagtccaaaacaagtaaaagcagttgtccaggtctctcccaagacaaagagaagcctagacatgctaatagtgaagtgccttctggggatagtgaccccaagttgtccagtagcaaggagaagcccacgcactgttctgagtgcagcaaagccttcaggacataccaccagctcgtcctgcactcgagggtgcacaggaaggacaggaggactgatgccctgtcacccaccatggctgtggatgcaaggcagcctgggacctgctccccagacctcagcaccactctggaagacagtggggccggggaccgagaagggggctctgaagacgggtctgaggatggactccctgacgggctccatttggataaaaatgatgatggaggaaaagcgaagcccctcccgtcctcgagagagtgtagttactgtggcaagtttttccgttcaaactattacctcaatattcatctcagaacgcatacaggtgaaaaaccatacaaatgtgaattctgtgagtatgccgcagcccagaagacatctctgaggtaccacttggagagacatcacaaagacaagcagccggtggatgctgccgctgagtccaaaagtgaaggccggagccaggagccgcaggatgcgctactaacggctgctgacagtgcgcagaccaaaaatttaaagagatttcttgatggtgccaaagatgttaagggaagcccacctgccaagcagcttaaggagatgccttctgtcttccagagtgttctctcaccagcacacagcaacgatactcaggatttccataaacatgcagctgatagtgctgagaaagcgaggaagagccctgcccctacttatctggacatgcagagaaagaaagcaggggagcctcaggccagcagccctgtctgcagactagagggggttgggtccttagcacgggaagctggccatagggagaagatggatcaggatgctgactacagacataagcccggtgctgactgccaggacaggcctttgaatctatcccttgggccgctccacgcctgtcctgcaatctctttgagcaagtgtctgatccccagcattgcctgccccttttgtactttcaagaccttttatccggaagtccttatgatgcaccagagacttgagcacaggtacaaccctgacccgcacaagaacggcagcagcaagtctgtgctgaggaacaggcgtaccgggtgccctccggctttgctgggaaaagatgtccctcccttgtctggcctgcacaagcccaaggccaagactgccttctcaccacactcgaagtccctgcactcagagaaggctcggcagggggcctcggggccaagcaaagcaccccagacttcaggaccagacaacagcactttagccccaagtaacctgaagtcacacaggtcacaacccaatgctgggggcaccagtgccaccaggcagcagcagtcagagttgtttcccaaaggtggcgtccctgctgctatggataaggtgaagagacctgagccaaaactgaagtccctaccagcctccccgtctcagtcccccctcagcagtaataatagcaacggttctgttgagtatcccgtgaaggttgacggcccatgggcacagcaagggagagactactactgccatcggaattctggcagtgccgcagcagagtacagtgagccacatcccaaaagactcaagtccagtgcggtgtccctggacacagagcatgcagggaccaatggcagaaggggctttgagctccccaagtaccatgtggtcaggagcatcacctccttgctaccaccagagtgtgtgcgcccaccgcctgtgctgccccacaaagcccgtttcctgagccctggggaggtggagtcacccagtgtgttggctgtgcagaagccctacagtgcctctggacccctgtatacctgtggacccgtgggacacgcaggaggcagcccagcccttgaag

SEQ ID NO: 1707 - protein, 1006 aa, Mus musculus
  VARIANT (1)...(1006): Xaa = Any Amino Acid
MPTQSLLVYMDGPEVLSSSLGSQMEVDDAVPIKGPVAVPFRAAQEKSMAVAEGHMPLDCMFCSQVFSQAEDLSQHVLLQHRPTLCEPAVLRVEAEYLSPLDKALEPTEPALEKSGEDPEELSCDVCGQTFPVAFDVESHMKKHKDSFTYGCSMCGRRFKEPWFLKNHMRTHNGKSGTRSKLQQGMESPVTINEVVQPHAPGSISTPYKICMVCGFLFPNKQSLIEHSKVHAKETVPSASNVAPDDHREEPTSPREELLQFLNLRPRSTAGSTVKPMTCIPQLDPFTTYQAWQLATKGKVAVAQEEVKESGQEGSTDNDDSCSEKEELGEIWVGGKAEGSGKSKTSKSSCPGLSQDKEKPRHANSEVPSGDSDPKLSSSKEKPTHCSECSKAFRTYHQLVLHSRVHRKDRRTDALSPTMAVDARQPGTCSPDLSTTLEDSGAGDREGGSEDGSEDGLPDGLHLDKNDDGGKAKPLPSSRECSYCGKFFRSNYYLNIHLRTHTGEKPYKCEFCEYAAAQKTSLRYHLERHHKDKQPVDAAAESKSEGRSQEPQDALLTAADSAQTKNLKRFLDGAKDVKGSPPAKQLKEMPSVFQSVLSPAHSNDTQDFHKHAADSAEKARKSPAPTYLDMQRKKAGEPQASSPVCRLEGVGSLAREAGHREKMDQDADYRHKPGADCQDRPLNLSLGPLHACPAISLSKCLIPSIACPFCTFKTFYPEVLMMHQRLEHRYNPDPHKNGSSKSVLRNRRTGCPPALLGKDVPPLSGLHKPKAKTAFSPHSKSLHSEKARQGASGPSKAPQTSGPDNSTLAPSNLKSHRSQPNAGGTSATRQQQSELFPKGGVPAAMDKVKRPEPKLKSLPASPSQSPLSSNNSNGSVEYPVKVDGPWAQQGRDYYCHRNSGSAAAEYSEPHPKRLKSSAVSLDTEHAGTNGRRGFELPKYHVVRSITSLLPPECVRPPPVLPHKARFLSPGEVESPSVLAVQKPYSASGPLYTCGPVGHAGGSPALEX

SEQ ID NO: 1708 - DNA, 36022 bp, Homo sapiens
cttggggcgcctgctcatccctgaacagggatgcacggggctgcgtttcctggatgtgtgcgataaggtggcttttttttccctcctctaattttaaagatttttcttaagtcttaatgttctataaacacttaaagaatatctttacaactcaattgtagtggaacacccaaaggcagctggaagcagaactgggaactctaaagggcaggaaggattgaaatgctagcccaaaagtgctgctgctttttttttttttcttttctttttttaaagggaagtttctgccaggaggtgccaagtggtgaaaccgctcagtttcaggcacagccctcttgtctctcgatttggccccgactgcgagccggacgggatggtggagaggcggagggcgctgctgggggcccgggaggctggatttggggctgcctgggcggtcccgcccgaggggcaagacccggcacgcggggcgcgcgccggaacctgggtcccgggagtttgagaagatgttcagggcccgggttggaacccacattttgggattctgggtagggccaccgaagacgggaaggcgctttcttgggcgggtgggggtggggtgagcaggcagggagttttccgccaggtttagttacaggagctagaaaaggccacttctgggaccctggcatctgggcagccctgagagccccagaaacttttttttctttttctttccccccaccccccagaaaagggtagtcatttcaggtttaaggctttggtgtattgttctacctcgaaattccttgagcctcagtttatcttcctgaatcagtctatggggcttggagcgttgaacattcctaaacacggagaaagtaaatggcggttgcagtggtccactggccagtttgggggtcctgtattattggccactgtgtgtcctacagcgtagctaggtttttcagttttctagatcgtttggaagcattaagctgtatgttttaagaagcctaggtctgatttagttcaggttgattcaattatgtcttcattgcttttgagttggttgaatgacttgacatgagattaagctcaacaaaagaaaaggcgaggtagcaacagctgccgtccaggcctggccactaggtaggggtcttaggaggccttttaccttctcttttgtatatgtcaagaaggagatttacaatgttcttattttactgtacttctttcccctgaagtggatgttctttcttgattgatatcaaacaagacttaaaatgctaagttttatgatacttagacaatgagtaatagatgtagtttctaaaagccttgatgtgtctgcagtgacaagtgcagaggaataacctcattgctttttgtctgaaaatataacaggcaagccactagtttgtgcttacttaatgtgtgctaagaacttttaaggtgtgtccttaatggtagataacttttttccttctgggaagtcatatttattttagatattgttttgttcagggttctggagactaatagtgtttcgttttgtttcttaaccctgatgttgctgccatttttaatcggttatatttaaattcaagaggcagtaagttatttaaaatacagttgtcagtagttccaaggcagattcatcatttattttaattgttagaataggattaataatctgtttgtttggaattttaatgatttggcgtgatgaggaaagctagtcctttagaattgtctttatttgcctacagaaggaggaagtagaggacaagatatgacttttattggtgaaggacacacacttttttctttagtgtcccactcttttaatccttttgtcttcacaacacttttctaacgctttgcagtttgacctttgctgttttttagtaacttgtgagatcgaagtttagcagttgtgttgggttcctattccctttcacttcttactcaaaaaaaggaactaatacaccacttagaaaaaatttgtagaaaacttttctcccctttaccctgaggaatctattttggtaacaggtcaaaatttttttccaggtagtaggggaggaaggaggagcagtgaaggttttgactttgactgcctttacttttttaaggtgggggtagatttgcatttttctttgtgagcctccatttttggcaggaaaacttcagggaggagtaggagcccctaatccccttccagtggacttgttttggaggaaatctgaaaataagacttaatcatcaagtcacttataaactgatgaaataattaaggaatataatggcctggcaatgactaagtccttctatctcctcattgcagatacatgctaatcacttttttctctcttaacaacatttattatgaaatggcatgtttttgccacagcagggtagccatttcccaaccctggagcactcttaattctgagatgcctgattagagcctcaggggtcccaaaagatgtgctgttttcccactttataaaattacattcttttctcacagttgtcacaaacatgatattggttgataagaactttggagtagttttaatgactcttgactgcctgaaagatgccactttaaaaaaggagctacttttagctgactctatttgaaagtaaatgattggaccctttttatgttttatatgaagctttgtttccatttgcttaaaaaaaaaattcaaattgtcccatctcctgtatgcccatatggcctgtatgttatagattttgaggttgctgggtatgatttgttttaaatcgttccttcctaatttcccatttcagtttaatccctgagcggaatgtttaatgaatgaattgggaaggtgaagctgaaggactgagcaatggctgttttcaagccttagaattagaaagtaggaatgaaaaacatgagacagttgcataaactgagtattccactaataaaataaatgtaataagattttaaatccagttactacaattgaaatctaaaaacagaatagtttttagattactgggatgttaaaaaataaaaacctgaaaggtatttacagaacagctaccaacatggaattaaaggaatctcaatcttgttaaatattctaaagagggaagggtttggttacagcatgtaaattaaacttgagacaatggcgggcgggggggtcttgatccgcacacctcttctccagattctgcgggggggaggggtgttaaaatttaaacgcacatggaagaaaaaaaaaatgtattacacaaagacggcaggaaatttcttaaattcgggtgaaggaagcctgattattgaatatcacttaatggcctcattttagaggcagtataaaaacttttctgaaatgctcatgtttttggagtaaggtgaactgggttatttttccccaaccagtaataacagacaaatttgcagtggtatctggggcaaaggtttttgaatttagaccacgaggagagatagaaatctgactttaaggaagtggaagaacagggaccattctttcctaaaatctgcagctcacgatgacatgctcaattcttgtacacatctatcttccagataaataggggggaagcccccgctagccagctgccgccacatattacccttttatatttaacgttggaatgctttccatttgaacatttgttgactgactgttctgaacatctccattacttcctgtccagggtatcagcataattgagttactggaaatttggggacagtttggtaattttatgataaagttgagaaataaaattactaaacctgaaaagacagctgaagaagttgtatgagagagttagttggattccttacttagcctttgttcttattaagctttacaaaacttgtttctgacctccacatgactgtacttcctatagaaaagctcccccagactcagaagctaggtttttaacagactcgtgtagtgtttctgtattggtgttccattattttctggtgtgtctggaaacctttggaatttaaaatgtagttaagtggactggaaatgtagactctagacatttcttgaatcagcgttaggagtaatagttacttttacttctacctctatcaaataaggataacaaagcatctcagttatactgaagtgtttttgtttcttttgtaatcaatatagagtttttcttcagtttataaatctactgaacaatgattgtattactaattgaaaggagacttttccccttgattttgaaagcaaacaggtgactggaaagagccagatatacaactttagtatgtagtcagcaaaagataggatggggaggggaatatttaaatcttgcagaagaacgatcttatgccttaaaaggcattgcctaagcttgtatttaactaggttacttgaattgtgtttaattgagagcgctcattggaagaagtggtatggtgtagtggtctagtagtgggcatatgtgtgtgtgtgtgtgtgtatatatatatatatatagatagatgtgtgtatacacacgttcagtgttttcattacagagagttagtgcaggtaaagatagaacagtttattaacagttaattaatttgctgaaatcttttttttttggtgcagttaggcctgtcaaatttttacagatatttaaggttgtactggttaagtagtagtaataggagaaacggatagcaatgcttagtcttgcttaattaaagtttttaaaaattcactttccttatattataactttttttcagatcaggatgtttttaaaaaccactttgcagatgacagtatctgttaatattgaaactaaaactagtatgttatactttaagttcttactaagatcccttaactgaccttaactgatttaagatgaattcaggcagtttctagttaatgacactcaaatatgctatatgattatatttttatagtactttggtctctaatcctatttaaaattggtaatttatgaacaatttcagcaaaatgaaattatttcctttacaagcttcccaagttgaagagtttaggttgtaaccttaaactttgaatattccaatctttttctttcgcttaacttggaagcatctttccacagctaaattaggaaagttgggttgaccatttagcctcatgggtgtgacccctagtaatttccttgaaacagtgttgaagaatttagagcattaaaaataaaaaataaaaaaacctgtagctttttgattgttagtagatggctatgcagagttttctccacttgtcagattaagaaaaaatactgtgtgtaaaagacagaggaaaaactttcagagaaaatgtaaacttctagccaggtcttggagataattttgtagttttcagggtacaaatgcattggccagagaatagcaatttaagttgaattttttaataactccttatttggacacctcagtaacttgggaaaaagtagctttgttagcagtatgacaaattgtgtataaatataatttttctgtgtttttgaggactttgaataccttattcaaagctgtattatggtagatgcatattccatatcaacaatgtaagataacctgttaatcagaagaaacagaggctgtgctgtttctaaaagttaacagtttgagtacatcaggatgtaaagaaaaatattcccaagttacagtaattgtcagcaaagtggctgttgtacctagttagttgtacttaagcacagattactgtgctttttattaagcagtgtagaatgtgtcctatttgctgatttcaagatctacaggtagtggtagaattcatggtagctttagtcacaaatcagtgtgtaattagtgacctaaagaacatcacacttctattccagccttttctagcaatatggttcctactggatttcaaagattacgctctggtaaattttaaaagtatctactgaaataatcccaatagaagtttctttcaaaatatggctatactcaatagcccacttgccttaggtgttagggggtatatgagttaagttctgtcgtttacctgagtaaagattttaaaatgtttttaaacattggaaaacatttttgtgaagtacttttcagtaagcttagcgtgttcataacgctcactttcttgcaagctagaagcatttagattatagtgttggattataatatcctgcttttctcctccagttctttgtcaagaaagacaatttactttatcagcagtgccatcggtttactgctgccttctgtgtgcaggagtgtggagagctggaggcttctgggaaggcttgtgtttgtgcacacaccccattcaattggaacggtgatttgctgttagtagattagaatttctattttgctgtattctgttattaacgtctttattgttacaaccactttaacgattactgatgagcaaattggttttaagggatgtaaacctggtttaaagtattattcattgtcttagagtttaaggaagtgttttgtctagtatgttagcagtttctaagtcaagagctgaaggcatttgctgtcagagatagccctaggatgcccagcatttttgttttggagggtcataaggagagtgagtataaatccaaatagtgcagttttttttttgcttgtgctgatcaactttatggtgtgattaaatacgattttttttattacgctcttgaaattgtactcttgaagttgcagaatggcaattagatggcagtcgctgatagccatgtagaagttttgatgaacatgcaagttaattttaatttctgatcagttacggttagtgactgtggccaaacatgtggtactgattctacacgtgtgctaattccgtgacatttattcaccagctatgtgtcgagtgcctaatcctgtgtcaggcaccttgttccaggcattgggggcagcagtggacaaggcaacagtctccatcctgaggtgttacttttagaaaaagacagttacaagcaaacaaacaggatggttttagatctggacagaggttttcagaggaagtcatccttgagctgtcacaatactttgggggggtagggtgtgctgggtagtcagggatggcacatttggggtgcctaaggattgctgtggccctgggagcctaggacagttggtcacaattgactattagagtcagtctcagaagctttcctggagaaagaattctgctgttttgccaggagggtttccttccccatctgaccacacaagaagaccccttggcctagaatgcctgccctcatctccaggtctcccaggctgttcaccctcccaggcaaagtggaagcttcctctgtcctaagatcgtttcccactgaacctccttcattgtccttcaccgcagtgaaataatcctacaaggtcttgtgtggagagtgatggtaacttctttaacccagataattgagaattggaaccaaaacatctttctattaataaatattttcagtaactaagttatgctgtttccctgagtgggaaataacactccatcatatttcttatttttttgggcggagaggggagacttgctctgttgcccaggctggaccagtggtgcgatcttggctcactgcaacctccacctcctgggttcaagtgattcccaaatagctgggattacaggtgtgtattaccatgcccagctaatttttgtatttttagcagataaggggtttcaccatgttggccaggctggtctccaactcctggcctcatgtgatccacccacttcggcttcccaaagcattgggagtataggtgtgagccactatacccgtcctcacatcatatttctaatcccgagactgtagagctggtgtctctttttctaaaggatgtcagtagagaagtggagttccccaaaattacagtttcacgtattagtcaagtttctaaaatacagtaataatgttgagagctgacatagggactaacttagtttttttttttttttttttttttcaaattctcactgaactttgattttgctaaataaggacattaaaaaaaaaaccaaaaaactccactattgcctattgccactatttgattttttaaaaaataagcgtattttagcatctaaaagtaggaaggacctcaaataaatgagtctttgttcttggccagggaaaacagcgttgtcagaatttgataactgtttttctagggtatgtgctgttattcagttaaaaccttgcctgggacgctagcattcagtaaatacttgttgaataagcaaatgaaacttaagcttctatgtatagaaacctaagtcacttcacattctgattagcagagtaattgaatattcttttcaatgtgtagctctatccccagaaccacagaatattggaactgtaaaggccatcctatagtttaaccaactgcgttaaatagataatagaaagatgtggtatgtggcagtgacaacttgaaggttgtgactagaactcgggtctctggagtgttctattatatcacaccaagctggtcaccagcccatgtgttgatcctccattgtgatagcaacaaagaaaagacttcaggacattctttcctttaccctaatccttgatctgcagtcttatttagaaaagcttaatgttaaagatctagtttattcaaaactaaagataacaaggagtatgagaatttctatttcggagtgtaaaggaggagatgtttccttggcttctctgagcctgcaggccttccttgctctttaaggaagtagagagagggaggaaagtaaagtatgcttttgttttttaaggttactttgctgggagtagtttgcatgccttttggttttcttgggtggaattaactgacttaagttttaagtagttgggactatttaaaaacaatgcctatccaatgtttgccataaaggcagagggtattggctttagaagttaattcttctccaggagtgaaaattagcttctaaaccagaagcagcagagctaaataaagtaattttccacctggccagtgcatgatgtgaaaggtagattaaaaaaatgagagggcccattttctgatgaaagactaagccatgttgaaacagccctgttgaggattttattttaaatctatacattcacaaaggagctttgtgtatgtctttccctatttgttgtttggactaggaagccccacccagtgcttgttgaaggcagaaagtcgttgaaagcaagctgggatttgaacagtggattgaggtttcgaatatccagtgaaccaaaatatatcagggttcccctggccaagatgagtgaccattctgaggtgttaagtatttcttgaatggggattttaggaaaagtttctgtatttctgtgctcattttgttgacctctgtatgtgcaaaatctctaagggggtgtttgggcacttagatttcttggatgcagatttgtttgtatatgaaacaaattttaaattgttttgtatacactggatttaaaatagtttactaaagtgttttaattttttcatcttaattttcacagttcttatagtctttagatttagggaggctgttgatggcatccacatgtgcattttagtggcatttaaaatgtattcagctgaatttaacaatttctgacctaaaacttgacattttagatttaagtcggtaaagcactgatttaaactggattttaactggatgaaattctgatttaataagtgtactgactggataaaatgccaatgatttaattaacaagcacgtttaacaggatgccctatatattagttaaaagtgaagcaattgaattaggtaccttctctgctgcgtggaaaagaccgtatgactcacccacaccagccttctcttcgctctgagtgtagctaaccgtttctgttttttttcctctagggtttggaaatcccttgtctccaggttgctgggattgacttcttgctcaattgaaacactcattcaatggagacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctgggtaagctgccctgtctccgtcccgtgctgttccgcctgtgtctgtctgtctccccgtctccccctctctattcccatctccagacaacgctggccaggaatggggtttggagagccagagtcaagtccaggctctttttggtatcactctgtgtaagtcatttaacctctcagggccttaattttctcatttctgtaataacagggttgagttaagaggtctccttgttctgaaaatatatatatattttttaaacgtgtatcgttttgctcacaaaacacactttaaaaaaaaaataacttgtgcatccagcccaaatgcactgcttcttaactggggcgattttgttcccaatcagtatctggcaatgtctggaggcattttggttgtcatactgtgtgtgtgggtgtgcctgctggcatccagtgggcagaggccagggacactgctcagcatggtacagtgcacaggacagccccatcatcaaagaattatctggtcccaaatgtcaatagtttgagcattgagagaccctagccttcacttaagtttttctggcgttcctgatctttttctgtagtgaatttctagtggccataaaaggtactgggagtgatgatcaactagagccaggaatattatttgggcagccgtttggtgctgtccaaaaccttgtcctttctgtctggcaagctagtatccatttataggtacctcaggaacccaaatgatttgtcataaaatacaaggaatgtgagcacactgaagacatttttaagaaggctcatttgctcagcagaattttcagtgtactagtggcatttatagaaagagaaggtgatcactgaaggcatgctcacataatattcctgagccctggtgggcgttatctagggcaaaggattccacctgtgtttggagttgcgcccatcctcactgtagccagagcttctcctatcagagtttagtattttgtttgaatagaggatcttgctgcttaaaacagttgaaaagaccctgatgggcaggccgtaattgacaagcgaatgatgggaacatgaatcggtcttagggaagcatctgtcaaagtggtcctcggttaaaacaagtgcctcctcctctcagtgtcacttgattgtgtgcttgaattcttcggaaaactgggtgtatgagacccacgatgaatttgcccacacgattgattggactcttccttcacctgctcttcagccagtgccagttccttttctgatcatgtgattgacgtgagaactgtagtctgtatatcaaatctttagaatgtttttgagtttcctgggacacaggaaacccagcacttagcatactacaaatctaatgtcttaatggcatcataaaaagaggctttaaacacagactccagttagctaagtggtttctgctagtgccggtactgttgcaggggccctgtgagatgccccagttccctgaaagaaatgaaaaggccagttaccggtaggtggtgtggaaaacatgggctagatcatcaggcaggacagaatgcctggctgtgggtgggagcaccccagcttggcgttgagttctggttctaccactgcgttgttttgtgaccaattatgagttgcttaacctttctttgctactatttccctgtttgcaaaatggttcattgacccctgtcttccacctcccaaggacaatttcaacagcctatttgtaaaaagatcacagtcctttaaaaaatataactgtaaagtcagaggtgatgcttgaaagagcaggaaccaggtagatgtggaaatgtcatgtcctttgttctaaagaaaaggcatttcatagctttttggatatgacgcaacataccataaatcctgacacatagttgggagtcggaaattgcaacaacgcccagttataaacccagctagtttgggtatgattgtaagaaaaaaaagctggccattctgtatttggggaattgattttcctaaacttatattatcttagtagtctagatttatcatattgtactatcatcctggcttttttaagacttaagaagatcaagtaaatttttttttctttctttagacactatatagatcatcaagggtgtctgtcttacaggtggatagtgatatgatctacagtgaggggacatttatttaaaacttaaacattcatgtgttttgggggtggtattttaacggcagcacctctgattgtcttttggagggctggtgtgtgtttgaagttctgtcctccttccagtggactctaacttctcctgatgcacgtgagacacattgtcctattgtcctgcagaaactaaagccaaacactgtcatttggggacaggttttcatttgtcagatctctttcgcccacatgagtgtttgtggacaatacagcctgctttccaaaactttgctaaattttgacagactttcctaggtgcttgcccaatgccagactttcttttctgttgaagattaagttgtgcttgctgccctctagtggtcagttgtttaatcctaaccttaaacggcttatttttcccctggtggttgggaagttgacggtttgtaattggctcatttttctaaattattctgaagaagataatttttcccgccagtatgtatgtccaccttcagtttgccagatcctgcctgctcagagacactgagaaccggaagctgcccgggcaattcagtctatgaaatgatctttcttgtgattaaggcaaacgaagaactgaatgtttaatagtgtactctgctgtacccagaaaaaaacaaaacaaaatcatgttataacactctaaaacttcaaacaacctccaacagcatttggtgtgtgtctagccgttttgttctaacccgatgttatataaaagaattttttcatgctttccaaaaatgtttatgtcaagaatatttaagtcagcatgccttattcaggtacttcagctaccttcttatataaatatttttgtttttcctttaagataaaaatgatgatggaggaaaaataaaacatcttacatcttcaagagagtgtagttattgtggaaagtttttccgttcaaattattacctcaatattcatctcagaacgcatacaggtaaagaacttttatttttttaaccatgcattagttaaattatgtagttatctaatttttttgttgttgttgttcagatactctgccagatccttggactagcttaaggataaatatgtagcatgttgattgcagtggttatttttattcttttagtgccattgtaacttgagccattgttcttatttgcagttcatttcttttctttcttttttgttttttgagacggagtcttgctctgtcacctcggctggagtgcagtggtgcaatttcggctcactgcagcctccacctccctggttcaagcaatactcctgcctcagcctccccagtagttgggattacaggtacctgccaccacacccggctaatttctgtatttttagtagagatggggtttcaccatgctggccaggctggtttcgaactcctgacctcaagtgatccgctcaccttggcctcccatagtgttggcctcccatagtgctgggattacaggcgtgagccaccgcgcccggacaaagttcatttgtttagtttatgactgctatgtcctgactcttatcttattaaaagctacagtattttaaaatgctgcatcttatgtctttatgattgagaatgaaatgagaatctatttagtagtcttgagattgtgaaaggagctatgacatcatgatgtaggaggctgcgtagatttgaaatttcatctcttccacttactatctgtgcacccttgggcaagttatttaacctttttgtgcttttagttttctttgctgtaaaagtagaataatacatatttccctagggctgttaggaagattaaataagttagaagtgttgctgttaatttttctattgaagataggcattcataatttcaaatattcattacagtaaggatgataaagaactgatgagaaatcctatgtgatagtagatcgagaaagcaaaaggaggaaagaagcctgttttcttaataaatagatatttgatctatttcagtgcttttcatacacttctataataaagtgccatttcttgccttaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggtattgcatgaggggcgtcgtgtttaaatggctgcctacagtgattaatagctaatccaggcattctcagtggagatggtaccactcccaagggtggggggtaggcagccagaagttcttgggggtcacagagagaagcattcttagatacggcagtggtttgtggtcctccaaggcttacttaactctgtgggtttaactcttaaccctgtgtattttattcttttgatttgtttagtcttactttatttttagagaaagggtcttgctccgtcatctagattggagtgcagcggtgtaatcatagcttactgtagtcttgaattcctgagttcaagagatccttctgcctcagcttcccaggtagctgagactatatgtgctgctaccatgcacagctgatttttaaattttttttgtagagatggagttgcccaggctggtcttgaactcctggcctgaggtgatcctcctgcgttgacctcccaagtatcttagactacagatgcactccaccacgcttggctaacttaaatttatttttttgtagagacagggatttgctttgttgcccgggctggtctgaaacccctggcctcaagtgatcctcctgcctcggcctcccagaatgccagcattacaggcgcgagccaccatacccagccttattcttgagtaatttttcttgtcaattttatttttctgttgtgagagtgatcatggaaacagtgggtgagaacactggtctgtctagtccattcttgtcttgctgttgaaattccagatgcagccagttgaggccccagcttgcctcacttcatcacagccctttttcttcctttgcacatgtatggtgtgctcagtagtcagtgccaatccacctggagttgcgggggttttttttttctttctttctttttttttttttttttgagacggagttttgctcttgttgcccagcctgagtgcagtggcacgatctcggctcactgaaacctccttctcctgggttcaagcaattctccagcctcagcctcctgagtagctggggtaataggcacgtgccaccacgcccggctaattcttgtatttttagtagagacagggtttcagcatgttggccaggctggtcttgaactcctgacctcaggtgatgcactggcctcggcctcccaaagtactgggattacaggtgtgagccaccgcgcccagcctaggggttcttcctcacgcattttaccattccctgctggcctgtaaacttcttaagagcagaaaccatgttttacatgtacagcatcaagtcacatgcttcccacacggggcagaatagggggcgcccagtaaggaccacacgtggacccttgacctggcaagagcagaaagcaaaagaacttccgattaaagagtcttgtgaaccgttttgctgttaaatgttgtcagccctccatatccttgggttctgcctcagtggattcaaccaactgcgggactaaaatatttgggggaaaaatggatggtcgcatctgtactgaacatctgcagttttcttttccttgtcgtaattccctagataatacagtataacaactatttacatagcatttacttcatattaggtattataaataacgaagagatgattttttttttttttgagatggagtcttgctctgttgcccaggctggagtgcaatggtgtgatctcagctcactgcaatctctgcctcccaggtccaagcagttctcctacctcagcctcccgagtagtttggatgcaggcacccaccgccacgccagcctaatttttgtatttttagtagagacggcatttcgccatgttggtcaggctggtctcgaactcctgaccttaggtgatcctcctgtcttggcctcacaaagcgctgggattacaagcatgagccaccatgcccagcagtgtagagatgatttaaagtatatgggaggtgctggatgtggtggctcacatctgtaatcccagtactttgggaggctgaagcgggcagctcgattgaggccaggagttggagaccagactggtcaacatggtgaaaccccgtctctactaaaaatacaaaaattggctgggtgtgttggtttgcacctgtaatccgaactgtttgggaggcttaggcatgagaatcgcttgaaccggggatgcgcagattgcagtgagtaagtctagattgcactgttgcactccagcctgggctaaagagtgagactctgtctcaaataaataaataaataataagtaagtaaagtatatgggaggatgtgaataggttacgctacaatactgcaaattaatagtactacaaggccagttgcggtggctcacgcctgtaatcccaggactttgggaaacagcctgaccaacaatggagaaacctcgtctctgctaaaaatacaaaattagctgggtgtggtagcgcatgcctgtaatcccagctactccagaggctgaggcaagagaatcacttgaaccttgggaggtggaggttgcggtgagctgagattgtgccattgcactccagcctgggcgacagagcgagactccatctcaaaaaaaaaaaaaatagtactacagatactatgaatactgcagatacgacactgttttatattagggacctgagcatccatggattttggtatctgttggctggggtggtgggggcgggtggtcctggagccagtgccctctggatactgagggacaactgtattaatttaaaaccaaccttatttcccccataggtagattgttaacctcatagatgactggggttttccccatagaaatgtgtcctggtggtgtcacttcgtacaggtgtctggcacatacctgtatgtgtaaaaaagtagctcagtgtcccagggacatcttctccttggcaaactcggtcaaactgcagcatcttcctttatcacatagaagctctactggtttgtgctccccaaagaaacagattcagttttgcacatttcagtttgtgttagtttcaaactgaggattctgtgtggtgacaacactctgtcaagaattgcttgatgctgattggttcagtagagatagcaaattaaaaaacaattgctttcagacactccagtagattttataaaaattgtgatgaaatagtaatttttactgccttttggttaaaaatcttcatttccccccccatggtgcttaaaatggacatgaatcaaaactttgtctttacttaaagggggaaaaggctctgtgtgttgcaagtcagatcctcttttttttttcccctcctctgtgagacagggtcacactctgttgcccaggctggagtgcagtgggggcaatcacggctcactgcagcctcgacctccgggactcaagcaatccttccatccttccgtctcagcctcccgagtagctgggactaaaggtgcatgtcaccatacccagctaattttttatttttagtagagaagaggtctcaccatgttgcctatgctggcaaatccccttttaaatgattttaaaaaaagcaaaaaacaacacttttacatagtttggttcatgatgcatatacgtttcaagtattttgtgatgtcatttttttccggctttttaattctttctagtgacagcccagacaattttaatgttagtgacatcaaccaaattctgtgctaacaagtgtcataaaaacaattcagctgtaactgaaaacacttgcatgcgactgtgtgacttaggcgttgattacattatcagtgtcagaaattttgaaaattgacttctaaaaacctatacacatcttacctaattgtttgaccttaactctaaatatgttttttttttcaatcaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtgagcatatgtttcaattaaaaacactggattggctgagtgcggtggccatttgggaggtcagggcgggcggatcacctgagatcgagcatttgagaccagcttggccaacatggtgaaacccctgtctgtactaaaaatacacaaatttagctgggcgtggtggcgggtgcctgtagtcccagctacttaggaggctgaagcaggaaaatcacttgaacaacccaggaggcggaggttgcagtgagcagattgtgccactgcaggtctagcctgggtgacagagcgagactcagtctaaaaaaaaggggggggggggcggggattgattttacttgatcggaaataaaccattaagttgtctaatataatgtaacaaaattgcttttaagttggattttgattttttaggtgttttaaaattagagtcctcaggatctttggatattactgaagataataggaaaacagtcatagtgactggaatttactgagcatttactttgtgctaggcattgaatgaagtgttttattatcaggatctcatttaattctgttgcagcagagggcttaggtaagggatgagcaaactagcttttcatgcatcatcatcaataaagttttattggaacatgatcatgcccatctgttacatattgtctgtggctacctccttgctgcagcagcaatgtcgggcagttgtgacagaccacgtggcctgcaaagctgaaactatttaccgtctggccctttacagaaaaagtttgtgacccagcattaggaggtactgtgcatgcttttcagatgagaccgaggcatggattatgcagtttgctcaaagccccgctctgcctgtgagaggcaggagcctggtttttgtcctaggtctgcaaagatccaggctctatgcccaacgttctagtttaagaacttgttcaaagacttggcaagtacttatctgccaagataagtacttatctgccaaggaggggaactgggacaggagcaagtatgtgagcatgtggttcacatgttaaaggtctcactgtagtgcaccgccgtcccgtaaggctcaagtagtagtatcagaattatgcatgttggttttgttagtttatatttagttaattagtttgggcagaaggtgtgatgtctgtgtacaggttatactatgactcattcaacaataagattaaatggaaagcttggggctcacgggcagatttagttgttcctcaggtaactcttgtcccgtaaaaccgtcactgtatattcgttgagcagcctcttcaccaagtgcctgctggctgctaggatacgaagatgaaaagatgctcgtggtccaggacagaatttctctgtcatattttcatcgggactcatatgggaactgagatgacgttctccctgggcagcgtgagccttgtgtggttctgcagtcttttctcctgcttaggataatagatgaagaacacgagggagtaaagctttgtcatcacaggaataagatccagtccactctatattaaaacataaaaataatttatgaattatgaggagcagattttagtaacaggttactcgaagcatccattacaactgatcagtagtagcaaacagccatgctcctgtatctggagctggtgtctctctgggagctctgagcttctctgcttgtgtttccttcatctggagaacatcctgcctgctctgtctttgctttccagcctcttctttctcatcctctggaccagctcacatattggttttgtttgtctgagacagggtctggagtgcagtggcacgatcttggctcactgcagcctcaaactcctgggctcaagcagtcctcccaccacagcctcctgagtagctgggattttcttgtgcatggcaactgccttttactgaattctgattcttggttaagtcatctcagttaaattactaaaagtagctccaaagttcgcagcattatctagttagtcattctcctaatactttcatagcaaaagttgaacttaaatagaacccagggccaggcgcagtggctcatgcctgtaatcgcagcactttgggaggccaaggcgggcagatcacttgaagtcaggagttcaagaccagcctggccaacatggtgaaacccttctctactaaaaatacaaaaaaattagccgggcgtggtggtgcatgcctgtagtcccagctacttggaaggctgaggcaggagaatcgcttgaacctgggaggtagaggttgcagtgagccaagatcgtgccgctgcactccagcctgggcgacagagtgagactgtctcaaaaacaacaacaacaaatagaacccattgcatttctaggtcagtttggttctatgtattacgcttttttaaagaaagaattttctaaactgtattcagttttgatcttaatcatttaaaaaatgtttttttccttaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctatcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaatttttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaatcttgagttttagtgtttattgtgtttctggtttctgattttgttttatttaactttttagttttctttctttttttttttttgagatgtgctcctgctctgtcactcaggctggagtgcagtggtgcaatcacagctcactgcagccttgaacccctgggctcaactgatcctccagctctcggcctcccgagtatcgagccatcatgcctggcttataaacacaattttaaggccagcacgtggctcacgcctgtaatcccagccctttggaaggccaaggcgggtggatcacttgaaaccaagagtttgagaccagcctggccaacatggcgaaaccccgtctttactaaaaatacaaaaattagctgagtgtggtggtgcacacctgtggccccagctactcaagaggctaaggcatgagaaatcacttgaacccgggaggcaaaggttgcagtgagctgagattgcgccagtgcactccagcctgggcaacagagcgagactccatctcaaaaacaaaaacaagaaaaccccacactctttttcttttttctattttttttttttttttgagatagggtcttgctctgtcgcccaggctggactgcactggcgcaatctcgcctcgctgcaacctccgcctcctggattcaagagattctcctgccgcagcttcccaagtatctgggattacaggcgtgtgccaccatgcctcgctaattttggtatttttagtagagacagggtttcaccatgttggtcaggctggtcttgaactcctgacctcaagtgatccgcctgcctcggccccccaaagtgctgggattacagacgtgacctaccatgcccagcccaccaaccttcttccttaggattttagctgccattgatgttgcaaaagtcacttttaaagacttcttaaaattccacatctgttaattgaaattctattaagaagagcttccttatgattatttggttaccctgaaacacagtttcaaccaaaaaaaggagaaatgctcgttttgtttgttttttattcctcttgattaccagctttgaggatgagttggtgccagcattctccagaggtgacccaggaataagcttttacatttttggtatgagctcacaagtcttatacacttgatgtgttgagagcatgtggtcgtcattttgatgcctcaagtctcttgtttttggtcagtgggagttccaagttggcccagtgtttgcaggacaaaagtctgaaggcttcttaactttttgttaaaacatgttctggctgggcatggtggctcacgtctgtaatcccagcactttgggaggctgaggcgggcggatcacctgaggtcaggtgttccagaacagcctggccaacatggtaaaaccccatctctagtaaaatacaaaaattaactgtgaaaccccgtctctactaaaatacaaaaattaaccaggtgtggtggcaggtgcctgtaatcccagctactagggaggctgaggcaggacagttgcttgaactcgggaggcagaggttggagtgagccgagatcgcaccactgtactccggcctgagcgacagagcgagactcagtctctaaaaacaaaccccaaaacaaaaccggagatgatccaaatcccacctgtactgacccacacctgggaaccgtcatttatccaaggatcctgggttccttttatgggaagcggtaattagggcagtttgggcgcaaggggcatttagtcctacctgggtggttgtgctcctggcctttttaatgtagggaaaggaaataaatattatcaaaaaggaaacctcagtgaattatactgctatttccaactcacgttttagagttttctttgattttgtttttgattttctgaaaagctgggttcctggctttaacctactgtatataacagaaacaatgccaatgttattgctcttatcactgcccaatgaacctttcagatttctcttttgagttggagtctcgctcagtctcccaggctggagtgcagttgcgccatctcagcacactgcaagctctaccttccgggttcacaccattctcctgcctcagcctcctgagtaggtggaactacaggtgcctgccaccacatccggctaattttttttgtatttttagtagagatgggatttcactgtattagccaggatggtctagatctcctgacctcatgatccacctgccttggcctcccaaagtgctgggattacaggcgtgagccaccgcgcccagcctaaagtaaccatttttaaaaattattatttttttctaagaatgagtctcgctctgtagcccgggctggagtgcagtggcacgatcttggcttactgcaacctccacctcccgggttcaagcaattctctgcctcagccttccgagtagctgggactgcaggcgcatgccaccaagcccggctaatttttgtatttttagtagagatggggtttcaccatattggtcaggctggtcttgaattcctgagcttaggtgatccatctgtctcagcctcccaaagtgctaggattacaggtgtgagccactgcgcccagcctaaaaattaatttttgatttatcttttcattaattctttttgaaaatacaggcatatttgcaggtctatttatatctccctttcttatttaaaaaggagtttacagtccacactagcacaggctgattttagcactgtttcattgttttcctggagaatgaaacagcacacacacacacacacacacacacacacacacacacacacgaaaaaaacgctgaaaaaaaatttttttttaaaagaacacggttttctgctgaacatcaaatgactcgaagaaatctactttggagaggttgaagttggtggtcttttctctacctgcttttatttcttcagtatatctttattgagctttcactaagtgccaggcgcttagggctagtactggctgggtgccagggacatgtgtctcatgaaccaggtagcatttcctaccctcttggggctgtctttgtggggttgctggtggtggaagacattgaaaataggtcatcatggctgggcgcggtggctcatgcctgtaagtctagcactttgggagccccaggctggtggatcacttgaggtcagaagttccaaaccagcctggccaacatggcaaaaccccgtctctactaaaactacaagaatttgccgggttttgtggtgtgcgcctgtaatcccagctacttggaaggctgagacacaagaattgcttgaacctggtgggaggaggttgcagtgagccaagatcgtgccactgcactccagcctgggtgacacagcaagactgtgtctcggaaagaaaagggctggggaaggggaggggaagggaagggaagggaggggaagggaggggaggggaggggaggggaggggaggggaggggagaaaaggtcaacagaccagttatggccctgctgtagtggctggggaggaaatcagcaggagactgagaataattaggagaacccacgagagctgggtggtcaggacaggacctaacaggtcctagaggatgaaaggaggtggccatgtaattaatgctttataaagaatcttggccgggcacggtggttcacgcctgtaatcccagcactttgggaggccgaggcgggtggatcacgaggtcaggagattgagaccatcctggctaacgcggtgaaaccccgtctctactaaaaataccagaaaattagccgggcgtggtggctggtgcctgtagtcccagctactcgggaggctgaggcaggagaatggcatgaacctgggagacggagcttgcagtgagctgacatcgcaccactgcactccagcctgggcgacagagcgagactccgtctcaaaaaaaaaaaaaaaaaaaaaaaaaagaataggttacagctattgatatttaccttaatagatatggaaaactattaaataatttacaaattcaagaacaacaataatcccactacatgttaatataaagaaaatttggccgggcgcagtggctcacccctgtaattccagctctttgggaggccaaggtgggcagatcatctgaggtcgggagaccagcctggccaacatggtgaaaccccgtctctactaaaaatacaaaaattagcgaggtgtggtactcacctgtaatcccagctacttgggaggctgaggcaggagaatcgcttgaactcagaaggcagaggttgtagtgagctgaggtcgtgccattgcaagccagcctcagcgaaagagtgagactccttctcaaaaaaaaaaaaaaaagaaaagaaaatcttttagtcagggatggtggctcttgcctgtaatcccggcacttctgcaggccgcggagggtggatcgcttgagcccaggagtttgagaccagcctggggaacatggagagacctcatctctacaaaaaatacaaaaattagccggccatggtggtgcatgcctgtagtcccagcactttggaaggccgagatgggaggattgcttgaggccaggagctcgagaccagcctgggcaacagagtgagacctctgtctatacataaaataaaataaaataacaaaattagctgggcatggtgttgcaaacctgtagtcccagctactcaggaggttgaggtgggaggatcacttgagcccaggaggttgaggctgcagtgagctatgattgtaccactgcactctatccagtctgggcagcagaacaagaccaactcaatggaaaaataataataacttgtttttttttttgagacagagtctcactctgtctcccaggctggagtacagtggtgcgatcatggcttgacctgggtttaagggattctcccacctctgcctgtccagcagctggaactacaggtgcttgccaccatgcctggctaatctttttttttttttttttttgagacagaattcactctgtcacctaggtgcagagtgcagcggtgtgatcttggctgattgcaacctctgcctccctggttcacctcagcttcccgagtagctgggattacaggtacatgccaccacacccaactgatttttatatttttagtagagaaagggttttgccatgttggctaggctggtctcgaactcctgacctcaagtgatctgttgccttggcctcccaaagtgctgggattacaactgtgagccacttcacccggcctaatttctgtgcgtttttttttttttttttttttttgtagaggtagggtcttgctatgttgcccaggctgggtgagttttgcaaaatggttatgtgtgtgaatttagctgaagcaataacgaggatttggttgcattgggaaccaaaccagtctctagttatgaagaaggcaatgagcacaacacacttctgccaaattgtaggggagaagtgcgttcttgaagaccatcaataactgaatatctgaactattcaaggctatttttctcaatggaactaactgaccaatgatggggcattttacttagtgccataaagtgtcacctccaggtggcacgggtgttaacaaagtttgccagttccttgttctaccagctttgaaattcaactttgatagttgagcaacttttcaaagatggaacatttgtgttatttcaaatgctgtggggaacatttgtgttatttcaaatgcggcagaaaagatgaaactctattagtaacgcttttaataaactttaaattttttataattcaaaaaaaatttaaagttccttgagctagcttgtatgttcattacctagtgtagtccttgtgcttagtgattgtaacagcagagcaaaatgacaccgctgttatatggatatttatttccagtgatgccaaaagcccagtttttttttctttctttcttccttccttcctccctccctccctttctttctttccttccttctttccttcccctcccttcttccttccttccttgtttttgacagtcttgctctgctctgtcacccaggctggagtgcagtggaatgacctcggctcactgcaacctctgcctcccagggttcaatcgattctcctgcctcagcctcctgagtagctggtattataggcatgcaccaccacgcctggctaatttttgtatttttagtagagacagggtttcatcgtcttggccaggctggtctccaactcctgactttaagtgatctgcccgcctcagcctcccaaagtgctgggattacaggtgtgagccaccactcctggccccaaaaacccaatttaattaaaagaagaagaaaaaaaggaactctcactgccattgtgttctccactttgccccaggtgctgggctctgagagctccaggggcagggcttgtattttctagggaggatgtaaggcaagaaagcccaggggaaagtaaatgaccctgggaaggaggagtcaagtcctaagagacaggatttggccctggagggaaaagggagaaagccagtcctgaaggaagggaaggagttgctcaagctccaggcggggtggggttgagcctggagccgcgctcccctctcctggttctctcaccccttcctcctgccttcttctctccccacttctcttccctctatccctcatttgcagatggatccatcaagaacttctgggccggatgcagtggctcatgtctgtaatcccagcactttgggaggccgaggcaggcggatcacctgaggtcaggagttcgagatcagcctgaccagcatggagaaaccccatctctactaaaaatacaaaattagctgggtgtggtggcacatgcctgtaatcccagctactcgggaggctgaggcaggagagtcacttgaacccaggaggcggaggttgtggtgagctgagattgtgccattgcattccaggctgggcaacaagagagaaacttcgtctcaaaaaaacaaaacaaaacaaaaaaacttctggaaatggaccaggcttagtgtggtttgtgggacctaaagatgactagcaaggaaaatgatccaactcaccattcgccccaaatgggaatgaaactcaggatgacagagatcacaaggcttcttgaacttctattcagatgcaactttatttgttttgttttttgtttcgttttgttttgagacagagtctcactttgtcttccaggctggagtgcggtggcacaatctcagctcactgcaacctctgcctcccaagttcaattgattctcatgcctcagcctcccgagtagctgggactacaggtgtgtgccaccacacctggctaatttttgtatttttagtagagatggggtttcgccatgatggccaggctggtctcgaactcctggcctcaagtgagccgcccaccttgacctcccaaatgctgggattacaggcatgagcaactgtgcccagcccagatgcaactttaatgccacaaatacctccttgggtgtgccatgtgatatcaattattctggttacagattttcttaagtagagaaataatggtagtacatgaacaataataccaatagtttggtactttaaaatagcataaactggccacggtggctcttgcctgtaaacccagcactttgggaagccaaggtgggaggatcgcttgagcccaggaattcaagaacagcttgggcaacatagcgagacctcatctctaaaaaacaaacaaacaaacaaagtaaaatagcaaaggtgcaaaagcctgccaagaatggaatggatgagtaagctgtggcatctccttgcagtggtcagtatacagtgacaagaacggatgatctacaatcatagagcaacatggagaaacttcgcaaacataatgcagagcaaaagacgccagacacaaaagactgtgttccgtatgactccactcatgcaaatgacaaaaatgggtagcactagcctatgctgctggaagtcaggatggcgtgtgcgctgctgctggtggtgggcaaacagcaagcaggtacagacacgcttgggattctagacctttcgttccatggtctgggtgctggtttatgttgtgaaaataaattgaagtctacacttatgatttgggcactttttgtgtgtatatatatgtatatatacatatatatgtttgtgtatatatatatacacacatatatgtatgtgtgtatatatatatgtgtgtgtgtgtatatatatatatatatatatatatatacacttcagtttttttgtttgttttacagagagggtctcactctgtcactgggatgctggggtgcagtggtgtgatcatagctcactgtagcctccaactcctgaggtcaagtgatcctcctgcctcagcctcctgagtagcttagactacaggaatgcaccaccatgcttgactaatttttaaaaatcttttaaaaacttttctttggtagagatgatctgttgaccaggctggtcttgaacttctagcctcaagcaatcctcctgcctcagcctcccacagtactgggattataggcatgagccaccaatcctggctgtattatacttcaattttaaaaaaggaaaaaatagcagagtaaagtatgaacaaattgaggttatgactcacaatacacctcctttttttgttttttgttttttttttttgagacagagtgttgctctgtcacccaggctggagtacagtggcgtgatctcagctcactgcaacctctgctgcctaccctgccgcccgggttcaagtgattctctggtctcagcctcccaagaagctgggactataggcacgcaccaccaggcccagctaatttttgtaatttttagtagaaatggggttttgccatgttgaccaggtggtctcgaactgacatctggtgatttgcccacctcggcctcccaaagtgtttagattacaagcgtgagccaccacacccagcccaattttcattttattttattttattttttatttttattttttgagatgaatcttgctccgtcgcccaggctggagtggggtggtgctgtctcggctcactgcaacctccacctcccgggttcaagcaattctctgcctcagcctcccgagtggctgggattacaggcgcccaccaccatgcccagctaagttttttgtatttttagtagagacgtggtttcaccatcttggccaggctgttcttgaactcctgacctcatgacccacccgccttggcctcccaaagtgctgggattgcaggcgtgagccactacacccggcctattttattttatttttgagacggaatgtttctcttgtcgcctaggctggagtgcaatggcgcgatctcagctcactgcaacctctaactcccgggttcaagagattctctcacctcagcctcccaagtagctgggactacaagcatgtgccaccatgctcagctaatttttgtaatttttagtagaaatgaggtttcaccatgttggccaggtggtcttgaactactgacttcaggtgatctgcccaccttggcctgccaaaatgctgagattataggcgtaagccaccatacccagcccaatttttagcttttgctctaggtgtgatgggaagctgtggggaggtttagcagagggtttaagtgactggacttagcacagctgtgttttccatcatggtgtctgacccgagggccattgcatcattgatgttaattccaaatgaggctgaatattcatgcggagacaccgacggggttgaccggagctgctcctcccacctcattgaacttgattgccatttctggaaggcttcatctgtcagtgcccccgacccccaggaggagggttgggagggcttcctagaagaagagctgtctaatctgaggcttgcacaaggatctgggagggtttgcaccggctgttgcctctgaacttccctcttgggaggaggttaaaggcaacaaggcac

SEQ ID NO: 1709 - DNA, 5252 bp, Homo sapiens
tgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctatcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaatttttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttg

SEQ ID NO: 1710 - protein, 1061 aa, Homo sapiens
MQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEPAVLRVEAEYLSPLDKSQVRTEPPKEKNCKENEFSCEVCGQTFRVAFDVEIHMRTHKDSFTYGCNMCGRRFKEPWFLKNHMRTHNGKSGARSKLQQGLESSPATINEVVQVHAAESISSPYKICMVCGFLFPNKESLIEHRKVHTKKTAFGTSSAQTDSPQGGMPSSREDFLQLFNLRPKSHPETGKKPVRCIPQLDPFTTFQAWQLATKGKVAICQEVKESGQEGSTDNDDSSSEKELGETNKGSCAGLSQEKEKCKHSHGEAPSVDADPKLPSSKEKPTHCSECGKAFRTYHQLVLHSRVHKKDRRAGAESPTMSVDGRQPGTCSPDLAAPLDENGAVDRGEGGSEDGSEDGLPEGIHLDKNDDGGKIKHLTSSRECSYCGKFFRSNYYLNIHLRTHTGEKPYKCEFCEYAAAQKTSLRYHLERHHKEKQTDVAAEVKNDGKNQDTEDALLTADSAQTKNLKRFFDGAKDVTGSPPAKQLKEMPSVFQNVLGSAVLSPAHKDTQDFHKNAADDSADKVNKNPTPAYLDLLKKRSAVETQANNLICRTKADVTPPPDGSTTHNLEVSPKEKQTETAADCRYRPSVDCHEKPLNLSVGALHNCPAISLSKSLIPSITCPFCTFKTFYPEVLMMHQRLEHKYNPDVHKNCRNKSLLRSRRTGCPPALLGKDVPPLSSFCKPKPKSAFPAQSKSLPSAKGKQSPPGPGKAPLTSGIDSSTLAPSNLKSHRPQQNVGVQGAATRQQQSEMFPKTSVSPAPDKTKRPETKLKPLPVAPSQPTLGSSNINGSIDYPAKNDSPWAPPGRDYFCNRSASNTAAEFGEPLPKRLKSSVVALDVDQPGANYRRGYDLPKYHMVRGITSLLPQDCVYPSQALPPKPRFLSSSEVDSPNVLTVQKPYGGSGPLYTCVPAGSPASSSTLEGLGGCQCLLPMKLNFTSSFEKRMVKATEISCDCTVHKTYEESARNTTVV

SEQ ID NO: 1711 - DNA, 29377 bp, Mus musculus
  misc_feature (1)...(29377): n = A,T,C or G
gtgtgtgtgtgtgtgtgtgtgtgtgtgtgtgatgttctataggcgtacatgccatagaccacatgtgaaggccagagagtcaggtctcaggtgtggacagtgagccccctcaccagctgagtcacctgccctttctctctcagagtctcttaccttacactggactttgtttgctatgtagccaacatgtccctaacacctcccaagtgctgggatttcagctctgtgccatcatccctggtttatgagatgatctcaggctcaaacccaggttcttgtgaatgctaggaaagccctctaccaactgagctacgtaaccagactctcttttccaaagctgttttctctgtccctctttgtccccgcggagaggaggaatacataccaaggctttcccaacactcccaccctccacccaccagggttacctgggaatacgggcagtaactacaaacagtgcatcttaggttggggacacctcaaagcatatatatatatatgtgtgtgtgtgtgtgtgtgtgtgtgtgtgtgtatggatatatacatatatatatatatacacgtatatatatgtatatatatatatatatatatatatatatatatatatatatatatatggagaagttgtagggaagaagccatgatctgcagctgaactggggcaggacagcgccccaccccaacccccactccctccactgtctaagacagggctctaattcttcctctgatatctaattcttcctctgaaccagtggaggctgttcccacaggcaacagaaaacagctcagggacccacaaatggtgatgggtgaagtgctgttacccaaaggcagagcctaggaaccaggacaccctccagcaagttgggagccttttcccactggctgccatcaccatccccccccacccccgacgccccctgaccctgtctgctttgctgaggaggtctgcgcttgagtgttactggacagtgaatctcttttttcttcatatgttgtctgggtttgcagccatgtgctgagtaaccctgagaaaaggaaccttgagaagcgccagtcttggccctggtgcccacgagaacttcccccggaacagttcgaaagtgtcggggttttttctttttatgggtttcacagtaaaaacaccaatgtctgaaacaaaataagaagcacaaccatgcaaacatccatgcatgaaggttttttttttcttttttttacatgaagtttattaacagctacttttttggttggttggttggtttttcgagacagggtttctctgtgtagccctggctgtcctggaactcactctgtagaccaggctggcctcgaactcagaaatctgcctgtctctgcctcccaagtgctgggactaaaggcgtgtgccaccacgcccggcaataggtacattttttatgtttatttgtgcatgtgctgtagtacatatggtagagtcaaagggcagcccgcagatgttctctccttccaccttgtgggtcccaggaattgaactcaggacattggcttcatctcaagagctgttgcccaccaagctatctgttcagcccagaaactttattggtaaatactgaaacctggaaataaccaaaatctgctaccaggtgaatgaacagctaggccaactaagtggggagtcacgtatagctttgcttgcttgtttacctcggggctggagacccaacccaggatgtgcgcatttgcagctcctgagccacgccccagccacacaggtaaatgctggtctttcccacgagaagctatggaggggttttagaagcaccttgctgaaagaacgttcccacagggagctgctatgtcccagggtctgaaacagggatcaaaacagctcagcaggttcttagtgactttgggaggcagagaacaatgaacataagatacaaggctcttcatttcactctgactcagatgaaaacacacgacatgggcccagcagcctgagcctgaagtccctgccctcagaaagcagcagctgaagaattaccataggatagacaggagtctaacctgatctgcatagtcagccagagtagtcaatgttccagtaagaacctgtccccaaaccaacacagtacaaagtcagaggctggagagctggccacacagtcacaagcctgtactacaggctggagagctggctcagcagttactagcactggctcttctggaggtcccaggttcaattcctatcacctacctggcagctcacagttccaggggatctgacatcgtcacatagacacacatgcaggcaacacatcaatgcacatacaataaacgtagtaaaattaaaacataataacaatgataaaccctctactgctcttgcagaggacctacattcaattcctggcacctagaagggcagctcacaatgacctggaattccagctccaagacatccaatgccctcttctggactccatgggaactgcactcatatgtgcacaccgtcctttgccccacaagtacatccaatttaattaaaaattcttagctgggtggtggtgctgcacacctttaattggagcactggggaggcagaggcaggcagactctgagttcgaggccagcctggtgtacagagtgagttccaggacagccagggctacacagagaaaccctgtctcaaagaggaggtggggtgggggtagggaggcagcgtccaagcgattctgtatcagcttgggctgacagggtttttgacatacagatctacagaggcagcgtagcttgggcaccctgaagtctaccttctttgtctgaatggatggagaaagtgaagcctgagactcacagcaagttcccttccaccaagctcacactgacttcttactgagagcagactgctgggggccattcccctcccccagggtggctcagctgggagtggccaagcctatttgttcaagacggtggagacgttattcactcctaggaggcgggggaagtccagaagaactcttaggcttctgtttcgggtgtgatgaggtcacagaaggcttcacttccccaagctgacgggaactggttttttttttttttttttatcttttcacatgactggctttactaaatatattgaacttagatgaccagattgcaaatatgcaaaaatcagaactggggaacaagtgaaagaatcctggcacctattcaggtggtgtgtgtgtgtgtgatgtgtgtgtgtgtgtgagatgtgtgtgtgtgtgtgagatgtgtgtgtgtgtgtgtgtgtgtacagggcttatatacacatattgagtgaagacagcggaatcaagcgcgacgtacatgcaaacaaccgtttcaacagaggtggaaaaggagacgaacacacctgagaaaaatagattcttcaactgtagtaatagtccatctggcacttgggaagcagaggcaggtggatttctgagttcgaggccagcctggtctacaaagtgagttccaggacagccagggctacacagagtaaccctgtctcaaaaaaaaaaacaaaacaaaacaaaaaaacaaaaaacaaaaaaaacaaaacaaaagtccatctgctgaaacaacatctaaatcggggattggggcagaactacttacaagtatgaggatatgagttcaaatctccttcacccaggtcaaaaatgtgcctggctatgaccccattactgggggtgtggggtgggggaggaccgggaagacaggagagaaacaggtgggtcctggggagctcactggccagttggcatagccaaacaagataaccctgagaggccctgtttcaagtcagtaaggtagagacaaacaccctttctcgggccctcataggcacataccgagaagcatatacctgaacaatacacaccacacacacccaactcaaaccaactcaaaccggatcagagacatatgtgcataaacctgcagtgcatgcattagaaaatgcagtgggggaagattttgccacagagttggccatatgggccaaatcggatggtcctgaagttgaggttttcctgattctgagagctgcggtcagagggagatcccagcgtgcctgcctggagaaatgaacctttgcctaggcaagatccactcccccacctaagcagtaagactagcgttcattacacctaaaaacttctaggccaggcatgatggctcagacgggaagtgaaggaaggagagtcatgggtcacccacagccacgtaacagtctgaggctacacaagaaccgatctttaagattgtagtttccgacacttgaaggctagctttggagatgactcagtaggtaaaggtgcttcttatcaagattgaaaactaaattcaaccccttggatcctgtggaaggagaggactgattcttgcaagctgtcctctcgcctctccttgtgtacccccccccccactattaacctttaaaaacttctgtcatttctgctacttggaaaacaaaatgagaaaagctatccagagatttgttactgcccagccagctgtttcttgaggtgttcttaaaaaatacaaaaaggaagccgggcgtggtggcgcacgcctttaatcccagcactcgggaggcagaggcaggtggatttctgagttcgaggccagcctggtcagaactcagagtgagttccaggacagccagggctgcacagagaaaccctgtctcgaaaaaccaaaaaaacaaaaaaaaaacaaaaaaaaaccaaaaaggggctggagagatggctcaacaaaaagatgacggcttttccaaaggttctgagttcaattcccacaaccacatgatagttcacaaccatctgtaatgggatccgatgccctcttctggtgtgtctgaagacaactacagtgcatttatgtacataaaataaataaatctttaaaaaagattaactcttttttttttttggtttttcgagacagggttatatatatatatatatatatatatatatatatatatatatatatatatatatatatatatatatgggtatatatatatatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtgtgtgtgtgtgtagggggtggtgattaaaggtgagtgctgggcctcacagcaacattataaaggaaaacatttaattgggggtggcttacagttcagaggtttcatccactgtcaccatactgggaagcatggtggcgtgtaggcagacatggtgctggagaagtagccgagagttctacatctggatgagcaggcagcaggaaaagagatagacagacagacagaaagacagacactgggtttagcttgagcttctgaaacttcaaagcacaccccaagtgacacactttctccaacaaggccacactcactccagcaggggcgcacacctcccaatagtgggcctatgggtgccattttcattcaaaacaccacaggagggggtttctactacactagctgttgctggcctggagtctcaagtgctgggtgggattacagtcgaaggaagcatgaagaagacacttgggagtgactttggatagtggtaacttgactagaattatatttttaatttaataaaatttagattcatatatttcatgcatatgagtgttttgctcacattcatgtatgtatgcacatcatctgcatgcctggtgcctgtggagatcagaagagggtctgggatgacccaggattggagttacagatagttgtgggctgcagtgtgggtgctgggaatcaaaccaggtcctctgcaagagtaacaagtgttcgtaatctctaggccctttctccagccctaagtttatttttaattatttgtgtgtgtgtgtgtgtgtgtgtgtgtgtgtgtgtgtgtatgggtgggtgagtgttgtaggtgtgtcagtccctgcatccacatatatgcaggaacactcagaggccagaagagagcactggatctcttagagctagagttaaaggtgtttgaactacgtggaccctgggatctgaattccagtgtccacgattaagcaacaagtgttcttcaccctgctatatgattggtcttttctgttactggatgaggaaggttcaacatttaaataaaaactatgtttccataggcttgcatggggaggggggatgggttggaggggaggaggttgggttttgtttttgtttttgagacagggttattctgtgtagtcctagtcatttctggaacctgctctgtagaccaggctagcctcaaacacagagatccaactgtctctgtctcccaagtgctgggactaaaggtatgtgccaccaccgccccgttctgcaggcttgtattctaatcatgggaggacaagaagcagcatcctgagggagaaaggctgggcagggtgggcagctgcaggaggtggcacctgaggagaggccctaaggaagctgtctttactctgtggcttttacacttagcttgatactcatggacgttggacggaccagaggcagggatggttggctatgacgccaaagcagatgtcaggagtaactccaagttggaggtggcggtggcgggatcagtgtcaggatttgtcacccgtgccctgatcagccctttggacgtcatcaagatccgtttccaggtacccttcccccactattccttgtgatgggccaggggacagggttagtcccagcaaaggcagtccccaaaacttagaattctgtcaaggtgaagtatttcttttcctttaattttccgcttgtcagttaccctacccccacctcctgaccttttatattttaatctctagctccagattgaacgcctgtgtccaagtgaccccaatgccaaataccacggaatcttccaggcagccaagcagatcctgcaagaggaaggcccaagagcattctggaaaggacacgttccagcccagattctgtccataggctacggagctgtccaagtaggtgtcaggggacctaatctggttgggtgcttggggtcacgttgctccatggagcagagaaagggagatgcttggcggcaagccccactctgccagtttgccttcatgggagatctgctctaaccacctgagcactaaccacattatccattagctgcaccttaggccttccctccccatcctgttcaccttccctctcctgaccctgtcccaagtggtactgagtggtactacacttttcatctttagatttcagattattttttatttcttcagtgacgaagctgcgggaggcatgcttgctaaacaattcctgccagggtgtcaaggccagagagcaatttaagaggagtcagcttctccttctgttcttctgtctctctccttcatcctgtgaggtagatcctgtcgtctttctgattctccagaagagaaggctatgacagaacaggtcctagggttcacttggggtttgatttttgttttgttttgttttgttttgttttgttttgttttgtttgagacaggttctctctatgtagccctgtgtattctaaaactctctatgtattctggaactcttagcctacaactcacagagatctacctgcctctgcctcccagggtctggaattaaaggcattcagcactgtgcccggttagggccagggttcaaattcagctcatcaggtttagctgcaagcaccttcacccactgacccgtccgtagttagaactagccgattctccaggtgcttctcttgcctcactgggacacgatgtgaacaggcagcaggtgccacaaggatggcgggacggctgccatgacctcctgacggttcctggtgggaagagcagcacgcagcttgtcacttcaggctttagctgagctccatcgtacgttaaagtgtccatgggaagctttggtgggaacgacagtagcgtttgtcactgcagcctgtgggcccgccccgtcacggtcacccagtgaggtagatctgattatctctgtgtttctacagaagagacggctgtgactgaggatgtcattcacaggaagatgacagacaggcagccggtgtgatgggggagcgtggagcaccactttagcttgcttgtgaggcccacaaagcaaacatttcacgagagaaggggcaggatgctcatcatggagccagggtcagggtggtgtccatgccactctcccacctgttgaagtctacagcttaccaggttgtcacgtctgtgttgtcccaggttcttgtctgatacacaattagacatcgcaccctgtgaaagcaaggtcccgggaagcgtggctgacaggaggtgggcgttaggggaggctgtgccctgtcaacagagatgagtgattctccgtggtgtagagtcccctgccacaaatcacatagcttttcttaggttgcagtggattaatggagtttcctgcatcttctaaacctagtatgatggcacacacctgtaatcccacacttggggattgaggcagaaggagcaacataaatccaaggctgtactggtctatggagcaggttccggccagccaggctcttcagtgaggccctcactcagaaagtgatagtaaaacagttctgtgtatttgttctctcttcttctttcttctgctttctctctctttctctctgtagtggtagtgtttgtatgttcacatgtgtgtgcatctgtctttgtgtgtagggtatgtatgtagaccagagatatgtcctcctcactctcccatgcatttttttttttaatttggcttttcaggacagggtttctctgtgtagccctggctgtcttggaactcactctgtagaccaggctggcctcgaactcacagagatccacctacctctaccccccccccccgtccccgtcccctgtctccccagtactgggattaaaggtgtgtaccaccaccacctgactgtctactgtgttgtttgttttagggttttttaagacagggtttctccatataacagagccctggctggtccttgattcaatttatagaccagactggcctaaaactgacaagaaattcacctgcctctgcctcccgagtgctgggattaatgttgtgcaccgccgtgcctgggtctctgctgtatttttttgaatcagggcttctccctaaaccgggagctcactgacttggtgagactggctgaccagcaagccatatggatccttgtgtctctgtctccgccaccactgactctggaatcacaggcatgcaccgcggcaccctgcttcatgtgtgggtgctggagctcagatactttaccgagtaagctgctgttgttgttgtttgctgctgctgctgctgtttgtatgctaggtacccagaacctgtgttggcctgtgtgacttcccactgaaccacaccttaggctggtccatttccttcctttctttgatttttaaagatttttcagttgtgtgtatgtgggtggggtgtttgcatatgggagctggtacctccagagacctcaggtccccccggagttggaggtacaggcagtggtgagcttccagatgtgggcactaggaactgaattctgcttgtaagtgctgagccatcgtcccagctcccttccttatctctggatacctggcttgattcaagtggtaggaaatgtgtctttctactctgcccacaaggtaactgtcaggcatctgagtacagagaatggtgtgattctccttccggggagctgtgtcttcggcgggcgtgcgtgcgtgcgtgcgtgcgtgcgcgtcctcagtccttcccacttgcttctgcagtttttggcctttgaagagttgactgagctgctctaccaagccaacttgtaccaaacgcaccagttctcagcgcactttgtgtgcggcggcctgtctgctggcactgccaccctcaccgtacaccctgtggacgtcctgcgtacccgccttgccgctcagggcgagcccaaggtgagcagccaggaccagggaggggagcctagctgaggggagagctcaggaggtggggctcctgtccctctaggaagcgaagctggggaccccttgcattctccgcacagcagctggtttgcacggcttataagtaacccgcactctgcaagcgtccatttctcccgtggctcatagcctcccagggagatacagcctacaggaccaccacaggacaagtaagtgtccagcagggggccgcgcccggggacttgggactcaggaaaaggcagtaatgtcctcagactctcctcactggttgaaggacatggcgtggctgagcccggtgtctaggaagaacttaccgatagcattgggccaggccgatgtcttagggacatcttaggtttcctcttgctgtgagcaaatactctgacaaaagctacttaggggagaaagggctcagcttggcccccagtcggagggcgctgcccaccctgttggagaagcctgttgtctttgtcctttgactaccacgtatacaaagtgtgcctatccgcaccccccgaccacccatacaaacacacaagaactaaacatagtggctgcagaggggacttaatgacttagagcactggctgcggttccagaggcccaggtacaatccccagcgcccgcaagcatctcacaaacacctgcaactcccgtctctggggatccaaagccactttctggcctccacaggtcctgcatgtgagacagacatacctagaggccttctattgctgcagtgaaacccatgaccaaatgcaggctgggaggaaaggcttatttatcttgtacttccacatcactgttcatcatcaaagggactcaggacaggagctctctcagggcagggtcctggaggcaggagcggatgcagaggccatggaggggagctgcttactggcttgctacccctgacttgctcagcctgctttcttttagaacccaggaccaccagggatggccccacccaccacaggctgggccctccccatcagtcactaataaatgcctacagccgggtctcatggaggctttttctccgtggaggtttcctcctctcagacaactctagttagtatgtcaagtgaacacccatactcataaagtcaaaactataaacgttctttagaaatatcagtgtgagccaggcggtgatggcgcacacctttaatcccagcacttgggaggcagaggcaggcggatttctgagttcgaggccagcctggtctataaagtgagttccaggacagccagggctacacagagaaaccctgtctcgataaaaaacaaaacaaacaaaagtatcagtgtgggtgtgtctcatgtcatccatcttatggctgcattggtggcgtgaggacatttggtttagaaatggttctggttttgtttggccatcatgttactcaggatggagactccagttgggaaacattctaacgatatttgattgcgaaaacaaagtcctgtaggaacagtctggaagacaggatcagggctgcgtatagtaattcattggagagttggaggttggggtgactgccctggaggagaaacggggtaagggttgagtcggtctcagcagggcacggtggctgctgggctagagagaggtgggtgaggagaacccagcttgtcctgtacttctggttacttcctgactcttggtgaaagatcctagagaggaaaaggtggccccagtatcaggcaggagaccagcatggtacctctcctaactaactgcagggcctcggtctgtgctgacctgctctgagccccagcacagctgagaagtagtcattcacacaggagaccagcgtcaccaaattctcaaacaggccagcttcccctggcctggcctggcctggcgtcctctcagagtaacctgccgctagccatggggcatttcccgtcagtctgtaccctgctccctgcctccctgggaaggattttgaaatgagccgtccactctctgtgctgttcttgtttgtgatctccacgggaggactaggcagggctttgttgctggtggctttccctcgagccctagcacagtggcctccagaattccggtggctccctttgcagtccacaggacatgaactttcaaagatttatttgatgtatatgggtattttatgcctgtgcattatgtgtgtcatgcaggctctggaactggcgagctgctgtgtgggctccgggacctgaaccttggtcttctccaagagcaggtttatatgccaatgagaaaataacgagtactgacgtttctagaaggaaagttgtcagaaagctacccttcttactgctttgttcagtttggaggcagggtctccctgaattgctcaagctgggcccgagtcctatgcagatcatctggcttggatcatcttgtacctagaggtacacctgcccctctgccttttgagagtcaggattccaagtgggtactatgcccagttggcctcagacatttttctttaagattttggttttgtgtgtatgagtgttttgcccacaggtatgtccatgtactgtgtacatgcagtgctcacagaggccagaagaggttgttgggtgccctggagccagagttaatagacagctgctgggaacagggcctgaattctctgcaagagcagcaaattctcgtaatcactgagccatctgtcctgtccctggcctcaaactcttgaccctcctgcttctgtctactgagtgcttggactttggcatttatcaccatacccagctgccctttttttttttttggtttttcgagacagagtttctctgtatagccctggctgtcctggaactcactctgtagaccaggctggcctccaactcagaaatccacctgcctctgcctcccgagtgctgggattaaaggcgtgcaccaccatgcccggctccagctgcccttttgagatagggtcttatttagtccaggccggccttgaactcctgatccttctgcctccacctgtcaagtgctaggactgcagcctgcgccattacctgtatctctagttttccctgcctgaacaggaacagctaagcttcagaagctgggctctagataagatgcatttgggcggaaaccgcctcacagggttcactcacactatgtgtgcatgggcagatctataacaatctgcgagaggccatacggaccatgtataagaccgagggccccttcgtcttctacaaaggcttgactcccaccgtgatcgccatcttcccctacgcgggcctgcagttctcctgctaccgctccttaaaacgtgcctatgactggctcataccaccagacggaaagcaaacaggtgagctgccccgcagcccggcctgggccacagcttctggggaccttcagggcagtgcatttcctgtcggaaggtaaggctgaccgacctggctctgcagcaagtcctgtagcatagaggagcttgcttccggctctcccacatctcccctccccgggcttccagaaggaggcatatttccagggaatggtcctgctgtccagtttttgtcagaagccaacgtacaaattgcgtttttttgttttgtattttactttttacttatgtggttcctgctgggggagggggagcagagaggggcatagtattcctgctctcatattgaggcacagtgatgtgctggctaacgtgcctgtgtggctctctgcagtgattcacatgcgccttgtgcccttggaggcaagaagaggtcattggatccctagaactggagttatgggcagttgtgagccaccacgtggtgctggggggtggaatctaggccctctggaaaaacagccagcgctcttaactgctgagccacctctccagccctggtttattttcttattcaggtgtctatatgtgtattgcgtgtgtgtgtgtgtgtgtgtgtgtgtgtgtgtgtgtgtagggaagagatacccaaagaggccaaaagatcccctggagttatagttacaagcaattgtgagctgtctgacgtctgacttcagtgctgggaaaagaactggttttttgttttttgtttttttttttggaagagcagcaggtgctctaaaccctgagcagtccctgtccctgccctgcctgcccctctctcccctgtcatgttgtctgccttcactcttctcaacatggtgtctctggttcagggaaccttaaaaacctgctttgtggctgtggttcgggagttatcagcaagacctttacatatcccctggacctcatcaagaagcgcctgcaggtgggcgggttcgaacatgcccggtctgcctttggccaggtaagccgtcctgtgcgactggatcatgagggagctggtggtagtgaccctgtccctgctgtggtcttctgtagctttatttctgtgcataaacacacctgcacatttttacaaaaacaaggttagcttggtggtggtgatggtgcgcacctttaatcccagcacttggaagacaaaagcaagaagatcgctaattttgaggccagcttggtctatagagcaagttctaggacaaccagtgctacacatggaaaccctgtctcagaaaaaaaaaaattaaaaataaggttacacaatgctaggttttgtaaccttatttttctatctaccaaggtgtcccaaagagagcatttgaatttagtctgggagaaatggcaagagcccaggacaaaggcccttttcctcacagaaactagtgcgatctggctggctggagggagggaggggcgctcatggggcgctcgtggagggccagcgtgagccaaatgttgaaatgctttgaatactagccagacttgaacttgaggctggatggtgtccttggcgcataacacagggaggggcttggggacataggccaggctagaggtgggcaccagtcagggaagatctagtgatggcctattcagacctgctgcccaaggggagcaggataatgagttggagactccaagatgggccagagctatcactgcacaagggaaggaaaccagtcaggcacttccttaccaggaaggagctcttgctctccagctgccgaccccaggcccttcctcagttagcagcatgcattagaaagagtgaggagctccctcctccagggcctccttcatccatccgcaggcagttacaggagctgccttgtcccgggtgggcagtcgtggtttaggtccctgcttcctcctcagcctccaccttcctctctccaggtgcggagctacaggggcctcctggacctcacccagcaggtactacaggaagaaggcacccggggcttcttcaagggcctgtcccccagcctgatgaaggctgcactctccactggcttcatgttcttctggtacgagctcttctgtaacctcttccactgcataaggagggaagacagatagttgtgaggcaggaggggcctaaggaggggcccgacaagacttggctctgagctcatactgaacaatggctgctgcctggttggccttccaggccagctgccgggagcatgaagtcatccggagctgaaggcagaaggacgcaagggccttcgctgaacagaaggaagagagaagggggtgcttgcactgtaaaaagaaggcctaggtggaggaacctggtgcgcatgcgtctcacctccgaccagcccaatccagaaggaactggccatccttttttgcagtcctggctttggggagaatgctcctagtcctgataggaccacactggagtgcagacggggccgggctctttgcacagttctaacctatacaacttggtctgctcctcctaccaacttatttaatagacattaaagtaaaacgcgcattctttgtgtcactcctatagcttaggaacacatcccatctgagggaggatgatgggggaggggcctttctggcttgcagccctgaggcagccatgcttgtcagcttagggggagaaccctgtcatgtgggtagcttctgaactcccaggcccaagcctttgtgtctgtgaggctccacaacaggtcagggaggaaactgagacagaggcggtgaagggcagacaggagtggctcccctccttcccctcccactggagtgcaggggccatcaccagctctgcacgcatgctgcacaccatgtcctctaatcccagatgggcctcaggcccaggacatgggatgtccgacagcctggtgaggtgtggtgggcgctgtaggcagagccagggatgcagatgaagagggagcttcctgttcacggcacgagaagaatcacatgactgctgtctttcccatgctccagcctagtggtggggttggtctaaagaaggaagggaggagagacttcttgactttgtgggattccagcccctgccataacttggattgtaatgcctgctgggaatggccctgatcgtgaaaactggggctctgccctgcctgtcagttccactctcccctctgtggtccactgtagccctcccctagtggttcacttttctgatcttggctcctgattctgaagacccagggtcacttgggagggcttctgagatgggtggcccgttggcttcctgggcttggagcagcaggagtgttttgtgaccctattgctggagagatgtgaataaatttatataccagaggagaagctgactgcagaccattgtaaggatactacttgtttcttctactgctatgataaacaccatgaccaaaaagcaagttggagagggaagggtttattcagcttacacttccacatcactgttcagcactaaaggaagtcaggacaggaactcaagcagggcaggaacctggagccaggagctggaggtcatggagggagctgcttactggcttgctcagcctggaccatcagtccaaggatggcaccatccacaatgggctgggcccttccccatcaatgactaattacaaaagtgctccacaggcagtaggagtttatggaggcattttcttagttgaggctccctcctttcaaatgactttagtttgtgtcaacttgacataaaactatccagcacattaccaaagtccaattgggagttactcacaggagcagaaatgactcaaagacagggacattacccaaagctcagcctagcattgctgaactcatgaaagctgggatcatggagcacagtgcagtctgcaggcagcccaacagattggagagacctccaggcagctcagttggtcccagcctatcttcaggtcaactggagcagtctcaagagtacactgggcagcccagctcaagctgctgtttccacagggtgtgctagctcgagcctttttaggccacttagctcgtctgagtgcaattcggcaatcctcgctgcttttacattcttagtagggaggggcttccaggagcctgtgagttgttcacttcccctacttaaaacatcctgtgtcttaatgcgcctccctgcgtggtgggatgttgtttctcctttatcttaacctggaagattcagggtcggctgtctgattttttttttttttaagaagtcttatcgacgtaaattccgtgctcctcatttccccgccctcaggagcttctcgagctttttggtacctatcaccctgagcgctgtggcaaactcttaaagcagctgagagctttggctcctggtccctcgtgcgcagcagtgttgctcccgattccccctaggaaagacccagggccctttatcttggctgctcctttggtttaaaacttattttacagtgagtggcaggagagggagttgccagagtgtgccccagcccttgcactccgctttaaccggccaaaccccagaagactacgcccctccccccgaataggccacgccttcccgaagctcctcccacgctgcccggccggggagagtctgacctagttcacctgagcggggcaagggatatggtgaccccggcgcggggtgcgacctggcaagaccaacaacttcacgcaaaacgcagggagggtccggcccagcgctcggaggctttcgtggtcagaaacaaggcggaggtgcgccgggtgggaaggggacaggggccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcgggccagccctggcccaacggctgcaggggtggacggactggaaacgctgggagagaggggctcggagccctgctggtatcaggatctgcggcttggactgagccagcgtcctccgtgctagacgataaaggcgagcctgacgtttacacccagttcagtatttgctccccgaaatttaccctgatactgactgtatcagatcccagatctgggataactcagatcccgctgggaccgtaggtgaattcccgcttcacttctcagatgtaaccccagaagcctgggtttccttcagctgagcagcaggtggccacttggtgctcaactactccacccgaagccaagtttggtgggcactcagccaagcactgaacgcgacagaaagtccagttccacccgtcccaaggcctggtctgcccggcccagtgcctacagggctagaatcgggagctttgtgattcacccttgaagcctcaaccgtctttgcttctcaggtgctgtccttagtttcaggccagtgaaaacctgccgggcttagaccgtcatgagcgaggccagtagagatgattataaaatccagtcttttgatgcagagacgcagcagctgctgaagaccgcgctcaaaggtgagcctcccacccaccacttattttgtgtcaagttgacataaaactatccagcacgctaccagagtccgacttgaggttcccatgcatattccatttgggtaagagccgcactgggggctgaagcccagagccaggcagtgcccaagcccttcttggctctcagaaagtaagtcacaacctaattctcaccacatttaagccagtagattggagaatgaatcacagagttagatctaagatcataaagcctttaagtacccatgaaagagaacactgctttctctttaaaggctttgcatttggtgcagtcagcacccttgaatgtacagagatgcctggtttggagaatcagcctggcagaggggatatgtaattgcctggcccttccgttgtaacactcacgacagaagtttgacaggacaattagcaattgccgtcatgtgctaagctaaacattttggagacgtctccatgcctgtaatcccagcagattacagaggtaggagaattagcacaaattcaaggccaaattgctcaacacagactgtgcctgtgggaggagagatggcccagtgatttagagcatttgcgtgctgttctcctttaaccccagcaagcaggaggcacgatagctggctacacagtgagatgctgtcaccaaaacaaaacacaacagaaagccataaagaacacttgacttgcagaggaccttgagaggttcaagaccattgatagctcagttctcaggatcccgtgctatcctctatctccggcaaacacatggcatgcatatatacatgtaagaaaatattcatacatatgacatgaatgaacctaaaaaaaaaattacatggtgagcttgaggccagccagagcaaaacaagactatctcaaaaaaaaaaaaaaaaaaaaaaagtagaagccttggcattcagtgtacgccatcaaggcagtgctagaaaataaaagacgtgtagcctaagaaactacacttgtgctttggtctcctgcagcctcctaatcttacagtcattgatttattggcacaggatctctccctggctggcctacatctctccctggcctgcctcttctacctaagtattgggataaaaggtttgcaccattccatgcagagtacaaattgtttttttataaagtttttttttaaaggttatttattatatgtaagtacattgtcactgtcttgagacacaccagaagagggagtcagatctcgttaaggatagttgtgagctaccatgtggttgctgggatttgaactcaggacctccagaagagcagtcagtattcttaaccactgagccatctctccagcccacaaattgttttttgtttgttcatgtgtatacctacttgtctgcttgtgaaccacacatatactgtgcctgtggaggcaaaggaggatggccaagcctctggaactgaagttctaggcgcctgtgaacagccagcgtagaaggtgggaatcaaacctgggctctctgcaaagcaagtgctcttacccactgaggcattgtcttatctatttcctgattgggcagccggggtcctgacagtgaaagctgccctgctctcactcagcacggttataaccaccttctccggagaatatgtttttcttggtttggtttggttgctttgtctctagcctttggtccacacatagtaggcatagtgcttgttccctaaattacgccctttatgccctcaactttaaagataggatctcactaagtaggtctggctgacctggaacttgctatgtagaccaggctggcctgtctctacctctcaggtcataggattataggtgtgcgcctcaatccagctcccttcttttgaaacccagtcacatgtagcccaggctctcctggaactctgtctttaggcaagggtagccctaatgtcttgcttctaccttgagtgatttcctgctggttttcccttcatctcttaagcatgtggtgggggcttgccctatttattacaaatacctccagtcctggggtgtggtagtgtttgacttcaatcccagtactcaggctgcagtcagagtcaggtgggtttctgtgggtttgagaactggtctacagagtgtgccaggccagccagggctacatggagagaccccctctcaaagaaaaacaaaccccacttcaatccttagcagacagaggcaaatgtgattaagcaggcggctgtagactcccctcctgtctcttgccagatccaagtgctgtggacttagagagagtagccaacgtgattgtggaccattctctgcaggactgtgtattcagcaaggaagcaggacgcatgtgctacgccatcattcaggttgtgggggcgggcagagagggaggctgccctgaggatgccaccttagggtcaggcacaggctggccagcgccctgcttatcaccctctcttcggctcacaggcagagagtaagcaagcgggccagagcgtcttccgccgtgggctcctcaaccggctgcagaaggagtatgatgcgcgggagcagctccgagcatgctccctgcagggctgggtctgctatgtcacctttatctgcaacatctttgactacctgagggtgaggcaagggaagtcacctgcgcagcagtgaaggcctgtgtcccaaggccaaggctgatttgctccctcctgactgcagctcccaccaatgcagctccccccgccgcctttgctctccccacaggtgaacaacatgcccatgatggccctggttaaccctgtctatgactgtctcttccagctggcccagcctgagagtctgagcagggaagaggaggtgagtgactgttgacagggctgtggagcccagccatggagggcactgctcctcagccaggtgctcggcagggacagctaaggcctgtaggcatcactagacaaactacagtggctggaatttatccagcacatagaggccaaggcttcactattggagccttgtactaggaatggcaaaagctgtggccagctgtgggcacagatggcccagaaatcatctcagagtcgggtatatggaagagggttaagcgaccgtttgtggaggcaggcctggtttggagttcagcctggtcagaatgttctggaaagccccttttggtaagatttgggccatgccccttggtgtcagaatggagcgcggtactcagcaggtgctgtcacctccttgtgccatgttgctctgctcctccctctggctgagtaggccttgccactgcccctgcaggtggactgcctggtgctgcagctgcaccgggtcggggagcagctggagaagatgaacgggcagcgcatggatgagctctttatcctaatccgggacggcttcctgctcccgacagacctcagctccctggcacggctgctgctgctggagatgattgagttccgggcagctggctggaagaccactcctgctgcccacaagtattactacagtgaggtctctgactaagcccaggtctgcacatgccttcccgtgaccctcttttcaagctggcaccagaatccttgcttcagccccttctagacttttttgactgctgtggttctgccgtcttcccttccctcaatctggacttgtctcctggctgaagactgactgtcttcctctcccctcaagtcctgttatcttcccaccaccttcctcctgggcctgacaggggagaaccaactaacaaacactgaactgtgtagccactggtgcaacatgaccttggtgcctcagttttcctgtctataaaatgggcaattttagccattggtggaatgctttgggatgttaagggcaagttacaagaaatggtgttttatatattttatagagagacttttgtggaggaagcctgtttcctccagtcatgagtgactgcctcaccaggttggggtgagggttttctaataaatcttttctgaaaccaaactgcgtatttccatagcatccaaaggtgtaccccaagccaaaggaagaggtctttttacttatgagtccactgcagctgtcttcagacacacatcagaagagggcgtcagagcccattacaggtggtgtgagccaccatgtggttgctgggaactgaactcaggacctctggaagaacagccagtactcctcctcccccccccccccctccagctaaagaccgaacccagggccttgtgcttgctaggcaagtgctctgccactgagctaaatcaccaaccccaacagccagtactcttaaccactgagctctctctccagccccagaggtctttattctagtccagattggacctgagtttcttgcaggaaatctctgagacacattctgtctttgagaggttggagggggggagcaggggaaccaatttggattaccagataacacgtggtcctttgagtgcatctcactgtgtgagaggcagttttgctcaagttgtggccaacttctagccagcatggagaatcaaagactcacagaatggaagactgcattacaaacagcactctccgtccttaacttccagaactttccaacaggacagcaggagctcaacatttattagtggtactgtatgtatagatgttttgtctgcacctatgtctgtataccatgtgcacgcctggtgcccagaggtcagaaggtatcgaaacctttggaacaggagttacaggtggtcagtgagcctccgtgtgagtgctgggaatcaaaccaggtcctttggaaagagcagtgagtgcctttaaccactgagccacctctccagccgtcgggtggtttctcgtggcagtgtgtcctttcccacctctcctctcctgctaccaccagcggtagtgggccagggcacggttggcctctgccatcttatgcatattgtgcttcctcttgatcacgggaccccggttatgaaaagcctccagcagctcatgtgacagtttctctggcataagtgtccgccgcggtttattctctcggcactctgtgatcatccacttcatggccaggaagcgccgacgtcggtcagcgagaggcacggggacctggacagaggcaagctgaagttgatttgcgcctgacagagttaccatgtactgtctctgtgctatttctaggatgggccctgagcacagagctgactttcttgtatctcagaaacctgtgtctaaggaacattcacgtaataaacactgagcactttccttcagcagcagaagctttgtcgagttgacataagcagcaactgggaaaatcctgctgcctgagccaagccagctacttcagatcaaaggtgcctaagaatgcagtacaggaaccgcttgcctggcacccacttcaggccacacaccaaagacaccgggaaaaaaatcccctggtcttagctgctgatattaaaggggaaaatgacctaatagagtaatattaagtagttaaccgctgagatagggaccactacttcagttcagtgatgatgcatggtcatgggtccaggactagcccagacaatggcaggtaagcacagtcctttaccaagagttcaaagcttaggctacacaggacactggacattttgtcctctacctatggcatttacacggtgggcctcagacaagcagattctgacagtccccaatttctagggttattatacttggcctaactctgggcactcccgtcacacactcccaccccgacccgtctcacacacaggctccccactcacctggtagaaatggccccctttgaggatcggcaccaacccaatcacaggctcacagtttttgagtgcctcgtggaagatcctgtaggggttccgttcaatggtggcctgttcctccgcagaggcagcacggtacttttcaaactgcttccttttcacagcttccagagtctgcaagagacggaagaggctgctcgggccctaagtttaaccagttcacctgggagtgctgcacactcatgactgcacggggcgctggaggcaggagagtcaggaggtgaaggttatcctcaggtgcacagcaagctcaggctagactgtgttccacgagaccctctttcaggaaagccagagtttaagtgcctcctgctctgctagaccatgaccccaagaacaggccgagattatttgttcttgttttgagacagggttttcctgtgtagtcctggctgtcctggaattcactgtgcagatcacgttggcctcaaactcacagagatccacctgcctctgcttcccaaatgctgggattaaaagtgtgaactaccaccacccaggcaagaacttttttttttaatgttgacagaatgggaaacttctggggactctgtgtagctctggccggggtgaaactagcttttgaccatcctggcctcaaacttttcccaactctgcctcttttattgttaggttatccccccaccccaccccaagactggatcttaatatacagctctggctgtctggaactcagagatcagcctacctctggctctgttttgattgtttttaagacaggatctcactaagtagctctgttccagaactcactctgtagctcaagcaggcctgacttatctctgcttctcgagtgctggattcaaatgccttctccagcgatgggatttgaggtgggcaccaccaatctcagatcttggaaattttaatggcaggaatagaaacctgttttctagttttgaagccatggtgtaaaacgcagacaccaagcctgagggaaaagaaagacaagctgaagaggaagaagcggccttacctgagccatgagagaccgggccagaactttgttgcctcccttcatcatcatgttggtgaatttgcttcaaggagaaaaacatggttagctttcccgggctgtactccggatccctcagcagaaaactgccccaggtgagttccagcccacagcagaggagcatttgcgccaaacctgatg

SEQ ID NO: 1712 - DNA, 1428 bp, Mus musculus
cttagcttgatactcatggacgttggacggaccagaggcagggatggttggctatgacgccaaagcagatgtcaggagtaactccaagttggaggtggcggtggcgggatcagtgtcaggatttgtcacccgtgccctgatcagccctttggacgtcatcaagatccgtttccagctccagattgaacgcctgtgtccaagtgaccccaatgccaaataccacggaatcttccaggcagccaagcagatcctgcaagaggaaggcccaagagcattctggaaaggacacgttccagcccagattctgtccataggctacggagctgtccaatttttggcctttgaagagttgactgagctgctctaccaagccaacttgtaccaaacgcaccagttctcagcgcactttgtgtgcggcggcctgtctgctggcactgccaccctcaccgtacaccctgtggacgtcctgcgtacccgccttgccgctcagggcgagcccaagatctataacaatctgcgagaggccatacggaccatgtataagaccgagggccccttcgtcttctacaaaggcttgactcccaccgtgatcgccatcttcccctacgcgggcctgcagttctcctgctaccgctccttaaaacgtgcctatgactggctcataccaccagacggaaagcaaacagggaaccttaaaaacctgctttgtggctgtggttcgggagttatcagcaagacctttacatatcccctggacctcatcaagaagcgcctgcaggtgggcgggttcgaacatgcccggtctgcctttggccaggtgcggagctacaggggcctcctggacctcacccagcaggtactacaggaagaaggcacccggggcttcttcaagggcctgtcccccagcctgatgaaggctgcactctccactggcttcatgttcttctggtacgagctcttctgtaacctcttccactgcataaggagggaagacagatagttgtgaggcaggaggggcctaaggaggggcccgacaagacttggctctgagctcatactgaacaatggctgctgcctggttggccttccaggccagctgccgggagcatgaagtcatccggagctgaaggcagaaggacgcaagggccttcgctgaacagaaggaagagagaagggggtgcttgcactgtaaaaagaaggcctaggtggaggaacctggtgcgcatgcgtctcacctccgaccagcccaatccagaaggaactggccatccttttttgcagtcctggctttggggagaatgctcctagtcctgataggaccacactggagtgcagacggggccgggctctttgcacagttctaacctatacaacttggtctgctcctcctaccaacttatttaatagacattaaagtaaaacgcgcat

SEQ ID NO: 1713 - protein, 329 aa, Mus musculus
YSWTLDGPEAGMVGYDAKADVRSNSKLEVAVAGSVSGFVTRALISPLDVIKIRFQLQIERLCPSDPNAKYHGIFQAAKQILQEEGPRAFWKGHVPAQILSIGYGAVQFLAFEELTELLYQANLYQTHQFSAHFVCGGLSAGTATLTVHPVDVLRTRLAAQGEPKIYNNLREAIRTMYKTEGPFVFYKGLTPTVIAIFPYAGLQFSCYRSLKRAYDWLIPPDGKQTGNLKNLLCGCGSGVISKTFTYPLDLIKKRLQVGGFEHARSAFGQVRSYRGLLDLTQQVLQEEGTRGFFKGLSPSLMKAALSTGFMFFWYELFCNLFHCIRREDR

SEQ ID NO: 1714 - DNA, 33317 bp, Homo sapiens
actatcaggccaggagaaattgtggaaaaaccttagctgcatattgctgagtgaaagaaagtctgatccaagagggcaagaattctgattgattcactgctgaatctccaacatctaaaacagtgtctggccaaaacaggccctcaatatttgatgagttgttgttttttttaagtccaggcatatggtggctcaaacccttgatcccagcactttgggaggctgaagcgaggtgattgcttaaggccaggagctcgagaccagcctggacaacatagtgagactccatctccattaaaaaaaaaaaaaaaaaaaaaaaaggccgggcacagtggctcacgcctgtaatcccagcactttgggaggctgaggcaggtggatcacgaggtcaagagatcgagaccatcatggctaacacggtgaaaccccgtctctactaaaaatacaaaaaattagctgggcgtggtggcaggtgcccgtagtcgcagctactcgggaggctgaggcagaatggcttgagcccgggaggcagagcttgcagtgagccgagattgcgccactgcactccagcctgggcaacagagcgaggctccgtctcaaaaaaaaaaaaaaatgcagattatattttagaactgtggaggtgcagaggcagcaaggcttgacctaccctgtagtccaactccatctgaacagatgaaggaactgcagcccagagaaggaaagttacttgccagagacacacagcaagttgccttctgactttcaggcctcttacagagagctgaccaactcagttagatgttaagagactcatttgcctcagaagcatcagctcaagcagctgctaaataccaactctatttggtcaaggccaaggagatatttactccttcttaggaggcgggggaagtccaaaggagctttttataggcctctttagggtaagtgttggtgaagtcacagaaggattcacttccccaagctgacgggaaccgttactttctggtttctcttttcagatttactaaacatatttaacttaaaatgaaatggccaaatttgaaatatataaaaactacaatccgggtcagcccaggaaaactagcatctacctccagtctcatctcatcccagccaccaatttgccacctgaccttgagggactgcaggcacatctcctagtccttctgggccccggccagatgaaatgacctccatgaatctttccagttctgaccatctgtggtgccctgggtctaagtcaccctacaattagcctgtagtcaaaggtccttcctggcttatctgctgattggcctttgaagaggcccattctaaaatgtgggtttgctctagttcaggaaaacaaagtagggccaaagatctccttagccaaagagatgatctggaaagaggttagcaatcagttcacaaactgacctggacaacagagataaaacatgagggctgcacttgcatggggaaataaggcaatccctaagcaaggagacagagggagtgagggaggacagtgcagcccggaagaccacagtgagggacgctttcgactagaacaggaagtcaaatttcttttttaggttctgcccattatgggccaacttaacatctttatttttatttatttatttatttttgtttatttttgagatggagtcttgctgtgttgtccaggctggagtggagtgatctcggctcactgcaacctcctcctcccaggttcaagtgattctcctgcctcagcctcctgagtagctgggattacaggtgcccaccaccacgcccagataatttttgtatttttagtagagacggggtttcaccatgttggccaggctggtctcgaactcctcacttcaagtgatccacctgtctcggcctcgcaaagtgctgggattacaggcatgagtcactgcaccaagcccaccttaacatcttttttttttttgagatggagtctcactcttgccacccaggctggagtgcagtagtgtgatctcagctcactgcaacctccgcctcctgggttcaagtgattctcctgcttcagcctcctgagtagctgggataacagacacctgccaccatgcccagctaatttttgtacttttagtagagacggggtttcaccatgttggccaggttggtcttgaacttctgaccttaggtgacccattcacctcggcctcccaaagtgctggtattacaggcgtgagccatcgtgcccggcaacacctttaactatctttttcctgtgtggacaatgcttatcattacttgcattgagtgaaaaaagaaaaaaggtcatcattttgtgtacacatgaactgattttcaacaaacatgaacagagcagtttagtggagaaagaatagacttttcaacaaaaacagagttccatgtactagaacaattaaatatccaagtacaagaaaaaaaccttcaatatctcataccaaacaaaaaataactaaaaatggatcagagacctagatgtaaaacctaaaactataaaatttctattagaaaacataggagaaaatctttataacctttgactaggcaaagatttctttggtaaaggccaggcatggtggcttacacctgtaatcccaggactttgggaggcccaggagtttaagaccagcctgagcagcatagggagatcctatgctgtctctaccaaaaattaaggccaggcacggtggctcatgcctgtaatcctagcactttgggaggctgaagcaggcaaatcacttgaggtcaggggtttcacaatgttggccaggctggtctcaaactcctgacctcaagatgaccaacccagcttggcctcccaaagtgctggtacaggtgtgggccaccgcatctggccaggaaccaattcttttttgagacacgatggctgcaaacatcacaaaatgacagacaagcaggcattatggtgttcctcatggaaatacacaacaccatgtaagtagtctcatttaaaaaaaaaaaaaaaaaaaaaaaaacgttggccgggcgccgtggctcatgcctgtaatcctagcactttgggaggctgaggcaggtggatcacctgaggtcaggagttcgagaccagcctgaccaacatggtgaaatcccatctctactaaaaatacaaaaattagccgggcatggtggagggcatctgtaatcccagctactcaggaggctgaggcaagagaattgcttgaacccaggaggcagaggttgcagtgaaccaagattgtgccactgcactccagcctgggcaacagagcgagactgtctttacaaaaaaaaaaatcaggccaggcacagtggctcatgcctgtaatcccagcactttggaagggcaaagtgggcagatcacttgaggtcaggagtttgagacaagcctggccaatgtggtgaaacgtcatctccactaaaagtacaaaaattagccaggtttggtggcatgtgcctgtagtaccagctactcaggaggctgaggcaggagagtcgcttgaaccctggaggcggaggttgcagtgagccaagatcacactactgtatgactgtactccagcctggacaacacagcaagattctgtctaaaaaaaaaaaaaaaaaaggctgggcgcagtggctcacgtctgtaatcccagcacttcgggaggccaaggcgggcagatcatgaggtcaggaatttgagaccagcccaaccaacatggtgaaacaaccccgtctctactaaaaatacaaaaattagctgggcgaggtggcacatgcctgtaatcacgactactcaggaggctgaagcaggagaatcgcttgaactcaggaggcggagtttgcagcgagctgcgattgcgccactgcactccagcctggaggacagagtgagactctgtctcaaaaaataaagaaataaattttaaaaatcaggccaggttcagtggctgacacctgtaatcctagcactttgggaggctgaagcagacagattgcctgagctcaggagttcaagactgccatgggcaacatggcaaaaccccgtctctacaaaaaatacaaaaaattagctgggtgtggtggcgcgtgcctgtagtcccagctactaggggctgaggcagaaggatagcttgaccccaagaggtagaggctgcagtgagctgagatcgtgtcactgcactctagcctgggagacaaagtgagaccttatctaaaaaaaaaaaaagtcaaacccagtctaatcaaaccttttagatctaattaccaattagcagagaacacaagggacataggggccaggtgtggtggctcacgcctgtaatcccagcacttcgggaggccaaagcaggcagatcagctgaggtcaggagttcgagaccagcctggccaacatggtgaaacctcatctctactaaaaatacaaaaattagctggacatgatggcgggtgcctgtaatcccagctacttgggaggctgaggctggagaatcccttgaacccaggaggcacaggttgcagtgagccgagattgcaccattgcaccacagcctggacaactgagtgagactttgtctcaaaaacagcaacaacaacaacaaacaaacaaacaaaaaacacaagggacacaggaagatgtggaaacaactccatggggatgcgatcagcaaaatccagactagggaaaatgccacagcataaaccacttaatttctttcttttaaaaaatgtattatttagtttttgtagagatggagtgtcgctatgtttcccaggctggagcacagtggctattcacaggcactatttttgcacactacagctttgaacttctgggctcaagggatcctcctccctcagtctccctaatattgggaatacaggtgtgcacccccagcctggctctatctagtttcttaaaaaaaaacaaatataataaaatagagaaagaaaggaaaatgaaaggaaatgaaagaaaacaaatttcaagtaaaaaaaaagtaaagtggagaaaaacaatagatttttaaaaggacttccagttgcaatgttcagttcagatctcaactctttttcttttctttgagacggagtctcactctgttgcccaggctggagtgcagtggcacgatctcggctcactgtaacctctccctcccaggttcaagtgatcctcctgcctcagcctcccaagtagctggaattacaagcgcctaccaccatgcctggctaatttttgtatttttagtagagacgcggtttcacatgttggtcaggctggtcttgaactcctgacctcaagcaatccacccacctcagcctcccagtgctgggattacaggtgtgagccactgcacccaaccaagatctcaattcagacaaacatttttgtttgttttctgagctctgtcacttagaaaagcaaacttgtggctgggtatggtggctgacgcttgtaatcccagcactttgggaggccgaggcgggcagatcacgaggtcaggagatcgagaccacggtgaaaccccatctctactaaaaatacaaaaaattagccgggcgtggtggcgggcgcctgtagtcccagctacttggagaggctgaggcaggagaatggcgtgaacccgggaggcggagcttgcagtgagccaagatcgcgccactgcactccagcctgggggacagagctagactccgtctcaaaaaaaaaagaaagaaaagcaaacaacttgttttaagaaggacatttcagccaggcacggtggctcacacctgtaatcccagaaccttgggaggccgagctgggtggatcacttgaggtcaggagttcaaaactagcctggccaacatggtgaaaccccgtttctactaaaactacaaaaattagctgggtatggtggtgcaggcctgtagtcccagctactcaggaggctgaagcaggagaatcacctgaacccgggaggtggaggttgcaccgagccgagatcgtgccactgcattccagcctgggtgacagagtgagactcttgtctcaaaaaaaaaaaaaagtttgagaccagactgaccaacatggcaaaaccccatctctactaaagatacaaaaaattagctgggcatagtggtgcacgcgtgtaatcccagctactcgggaggctgaggcaggagaatcgtgtgaaccccagaggcaaaggttgcagtgagctgaaatagcaccattgcactccagcctgggcgacaagagcaaaactgtctcaaaaaaaaaaaaagaagaacatttctttctttcagaaaagtgtaaacactaattcatatttgatattaaaagtttttttggggggtcggagtgacagttttgtgtgtgtgtgaagcataatgtatacgtattaaaaagggaatgcttgtcctttaaagacacatactgaaatatttactggtgaaaacacatgatggtatttacttcagaataacgctgggcagcgcgtgcgaggtaggtgcagaaatagaggaaacaagattgccccatgagtcgcgtaactgctgaggtcggagagcgactctacgcggcttcatcgggttattccacttctgtgtatcttgaaattttctacaataaaaatgtcttaaaattgtgcgtcaaaatgataacacgaatataaaaatgcaattaaaaagtcaggaggcaatactgtcgcgcaaaaccgtgacgctagttgtgtgcgggcggtaggatgagtcatttcctccttcctttctatattttctgtctatatacttttaatattacttttataatgagaaatactaaaactcggggtgagagggggggacactcgtgtttttgccttccccgtccccgaggggactgttctcatccattctcttcccgacgtcctccagctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtgtgagtaacctctacctccgtccttctcgccgccctctcggggaccagcaccctcgctcctcagggtggtcgggagggagcacacgcacccgggcgctcacgagagggcggggactgtgtacacacgtgtcacaccagaccagagaagcatctccagggacaccggcggccgagccccgcgcacgcccttgagcacctgagctccagggcgtcccctcggactcaaggagaaaaaacacaccccgaggcacacgtggacacctaggtacccacacggggacctctgcagatttgctcagctgagcccttgggcacatgggcacccgaacaccaggaagagcctggtatgctccggtctcctgacagcgatccaggacacctgccactcgggcttgctcctcctttctgcccagatgggcgggaaacacgctgctcagtgtgacctgagcggtccctgggtaacccctggagaggttttgcctctcagtcgcttgccgcgtgtttaaacttcctcatgggcgcctggggaggagttccagggtgggtgagaggagaaaaggaattgatgtctggggtggaggctgccatcctgtaggtagtatctcccctcctcccccacccccacccccactactacaagtattcaagaactagggtaattctgaagtctagttttagggattttttttttttttttttgccataacaaattcaaacagtatagaattatcgacaggtctaccttcctttttcccttctcagcccttctccctgtgatcagttaccaactacctgttgatgtgtgtggttacagacttctttctatgctttgtacaactctacagaccgtatgtaggtattactgtttttgttttttgtttttacaaaaaaggaaaaaagtacatctcctggaagggatgctttttagctgagctctggtggatgagaggagctagccttgaaaaagtgagtaggggctgagagtggggctgtatttcagacgtagggaactggaggagtagaggcaaggcaattgataggagtgctccccgagttttccaggaactgggcagaagcagtcagaccactctggttaaatgagggaaggggaagagtggtccagagtgaggctgaagaggtcagtaggtctgagtcaggggagcccaggagcgtcattttcttttttgttttgttttgtttttttgtttttgagacggagtctcactctgtagcccaggctggagtgcaatggcgtgatttcagctcactgcaacctctgcctcccaggctcacgtgattctccctcctcagcctcccaagtaactgggattacaggcgcccaccacgacacccagataatttttgtatttttattagagacagggtttcaccatgttggccagactggtcttgaactcctgacctcaggcgatccacccgcctcggcctcccaaagtgctgggattacaggcgtgagccacggtgcctggccaggagcatcatttgctagcgtagcatggccccactgtgccggggtggtctgaggtgtgtgcaggaggggaaagggaaaggtgaaggggctcagggcctcagggctcttcctttggacagtgggggattgttaaagaatcccaatccctgttctccagccctgcacgtccttcagtccctcagcgttacacttgagtgggctcactcagtgagcaggagtttgctataaagttgccagatgtcttggaaaaccagttgatctctgggaccaacaattgcctatcaagcctgttcattcgattctcaaatattattaagcacttaccatgatgggctctattccaggaaccggaaatttacgagtgaacaaatgagaccaaggtcgtgtttccacgggcttacattctagtcagggagagagacaagaaacaaatgtactgtataaataacccatggcgtgccgggcgctgtggctcatgcatgtaatctcagcaattcaggaggctgaggcaggagaatcacttgaggccaggagttcgagaccagccagggcaacattgagaccttatctctacaaaaataaaaaacttagccaggcctgcacctgttaagtgacagctaattgggaggctgaggcaagagaatcacttgagcccaggagttcaaggctatggtgagttatgatggcaccactgcattccagcctgggcaacagagtgagaccctgtctctaaaaaagtaaacaaatatgccatagtaataagtactgtaaagaggaataaaacaagtgctattttattttatttttaaatttttgtattttttgtagagttggggttttgcagtgttgcccaggctggtcttgaactcctgagctcaagcaatccacccacctcggcctccgaaagtgctgggatacaggcatgaaccgctgcgcccagtccaaaagtgagtgctattttagacagtctagtcagggagtgctgctctgaggaggtgatatttgagcagagaccataagaaacttgcctggtgtttattccgtatctcttgcatttagcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccaggtactcttcccctttttccatgcaatggactggaggacaagttcagtctttcttgcaaaagcagttcctaaaacttgaaattctatccagatgaagggcttgccttttctgaaagttccccttcacattccagcccaccccactgtcctgaccttttttattttgattcctagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaagtaggtggcaagggacctggccagacctctggggtcacgttgctcagtggaggagcagagggagggtgaggcaagcaggaatgccacgcagggcaggacggaagaggcaggccccacgcttcccacctgcctcacccgggagccttcctgaccagcagtaccgtaggcattgccctccgccatgtccctgcgtctatcctgtgtgacttaggtgttgcatcttggagaccgatttgatgtcatgccttctgtgaggcttggcgaaggacagcactaatgcatttcagtttttgaaataccaccttcacatatgtggttcatctgaacttcaccacaccgtcatgaggagggcagggtagctgtcatgtggatctcagggaggagaagtcagctgtccgaggccacacagcctgcacatggcggggctagggttagaactcatgcttcgttcagtggagcactagtatagtcatagtgcacagcatgtgattttatgcagtagatgtgtttaagaaccagccctgtacagtgcaaaccatgggccaggcccctgttggaagcacttcacatacactctgtcacagcagtccttaaggtaggggctgttgtccctcccatgtcatgcatgagaagactgaggtggacagagcttacataattaacccaaccaaagccactggctagaaaatggcagagccacgacccccacctaggcagctagtgccagagatgtcccttcctactcttcctgtgacatcacagtgaccgcccaagtcaggtgcttactggctgggcatgccctgcgatcctgtctctgcacttgtctgcaaacagatattgcagcatgacgaataaatacagcaacaggatagtctcaataagccaggcgtgggctggactcagtggctcacacctgtaatcccagcatctgagcccgggaggcggaggctgcagtgagccacgatcatgccactgcacttcagcctgggcaacacagccagaccctgtctcaaaaaaagaaaagaagccaggccatcttcagttggctgaaggaagatctgagcatagccctggtatagtggctcacacctgcaatcccatcactttgggaggctgaggtgggaggatggcttgagctcaggagtttgagaccagcctgggcaacattagggagacctcctctctactaaaaataaaaaataaattagccagatatggtggtacacacctgtcgtcccagctattccagaggcaggagaataatttgagctagagaagtcaaggctgctgtgaactgtgatcgagccactgcactccagcctgggcaactgagcacgaccttgcctcaaaaagcaaaacagggccaagctcggtggctcatgtgtgtaatctcagccctttgggagcccaaggcaggcagattgcttgagctcaggagtttgagaccagccttggcaacatagtgaaaccctggttctacaaaaaataccaaaattagctggacatggtggcatgcgcctgtaatcccagctacttgaggagctgaggtgagaggatcactggagcccaggaggttgaggctgcagtgagccatgtttgtgccactgtactccagcctgggtgacagagagacactcttgtccctaaaaaaaaaaaaaaaaaaaaaaaatgaaagatctgaatgtaagggggtcaccctgtggaacatgctcccaaaagaatctgccccagaaaagaatgattctcgaacagtgccgccaccaggtgccgccgccagctgcactgaaggggtccctgcaggaatcagagcatggccgtcttccccagttctcagaaaactaagttagccagtgacattttctgatatacattgttctcatgtatcttttttattttttcttgagacagagtctcactctgttgcccaggctggagtgcagtggcgcaatctcagctcactgcaacctccgcctcctgggttcaggcgattcttctgcctcagcctcccaagtagctggggttacaggcccacgccaccatgcctggctaatttttgtatttttagtagagacagggttccaccatattggccaggctggtctccaactcctgacctcatgatctgcccacctcggccttccaaagtgctgggattacaggcgtgggccactgcacccagtcttttttttgagaccgagtcttgctctgtcgcccgggctggagagcgcagtggcatgatcttggctcagtgcagctctgcctcccgggttcaagtgattctcctgcctcagccccccaagtacctgggactacaggtgcccgccaccatgcctgactaatttttgtatttttagtaaagacagggtttcactatgttgacccggctggtctcgaacttgtgacctcgtgatctgcccgcctcggccccccagagtgctgggattacaagtgtgagccactgcacctggcccccatatatcttcttaaccctttgagtgtctgactctactcaagtatcaaatggcatccgagttttgcgtagaatgttgtatttatcatatgctgtcactgctcaagaagaacatttcctgaccttttcctcgcccctccacctgggccccagccgggtcacgggtgatgtatttggggagtatttggtcctcaccctcatcctttgggctgtcagtgacttcttcacttactcttgcagttcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtgagtggccaggagccagaccggggaagcccaaataaggaaggtgttgtcacaggggtagcattctttattttttatttatttatttatttatttttgttttgttctgttttgttttgtttgagacagaatctcgctctgtcatgcaggctggagtgcagtggtgcgatcttggcttactgcaagctccacctcccgagttcaagcgattctcctgcctcagcctcccgagtagctgggattacaggcacccgccaccacgcctggctaattttttttgtatttttagtagagacggggtttcaccatgttagccaggatggtctcgatctcctgacctcacgatccgcccgcctcggcctcccaaagtgctaggattacaggcatgagccactgcgcccggcctattttttatttatttatttatttattttgagacagagtctcgctctgttgccaggctggagtgcagtggtgcgatctatttttttcttttatttgataagcatgtttttttaaaatatatgatttttatttttatttttatttttatttatttatttattttttttgagacagagtctcactctgtcgcccaggctggagtgcagtggcacagtctcggctactgcaagctccgcctcctgggttcacgccattctccctcctcagcctcccgagtagctgggactacaggtgcccgccaccacgcccagctaattttttgtatttttagtagagacagggtttcaccagtcacaggatggtctcgatctcctgacctcgtgatccgcctgcctcggcctcccaaagtactgggattacaggcgtgagccaccgtgcccgacctatttttatttttatttttttcaagagacggagtctcgctcttattgcccaggctggaatgcaatggccagatctcggctcactgcaacctctgcctcctgatttcaagcagttctcctgcctccgcctcccagtagctgggattacaggcgcctgccatcatgcccagctattttttgtacttttagtagagacagagtttcgccatgttagcaggctggtcttgaactcctgatctcaggtgatccacccgcctcggcctcccaaagtgctaggattacaggcgtgagccaccgcacctggcctatatatatattttttgagacagtgtcttgttttgttgcctaggctgcagtgcagtggcatgatcactgctcactgaagcctcgacctcctgggatcaagtgatccttctgcctcagcctccccggtagctgagactgcacctggctgagttttgtatttttttagagacggggtttcgtcatgttgcccagtctggtcttgaactcttgagctcaagccgtctgcccgcctcggcctcccaaaatgctgggattacaggcatgagccaccgcactcggcagaggttgagttcttgtccttgcagaaagcaaagctgggagaggttcgggttttcagtttgtctggcagtcagtttgtaaaacccatgactgtgggcagcactgtgcggggtgctctatgtccctgcctcaaaggagctcacagcctccctggaagacagaacctactgctatgaaacagaacaaataattacccagcagtgggctggatcaaggactgcccacttgagaatttattgctggattattatgagagcgtctttgtttttttgtttgtttggttggttggttttttgagacagtctcactttgttgctcaggctagagtgcagtggcgcaatctcagctcactgtaacctctgcctcctgggttcaagcgattctcctgtctcagcctcctgagtagctgggattacaggcacgtgatgccatgtccggctaatttttatatttttcgtagagacagggtttcaccatgtcggccaggctggtctcaaactcttgacttcaggtgatcccctggcctcggtctcccaaagtgctgggattccaggcatgagccaccacgcccggccaattgcgagtgtctttggtttccacaaagaatgggctggtggaaatgggatagactcgaggaagaatttactgagtgaaaacaagggattaaatcctgaaatagacctccccaccatgatctctgtttcctggacatatttaagaatagcatcatatgtatgtgtgtctgtgtgttctcaaccaagaaagaataattttattgttattatttatatatattttttgagacagggtcttgatctgtcacccaggctggagtacaatggctgcaatagcttgctgcagcttcgaactcctgggctcaagcaatcttcctgcctcaacctctcaagtagctaagaccacaggtgtgtgccaccacacctgactaattttttatttttttattttttgtaggggcagggtctcattatgttgctcaggctcaggctggtcttgaactcctggtttttttttttttttttggttgttgtttgtttgtttttgagacggagtatggctctgtcgcccagtctggaggcacaatctcagctcactgtgaccgcctcccagattcaagtgattctcatgcctcagcctcccaagcagctgggactacaggtccgctaccatgcccagctaatttttttttcagatgaagtctcactctgtcgctgaggctgcaagctccacccccagttttaagtgattctcccgcctcagcctcccaagtagttgggattacaggcgcccaccaccgcgcctggctaatttttgtatttttagtagagacggggttttgccatgttggccaggctggtcttgaactcctgaccttgtgatccacccatctctgcctcccaaagtgctaagattacaggcgtgagccaccgcgcctggccatgcctggctaatttttatatttttagtagagatgggtttttgacatgttggccaggctggtctggaactgctggcctcaagtgatccgcccacctgagcctcccaaagtgctgggattacaggcatgagtcaccatgcctgggctttttttctttatttttaaggcagagtctcactctgtcatccaggctgaagtataggggtatgattacagctcactgcagcctccacctcctggggtcaagcaatcctcccacctcagcctcccaagtagctgggaccataggcacttggtaccacacctggctaatttttgtattttttgtagagatggagtttcattcaccatgttgcccaggctgttctcgaactcctaggctcaagtgatcctcctgccttggcttcccaaagtgctgtgattacaaggctgagccaccagacctggcttataaacaataatttttccactgtctcaactctgctttaggatactgttagtgggaaaggaaggatactttgtttaagagtttgatgtgggcaacatggctctctacaaaatacaaaaaaattagccaggcatggtggtgtgcacctgtagtcccagctacttggaagattgagttgagaggattgcttgagcctggagagtgagccatgattgcaccattgcactccagcccaaacaacaaagtgagatatcctgtctcaaaaaaaacaaagaattgggctgggcgcgatggctctcgcctgtaatcccagcactttgggaggccaaggcgggcggatcacaaggtcaggagatcgagatcatcctggccaacatgatgaaaccccgtctctactaaaaatacaaaaattagttgggtgtggtgtcaggtgcctataatcacagctactcggggggctgaggcaggacaatcgcttgaacctgggaggtgggggctgcagtgagccaagattgtgcctaggcaactccagcctaggcaacatagcaagacttcgtctcaaaaaaaaaaaaaaaaaagataatagcatattacctctagcttcaactattgacatgttggattttagattctagaatgatcagagaatatctggtcatgaaagtgaggggaagagatgtggttaaaacctacaagactctccacctgccttaagactagtcacaaccatattataaacatgatcttgaacgataaaaaattttacaacatataagatgtatcaaggttacaaagacagttcttcatgaattataattttaaaaaatacccagccgctccctgattccgatccccagaggcgactacttttactacttatagttgtttctttgattatttccttccataattctaagtaacatgcttggccgggtgcagtggctcatgcctgtaatcccagcactttgggaggccaaggaggaaggatcacttgaggtcaggagttcgagaccagtttgggcaacatagcaagacctcctctctactttatttttattatttatttatttatttatttatttatttatttatttatgtttttgagacagagtctccgcctgtcacccaggttggagtgccgtggtacaatctcagctcactgcaacctccgcctcccaggttcaagcaattcttgtgcctcagcctcccaagaagctgggattacaggcatgagccaccacccccagctaatttttgtatttttagtagagatgggctttcgccatgttggccaggctggtctcaaactcctggcctcaagtgatctgcctgcctcagcctccccaaagtgctgggattacaggcgtgagccaccgcgcctggcctcaccttcctgttttaacagctgcactattctctcgtgagctggtgtcccataattcacgtaaccagcacccacagatggacatcgcgtctttagctcttccccaggacgctgcagtgactcctggacacatacttttgtgcacacctgtggatataacagtggtatacatgtgtagaagggggagtttctggaaaatgccatccttcgaatctctgtccagcgtttcccttgactgtcttcctggcaggaggagtttcgctcctggtagctggtattttaggcgaggggacagagctatgatgggctgttccagggctaaaaccacttcactgagctcattcaaagtgcgtgtgtgtgtccaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatggtgaggcagccctcacacgagagggagccctcccaccccagccaccagaacacccccttccaaatcacaaaggagctaaagttctcctgtccgaatcaaagaccgcgggtctctgtacctggctctgtaatgtggcaaacaaaacaactgcagctgcttggagaggacttgatttcttccagctcctgccacacccatcactggcattactgaaatttacttccagtgattggtcatggttttcatttttgtcagaagtccaaattgcaaattgcttgttttttggttgaggttcttcagttgctttttccaggcagggggagtgggagatgggggcagggggaggctggggaggggtggggcatcctggtcctctccagccctgaactgagtcatgctgcagagcctgaggcccatgttgcctccagctgggggactgcggcctccaacccttccagcccggatcactccaccagaagtggccgtgtctggctcttctccccctagattacattcctttttggaatgggaggaccagtggaggtcagatagaagtgcgcttgtggggtttggtttgtggtggaggattagccctgacgccttttaagttgtcacccatagactgcatttctctcatccattctcccaatcccacttctctggttcagagaacctccaaaacctgctttgtggcagtggagctggtgtcatcagcaagaccctgacatatccgctggacctcttcaagaagcggctacaggttggagggtttgagcatgccagagctgcctttggccaggtgagccgttcactcccaggcagacagctctgacccttgccatcactgggcacatgagggaaccagtagtcacctcctacccattgggcaacatcacccctggccatggccccttcacctgcgtccattccttgagatccctaagcatgtgggaaagctgcatgcaagccctgggtcctgagcactgtggaaggatctgggccaaggacatacagtgtctgctctttttttttttctttaaaatagaggcagggtctcactctgtttcccaggctggtcttgaaccctcctgactccacctcccaaagtgctgggattacaggtgtgagccactgcacctagcacaatttctgctcttaaaacatatcctggccgggcgtggtggctcacacctgtaatcccagcactttgggaggccaaggtgggtggatcacgaggtcaggagatcgagaccatcctggataacacggtgaaagcccatctctactaaaaaaaaaaaaaacaaaaaaattagccgggcgtggtggtgggcacgtgtagtcccagctactcgggaggctgaggcaggagaatggtgtgaacccgggaggtggagtttgcagtgagctgagattgcgccactgcactccagcctgggcaacagagcaagactccatctcaaaaaaaaatatgtccagaggctgggcgtggacgtggtggctcacgcctgtaatcccaacattttgggaggccgagacgagtggatcacctgaggtcaggagttctagaccagcctgatcaacatggtgaaaccccgtttctactaaaaatataaaaattagctgggtatggtggtgggcgcctgtagtcccagctactcgggaggctgaaacaggagaatcgcttgaacgtgagaggtggatgttacagggagccacgattgcaccactgcattgcagcctgggcaacagagcaaggaaggtccccaaatattaaagcacacagaaaaggggttttgctggagctgttctggaattgggtgaatttgagcaactaggttatatatatatgtatttttttgtttttgtttttgttttgaaacggagttttgctcttgttgcccagcctggagtgcaatggcacgatctcggctcactgcaacctctgcctcccgggttcaagcaattctcctgcctcagcctcccaagtagctgggattacaagcgcgtgccaccacgcccagctaattttttgtatttttagtagagacggggtttcaccatgttggccaggctggtctcgaactcctgacctcaggtgatccacctgcctcggcctcccaaagtgctgggattacaggcatgagccactgtgcccagccatatatatatattttttttttgagacggagtctcgctcttttgcccaggctggagtgcagtggcgtgatcttggctcactgcagcctgcgcctccctggttcaagcgattctcctgccttggcctccaagcagctgggattacaggcgcccgccaccatgtcctaatttttgtatttttagaagagacggggtttcaccatatgagacagggtttcaccacattggccaaggtggtcttgaactcctgacctcagttgatccgtccgcctcagcctctcaaagtgctgggattacaggcatgagccgccacacccgggcctaagttgtattttatgtgcactaggagagttggccattaagagaagccccgtgctaagtcatgttgtagtctcagtagtcactcctcagttgctcagatttttacatactccctttcttttggtcagtgggtagggttaggggtaggctaaggatgggcaattccaggcctttcccctctgtatcctgggaacctgagatgcggaggtgtgaaaaaatatgcctgacaatgtcagaggagagggatggcatggaatgggaggcaaggtagggagagagcattccttccttgggggaagagaaagagctgggtttatagttataatgcattttctttgtaggaaactttagaaaatttaagatagatgaaagaaagaccaagccagctgcagtggatcacgcctgtgatcccagcactttgggaggccaaaatgggaaaatcagttgaggccaggagcttgaaaccagcctggtcaacatagcaagaccccgtctctacaaaataaaaattaaaaaattagctgggcatggtggtgtgtgcctgtagttccagctactagagaggctgaggcaggagaattgcttaagcccaggagttcgaggctgcagtgagctatgatcacactactgcacaccatcttgggcgacagagtgagactctgtctcaaaaaaaaaaaaaaaaaaaaaaaaaaaaaaaaagaccaaaatcccttgtaatttcactaccacagataaccacatggaacctttcagtgtagttttatttcttttcataaatacacatgtacattttaacaaaaatacggatacactgtatacaaggtttgtaacctcccttttccacttaccaacttgtcctgaagggagagtttgttttcttttctttctttctttttttaaatgggatatcgctctgttgcctgggctggtctcgaactcctgggctcaagcgatcctcccctctcagcctcccaagtagctgggactgcaggcatgcaccactgcacccagcatgaagggacagtttgaatttggacagggagccgatggtgagagcccaggatggcagagggaggccttactgctaacaaagactagtgtaatccagtttggccagaggtgggaagggcacgtgggaggaccagtggaggtcagatcagggagggaaatcaaggccaaatggtgcagtgccttaaacggcagatcttggggtttggacttgatttctcatgatgtcgtcactaggagttactgcagcttttggagggaagccaggcttgaggagggttgtgcctggggatgaatgtctggcagcagtgtgtgaggtcagctggagagggtgaggctggaggcagggaggcccggctgagagctactgagggccaggttcagatctgctgcccaagggggatcaggtgggatgggatgaagggtcagagatgcctctgggaagaggttctggagccattgctggatcctttggagccacaggcagccgttcttcctgggcaggaaggagcgctgtccagcttctgatttctaggcctgtcatctgttcagtcttaacccaattacagtagaaagaatgaaattagtttatttgctattttgagctgggcatggttgtccatgcctgtaatcccagcacattgggaggctgaagcaggtggatcacctgaggtcaggagttcaagaccagcctggccaacatggcgaaactgcatctctactaaaaatacaaaaaattagccaggcgtggtgttgtgtgcctgtaatcccagctactcaggaggctgaggcaggagaatcacttgaacctgggaggcagaggctgcagtgagccaagattgtgccactgcattccagcctgggcaacagagtgagactctgcctcaacgaaaaaataaaataaaataatttgctattttgcattcatttctttgtccagcaagtacttcttaagatctgtgatgtgccaggggctgtgttgatgggagcagagcgggcatccatattttcatccctttcctctccccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctgggccccatgcccagaccttcgtgtctgcagacacaccaccacccaggctgtcctctcccaggaccgggctggtcatggccgtggggctccatggaaagcagatcccagcacccgtgcaggaagtggatgggccatgctgtgggcaggcgtgggtgaaggtgcagcctctccccagtctacctcactgactcctctttcacccagagctgggtcagccttgctgggtgaggagctatcagcaggacaggtggcatcagcgcccactgcctgctcctcagtgcagagcatgctgcgggtgcatcctcccctgtagccccagaagggccgtggctctgaagcagcccactgatggggatggcagaaggaaggggcgggcacgtagcctggtgagggcacagctggtgcctggggtgttaccagagcagagggacacccacaggcggagaggcagaggagaaaccagttccaggctgaggggaggtctccagaacatgacctccacccttccctccatctgcccggcctgtagggttgctccgacctgggaagccctccattctgcctccctctccagccttggaaagaggcacccactgggagccggcgctggccctggccctggcgtgtgggtcctgggctcctcctcgcaccatccttccctgcctctggtctgggattttggggtctgtctgggccctgaatgctggggcttcctggctctgggctgctggttcccaaggtccaggctgcggcgggggccacgaggatgcagctgcctgaatgcattttttatgaaattccgttaaagtttcttctcttcatctttcctgcccattggtttcttttgctgcagctgagcgttctcttcctcctccgttttcggtgaccactttggcggttcttttaaaaggaggcgagaacgcgggcagcgccggcagcgctcctcccggtcgcgcggcaggagcggcggcagttcttcccccacttctaggtgccctcctgtcacccagggcagacgccgggcggtggggtccgcgccacttcaggggcattcgcaacaaccgacggccgcgagttgcaaatggggcccctttctcggggctgcccctatgacctgaaactcgcttcgcccatgtcctccttggagcgggagagggttgtggctggccccggccctgcagcccctgccttctctacctgggttgggggagcggggaaagtggtgcgaccagggctgatgctgttcctcctgccaccaggtccccaccacgcgctctgcaggctcttcccacgccgcgcagcccagcggtgtctcccggcccagtgcacctgagctccggggagggctgggtgcggggccacgcgcaagatcgaggtgccggcgggtccggcgtgggcccggacacggcccaggcgcaccgggtgaaggggtgacgagccaagcgagttccgcttgcggctgggtggcagcgtcgcagggtcccacgcaggcggcgcggcttccggggcggcctggaggccagggcagtgccccgggggcccggcaggtggcgcgggcgagccgacccttccccggcgccgcgcgaggagatgagctcacggcgggccccgcagcgccggacgctggttgcgcgctcccaggcgccgagcggccccgggcacgcgcgcgcgccaccggcccggcaggtgggtcccggctcccacgccgcctctcccgcccgcgggaccctgggccgtgggctccgcagcccgccctgtgcctccgggaggggcgttccgggcgcggggggaacggccgagggctggagaccctaaaggcgcctcctacggccagaggggagcctccggcgggagccacctctccggggcgcatcatcctgccccccagtaagaggaaggctccagaatggagctcaggaattaggagtctcgagtgcgtagggccgggttactgccactcgggagccgatccgaccagcctgtcccagggagaagctggcacgggtctggggagttcaggctgctcccggcaggggcggcggacagggcgcctgcgtccccacccacgcaggccggccccatccgggggatgcagcggcgggtgttgagaccgaaggactcggcgaaagccagaaagagagggttggggagaggggctcggagacctgctggggacagagtcgcaccgcttggagttcccagcctggccctcacccggcatcttcctgggccagcaacgtcaggccggtttatttaagcaactgtaacgtccgcccgcacacaccctgccccagtctactcctgcctcctgctgggactggagggtgggcgctttcctgcttcagcttctcgctcttgtgtaatcccacaagcgagggatttctaaactgagcagcaggtgcctggctgatgcccagtccccaccagaagccaagcctggtgggccttcagccaaccaccgcacgccacggaccgcccaggagtccctgtcccgagcgcgccgtcagccccgtccagggcctgcaggacggaacccgccctgcgctccacacctgaggccgctcccttcgcctcttctcctcaggtgctgtccttattcccagcccagtcaagagctaccggggctggctagtcatgggggagcccagtagagaggagtataaaatccagtcctttgatgcagagacccagcagctgctgaagacagcactcaaaggtgagcacgggacccctcctgagctggggtcaggagctacagagaagggcccctgtgggcagcaccagaggctgagcctggtgaatgcctccacccctcccctcattctctgacgataggagtcggcaacgtaattcttgaactggaagacaagctacattgaggccattattttggagtatgaatcacagtcacctctcagactgtaaagactgttttaaaagtttaaccatagggctaggcgcagtggctcatgtctgtagttccagcactttggaaagccaaggtgggcagattgcttgagtccaggagttcaagaccagtcccggaaacatggtgtaaaccccatctctacaaaaaaaaaaaaaaaaagaaagaaaagaaaaattagccgggcatagtggcaggcacctgtggtcccagctacttaagatgctgaggtgggaggattgattgagcctgggagggtgagggtgccatgagccatgatcctgccactgcactccagcctggctacagagcgagaccctgtctcaaaaaaaaaaaaaaaaaaaaaaaagtttaaccataaaaaaaagaacacggctcctgcccttgaagcgcttacatttgaattgctggtttctgtgctgccatagccccgtctcttgaatgcacagttgcctgctttgagacagaagatggagaatattccgtttgccagaggagctatagtaattgctctcgcctgatgccttcccgctgtaacacgcagtacagaggtttgtcttcaactaataattagcaacacccatcatgtgtcaagccgagcctgttgggaggccctatgtggccctctcttgttgggggtttgcatgtgtgtagtataagaacactttttcttgtgaaattgctgttggaggcatgtcctggtcagtattccttcctcaacctagtgccaggaaaagatgtgtttcctgagaaactacattcttactttgattggtccctactagccacataaccctccccattttctctgactgggcaaccagaagacaagacagctaaagctgtttgtatggttactgtcctctgtacggtttcttttcccttttttttttttgagacagtttcgctcttcttgcccaagctggagtgcaatggcacgatcttggctcactgcaacctccgcctcccaggttcaagcaattttcctgcctcagcctcccaagtagctggggttacaggggcccgccaccgtgcccagcttattttttgtatttttgtagagacggggtttcatcatgttggccaggctggtcttgacctcctgatcctgacctcaggtgatccacccgcctcagcctctcaaagtgctgggattacaggcatgagccaccacaccaggccctctgtatgatttcttttatttttttctttttttttttttttttgagacggagtcttgctttgtcgcccaggctggagtgcaatagcatgatctcggctcactgcaacctccgcctcccaggtccaagcgattctcctgccctagcctcccaagtagcttggatgacatgagatgacgcacgagccaccacacctggctaatttttgtatttttggtagagatggggtttcaccatgttagccaggctggtctcaaactcctgaccccaggtgatccaaccacctcggtctcccaaagcgttgggattacaggcatgagccactgcgcccggccatgatttcttataagtaccatgcgctaaccaattgcaccactggagccactgtcctctgtatgatttctgatctctttcacttcaagcatatgagtgctctactgtaaatatctcaaattcttagaagcgggtggacacaaatgtgataaagcagcagctctagactcccctcctatctctacccctagatccgggtgctgtggacttggagaaagtggccaatgtgattgtggaccattctctgcaggactgtgtgttcagcaaggaagcaggacgcatgtgctacgccatcattcaggttgggggttgggagaggaaaggaagctgctttgaggaaggtgcttcaggagtgggcagaaggcctggcctgcaggacagagatgcacagggtctagctcaaagagagagagaggcataggatgggtggggttacaggggcaccgccccccacccttcaccttcctctccctggctcacaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaggccccggcagccaccctgggaggcagacatggcctgtttcctgaggcccaggttggactgctccccttggccactaagcctggtgctctgacccctcctcttcctcacaggtgaacaacatgcccatgatggccctggtgaaccctgtctatgactgcctcttccggctggcccagccagacagtttgagcaaggaggaggaggtgggtggccccagccctggcacaagcacagaaggctgcaggatggacagtccagctcagccgtgtgtcagcccactgctcacggaggtctctgaggactgtgtcacttctggggcaggactgtgggggtgtttaaggcctgtcagttataggacaagctgccaggtctggagtttatccaatagagagcagccaaaacctactggctcagtagcttccttctcagtcagaaagccaacgtatgatggcagctgtgcaagccatggctagctgtgggtacagacggccccaaagccaaaccagggtcaggcagtgtgtgggaggcaggagagtgggatgaagaagtggtttggagacaggcttgagtggagcctggccagatgagggacctcaggcaagtcccggaactcatttctttctgtgtaagatgtggaagtacccactggatggtaaggagggagcaagggaatgagtgtaaaggcaaagcacagcacctggcacttggcaaatgctgtgtgagaggctggcactgccccagttcacttgtgttacccacactgtcgcctgcaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccggtcgggtaggggtacagggacctgggtgagacaggacataggcaagttggtccaagagtctgccagggtttggggcctcctgcctccctgaattctaaggagtagccacatgttccctctggaccagccctggtcaggcctggggagaagggcctgtcttttcttcgagcttccctcaccttcaggtgaccccagtgtagcagacataagaggcgttcattcagcaaatactaattaagcactggcctctcccggcactgtggttcacacctgtaatcccagcactttgggaggctgaggcaggaggatcgcttgagcccaggagttcaagaccagcctcgtcaatataacaagaccctgtctccatatattaaaaaaaaaagaaggccaggcacgatggttcacgcctgtaattccagcactttgggaggctgaggcaggtggattacctgaggtcaggatttcgacaccagcctggccaatgtggtgaaacctcgtctctactaaaaatgcaaaaattagctgggcatggtggcaggcgcctgtaatcccagctacttgggaggctgaggtagaaatgcttgaacccaggagacggaggttgcagtgagccaagaatgcaccactgcactccagcctgggcaacagagcgagacttcgtctcaaaaaaaaagaaaaagaaaaagaagaaaagcactggccattttccctcctaaatggtagtcctaccaagttgttataagaaccaaataggaaaagccccattagctggggtgactaatccacctcagaccataggtacctaaaaacaagaccccttcagtcttcagacacagcaaaaccctgtctctactaaaaatacaaaaaaattagctgggcatggtggcggccacctgtaatcccagctacttggggtgggcagggactgagacaggagaatctcttgaacccgggaggcggaggctgcagtgagccgagagctgagattacggcactgcactccagtctgggcaacaaaagcgaaactccatctcaaaaaaaaaaaaaaaagttaaaaacaaaaagaccctatacaaacagttaaagaaaaccaaaaacaagaccccgtgtccaaaaatcatttgtcaggccctcactatgcgtcagtaccatgccagacacgagagtgcagacaataatgaagtccctaccccatggagttgatattgaaaaaggagaacacaagaaaactcaggacaataaaatataattaaatgctatgaaagagatacctagtactgttcagcaaacactgatgaagcatcagttatcggtcaagcactatgccaaacactggcatacaaagacaggatatgaatagtccctcgccatgagaattttacaggttaggacacacaggatgcttgacagaagaaggcgaagggaggtgggctcccagatgtcacttagatacttcttcactctcttccaccttctgcctataatttttacgctacaggactcagatgagtggaccgtaacagtctcaattctttttttttttttttttttgagatggcgtcttgctctgttgccaggctggagtgcggtggtgtgctctcggctcactgcaacctctgcatcctgggttcaagcgattctcctgcttcagcctcccaagtagctgggactactggtatgtgccaccacacctggctaattttgtattgttagtagaaacagggtttctccttgttgatctcgaactccccacctcaggtaatccatccacctcggcctcccaaagtgctgggattacaggtgtgagccaccgtgcccagccgtttttttttttttttttttttctgagacaaggtttctctctcttgcccaggctggaatgcaggggcgtaatcataactcactgcagccttgacctcctggactcaagtgatcctcctacctcagcctcctgagtagttgggagcacagatgcacaccaccacacctggctaatttttttgttttttttgtagagacgggatctccctatgttgccctgctgtctcttaactcctgagctcaagctatcctgcattaggctcccaaagtgctgagattacaggtgcaatcccactgcaccagctagaaagctatcaatcttgacccaactcccaagcaccacctatcttgtttcacatgtggagggccctgctttcttgccctggccattcattcacctggtagaaacggcctcccttgaggatgggtaccagcccaatcataggctcacagtttt

SEQ ID NO: 1715 - DNA, 963 bp, Homo sapiens
atggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctga

SEQ ID NO: 1716 - protein, 320 aa, Homo sapiens
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTELVHRGSVYDAREFSVHFVCGGLAACMATLTVHPVDVLRTRFAAQGEPKVYNTLRHAVGTMYRSEGPQVFYKGLAPTLIAIFPYAGLQFSCYSSLKHLYKWAIPAEGKKNENLQNLLCGSGAGVISKTLTYPLDLFKKRLQVGGFEHARAAFGQVRRYKGLMDCAKQVLQKEGALGFFKGLSPSLLKAALSTGFMFFSYEFFCNVFHCMNRTASQR

SEQ ID NO: 1717 - DNA, 23988 bp, Mus musculus
  misc_feature (1)...(23988): n = A,T,C or G
taaaaaaaaataaggaggtatgtgggagctgtgcacatgcatatgtgtgtgtctatgcatgtacaggtatgtacatctaggtctaagtgcctctgtctgtacagtgggcatgtgtttatttgtgaggttttgtgtgtgataccatggaagggacacatgccagtgtgcatgtggaggtcaaaggacatcttgctggagtatgtctctctttcttctaggtaggtatcagggattgaatgcaggctgttaccgagcttggtagcagtcatctttatctgctgagccaccttgtcagccctatctgtgtgcctccatattggtatacatattcctagatgtgtttgtctagtatgtatgtatgtatgtatgtatgtatgtatatgcctgtctgtctgcatatctctgtgtactgtacacacttgcatatctgattttttatactcgtgtgtgttgtctgtgtttgtgttctaaatatgtactagtgtgtgtgtggtgtgtgtgcatgtgtgtgtatgtacatgcacatgtatagatgtgtggtgtgtgggggtgtatggtatgagtgtgtatgtacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttgctagcccacgtctccgaacttttccaaattcctcctgcaaaccagttccaaaggtgaagacgctcacaggtttgtggcagcagcatccccactcctggtaccagttctgtacactacacttgccatcactgcagttccaaaaccaacctgaagaaaggtttactttgcctcacagtttcagagcttctgtcgtggtcctcgactctgtggattctggactcctaaggggatagaacatcagagctactatcctcacagcacaaaagaagtggggagagaggtcgagcataacttgtaaatattaacctgtggcctactttctccagctaagtctcacctcctaaaaattctaccacctcccaaaataatgccccgagctggggactgagcattttctgaaaacaaactcatttaaggacatttcatattcaaaccacaagatgttaacctttcccaccaacccctgtcccactgcaagccaggtcttccttgttacaactggtcttaactttcccaagactctccagttttactgaaaccatgttgcaaaattcatctccaaaagtcttcctctgtccacttcccatcatctcactactgccggttaaagtctaaactccccccatcttctggtcaaagcagcacacaattgaggcccgcacctctggacacttattgggtgtatgtaaagacctgcagaggctgctccagtaggatcatcatagggacagagtcgctgttttggcatggcctgtgtcttagacagagtttctattcctgcacaaacatcatgaccaagaagcaagttggggaggaaagggtttatttggcttacacttccatgttgctgttcatcaccaaaggaagtcaggactggaactcaagcaggtcagaaagcaggggctgatgcagaagccatggagggatgttttttactggcttgcttcccctggcttgctcatcctgctctcttatagatcccaagactaccagcccagagatggccccacccacaaggggcctttcccccttgatcactaattgagaaaatgccctacagctggatctcatggaggcatttcttcaactgaagctcctttctctgtgataactccagctgtgtcaagttgacacaaaactagccagtacagcctgggtgctgtgctgtgagtgatctttgcaccatggtttgaaaaacctgagcgtcaactttgttgctccagcctctaccctagtctcccctccacatctggaccctgcagtcagtgggctgggtgcttcacagccctggggttctcttcagtccacctgcatgtctgggaagaacccaggtgtgcctctaaacaggaaggagagatgccggtgtcactggctctccctctatcaggagtgtgagtgtcctctagcacagtagggtgagagtttctggttggagggtaatgtggtatgcatgtgcacttcgcatctgggggacatgaaagaggttgggtaatttatagtgttttatatttgagagtgattggggcatccgttgaggatgtgagttatggggtcaatttgagggcatgtgggcattgatgtattttatgagctcgtggtggaatgcaaattatgtctgtggtttccatgtgctgagagacaagcacctgtctggagtgaagtggggggcctgtgtctgggagtcgtgtaagacatggtatgcttgtgctacgacaggagatgagtgtaatgatgtttcatgacatgcaatctagtgtgtgtttgtgatatgaagcttgtatgttaagggattgtgtgaggtgtgcatgtgaggcatggctgtgttacagtgtcggtgtcagagtgtgtgactgtggtaagacgtgagatgtaagcagctatgggagagacgcgggttgtcggggcatgcacacagtatcagcgcagaggtcagaaagccttggtggtgtgttctagatcattccctctgtcctgaaggctacatcttatgattccctgcccttgtgtgagcgtctcttctacacagccccattctgaaggtccttaaggccctcgtgcttctgtctgtctcaggactgcccttgaacacaccacaggatattacagcatctcaggggacaaagcatggctcatccatacttgactgcctgcatgctgcaggcccagggaacataacccagagttgctaacaagcattgcccagaaaaaggactgaactctccccggttctctgtaagaatgattttatctctgtcgtctctggaggtgcctgggttgctccatcccaaacccattcctctaaggcaagtgtaagcaagtatatgtgaccagtagcttagctccagctgtagtggcaagcttagctaaaccactttggctcccagacagttgcgtgcttacaagcagagccttctggattcgcgaaaagaacacacacacacgcacacattagcttatttttgatatgtcttgactagctcaaaggctgggcagttctgatcctccgcccagctagcatacatttccctccggtactcctgactcaacgccttctgaatctgggttctctcttcgctgccctgttaccttctgggcccctcccctagggctgctttcccttcccacttacattttggacggtttctccttctgcagctctaaatctgacccatctcgctagatcatctccagttttctccctggctgccggccctcacaaatcccccaggtcccgcccacctcagtttacctgcccagccattggctgtaaggcaatcctttaatgccaatcaaattcagctgggggcggagacacaaggtctgggacctctgcctttgggagccgaattgaattgagacagcgttagaaccaatccctaacaccagctaagccccaacctctgaagccttggcctcctcccaaaataataatggagccaacaacacacaccaaagtcccaaaccaaggggtcagcagtatcccagtcgaattctccctaccgcttcccagcttctcttagctccgggcatcgtccctgttccttggagtcatcaaatattcctgtctctacctctggcttcacgaggctgtcttctagccatttgctttaaacctttccccatcacacagtcacactgggttaggggcttgtctcagttaattttcccgttgctgtgataaaatacccggacacaaacctcaaacaagcaacagagaacgagaggtgtgatctcttccttttcatgctgccctcctctggagtgggtcttcccacctcggtcaacctaattaagataatccctcacagcatgactctagggcctgccaagttaatgatcagtattaaccagcacggaacccctattccagtatggcccagttctaacctacatctctaatgttcctgttgccaaggaaggccacacacattttgggtaccagtgcctaggacttcagcatatctcttgggggacacgatgtacccccacaacattagttttcagtggacggtgagcaaggggcaagccactacccctctccaattcccacctcaacaaagtcacctccatccaggctccgggatcttctctcagctgtcatgaaatagttcctgctgatgtacacagccatttcccaagtcatagtcaccctcactgccctcacctaagaagttgaggggcccatcccccttcctacaccccgcatccagtccctgcatcctgttcctttctatacagcgttgagatgttgaaaagttggcccacaagctactgaaccctggtatgtgcaaccccagattctccatatcccgtcatccagagctgcagggttcctgggctgtactagaaacagctcaaaacgacccacgacttcatgaattcctgtggcacctactcggtggccaggcctaggccttccctgaataatgttggccctatcttgtccccttggaaagatgggcttcaagagctcaccttcccgtggtgggacatcaggggcttagactaacaaatgagggagaaacatggcaaagagctccaagtgttagcaccacccaggagctccccagatggtcagtgcgctaccaaggtgagtgtcggtgaaaaagtaggctcagatgagctgannnnnnnnnnnnnnnnnnnntcaaggttaatgccctttttgagctaagcctcaaaaagtgacacctgtcacaggcgtgctgtactttgggtccccactcagcggtaaatcccacccttcccctccccactgcctccagacagagactcacagctccttcccaacaccccaggctgcatgtagccagcctacaagtccacttgggaattttcagaagctgagaaagaacatggcaattagtgaccatggcccactctccccctccccccgcccggcccccgacgaccttaaaggcaactctctggggtgcatacattctgcaggaatgccctgaataaaaggatgtctgtcaccacctctcttattggtgtccttggcttaagcaagtacatggaactctaaaaagagatgctgagccagccagcctcttgcactatttttctacagggtttaggagagataagtaagagctatgccaggtagaagtgatgcctggtcttgaagggtacctgcctctttcagggtcttggttcctctccaacaccagatctcactctcactaggagcttcacatctccaccccctagggtttcaggggaagccagtcagccagcctacccacccagagacgttgagataggcgtcctgtgtgggcttgtggcaggaaatggggctctaagtcctcaggggaggggagttgctgatggccagcccccacccccaggctgatggggatctcctgacctcctagccctgcgggacaactgagctgtttacctaggaggtggcaaggctgagcagctgtttgtgtttggtggacttgatgggctgggtgaccggctgcatcatttgctcaaggcagctgtgatctgtaaagtacacaaataccggtattcgccctgcctccctccctccctccccctgtatggctggggccccagagccatcagagtgcctgctgggagcacctgcaaaatagctgacccccagcctgccaggcttggccccgtcctgagtctgtagctgtgggaaaagagcatgatgggaaaagatccttggagcaccttaggtctggggtctcgggcactcttcttaagtggttcctatcaatcttgtcgctagtcattgacaagctccagaaaggctgcaaaggaatgagccccactcccccacccacccccactttcctcctattatggtgggcaagccgatgaaaatttccccaaagcacacagtagggcttttataattcgggaactcagccttgcatcccttcctctcggacccactctgacatctctgccccacaatcaactaatcaggcccaagaccccatagctaaggaagaaaagctttttagctttgtggctccgctatcaagttcagagagccctgagcaattccaaccttattagcagtctaaccagacggctgggaacattccagtgttgagtctacacctccgttctccaagatgactgagcagagaactccctctaccatacctgcatgttctccacagtgacccaaagatgccagttcacagccatttgtccctcttgggaggtttctgctaaaaacttcagacaagctggctccccatctcagaataaattccagccttccctaattcctgcaagcctattatgagcgtaagccctcattagacacttccaaataattgtctgacccaaaaggaaactcaaacaatagtaatttaaagagagtgtcctgcccatcaagtcttctctttcttcttttaaagatgggggggggggctggttatttagccttagctagtccttgaactcagagatctgcctgcctctgcctctcaaatgctgggatgaaggacccgaaccaccatgttcccacccacctgtcaagtcttggtaggctacgggaggagaggtccttttccctgtgtgggagacccacccacctgagcatacactcagagcatcagtagtctctgcactggccagcaatgggcaaatatatatccaaggtatagaccaacggaatgtgaagttctatggtgatctccaagtactttggaggtctcagctcagcttcaaggacattgactagtacaagaagctcagagggagaacctcagaggctgaggcaaggagactgggggagagaggcatggtgatgacagggacaggctcactggaggcaagtgtccctctgtcctgctgacatccttctccacccatctctccttctctgaccctctctggggcatctgaaatctcagaagaccccttctcccccctccagttgctattaactgcctctgcccccatctcctaggtgatgcttcttggagactcgggcgtcggcaaaacctgtttcctgatccaattcaaagacggggccttcctgtccggaaccttcatagccaccgtcggcatagacttcagggtgaggtggctgcaggctcctcctgcagtgagctgggctacagctcaggctcaagaaggatgctctctccttgtctgctttgaatcctgagggcacctggggcttactgcctggaaggccccaaaggcgctcccaccaggaccacagagatggctaggtcaaaggagtctgggtagggctggcaccttgcccaccttcttctcagctcttggataatgtccccaaaacaaggtagcttcatggtcttaagtccagagagccccttgctagtggtcatctgaactgggctcttctgtcaaggtcagttttcaagaagcaattgccaagtagctgaaggtctggattcaaaggcaacagatctcagggctgtctcccatcccactccccatccccaggtatctaagatctctatatcagtgtgcaagagggaccactgagtactatatatcaaaggatcccagagggaaagggcctagccctagcaggtgagcctacagaagcttcatgcttctcccagtgaactgagtgctgaggcttcatggagagaactatggggaaagatggtcaagcctcagaaggcctcgggatgctaatgggtgcctcatcactaaaggtgaaccctgagagacagagattgaagcagggaaggggcagagcctcgcacaccctccctgtgctgcctgctgagtccaacagaggaccaggcaggtttgaaggttctcgctgcctcgctaggttaggagaagaatggatggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaggctcaccacattgccccactgtactggggacaggtaaattggcagaactctgggggccagcctcccctcccctcccatcccatcccgaccctctgcccttttctctttcagaataaagtggtgacagtggatggtgccagggtgaagcttcaggtacaagcagaagctggggcggaggaggggctcgtgcttgcttgcctctcaacctgaaccacaggcctgcagccctggcctcagcctggggtaacttcctgtggggcccatgagaggaaactgcttttctttgtttgatatctgcagaaaaagcagttcccaggcaccctttctcctatcaaaggcgactcaaagtaccctcagcccgactcagcctccctcgggccccctccctcccagttttctgagtctctactgagctaaggatccccaacccctaggctggagaagaggaaacagcagtaaataggcttaggatcccagaaaggcgatttaagaggtcgtcagatgctggggagccttgagaactgtgagaaacccaaagaaggaaacggctccccccctgccccctcccccacccactccagctcacagacagctctcataccacagcatgagcgctctagtcagcagctagccctgcctccttctcacctctctctcttcctagatctgggacactgcaggacaggagcgcttccgcagtgtgacccatgcttattaccgagatgctcagggtaagtccccttatcctctgtcccctccccattccacagcacctctgcagatgccctgaactctcctctatatctgttcccctccagctttgctcctgttgtatgacatcaccaaccagtcctcttttgacaacatcagggtaggtcctcccctccccaaggtcctttccctgtcccaacaaccctgcctgtcatgagcagccagaacagggcttctgcagaccagattgcttcaattctgtaaaagcaggtagaccatagaactgtcacctttgaaatacactcagcagtaactatctttcattagatatgaattatctatttcatgtgacatgaaaaccgagcaggctggtgtgccctgtatagccctgactgcaattcatgagtgtgttatatatcaaagtgtttagaacagtctcagctccaccctggacagttatccacaggaagaaagcccaagcagaaaactccacatgcatccgggccaagttgcaactcaagaagacagagtgggaggttgtgtcctcacagccaaaccattagagaggccataaccagtaaatacaaacacaactctgtgcacagcattgttatggttttgtgtgctgacaaggcacaatccttgaggactgacaagcaaactgaggggataaaacagataggtataaaaggatagaagctggagatcatggtcatctccaagcctattctcagggcagacatcactaatcaatcacagtacttattggtcagaaaggcaatacaggataatggaccccagtgtcttgtttagtcaaggcaaatatttactgtagtacatccccagccaagcttagtcatctccaccttcaattcctatttgttgttgttgggttgttttggttttgaggtagagtctagatatgttgctcaggctgacctccagttctatccacccgcctctatgtggggagtataaaaccccatgtcccccacatatggctgatcccgttgcttttgattactgagcccttttgtggttttagaatcccaacagagcactctaggagaagactcccctggtccttggcctcagcctggctcagcttgccctctcccacaggcctggctcacagagattcatgagtatgcccagagagacgtggtgattatgcttctaggcaacaaggtgagtggctctgtgctacagtcgatgcactgatgcgctcggcctttctctcccactgcctcagcaccagccccacccagctccataaccacctaaatccttccggcagaggactctgaggtctccagcgtgggagtcagacatgtcttgtggcttctgcctgtcctgccccagagctttagtagcagccccttccaccaatagcctcaaatgcctccagagagatgccaggtgactcagctgccagccatccttagattgttatggacagggtcaggggttaagtacaaagggtttaattcagcggctgtcacctgatgaagctgggtcaccacaccctttgctagagttacacacctccccaagtgctcagggctggcattgggcacatggccggagcaacccagaaaccctggctccaggccaatcacacctgcctgcagtccctcagactaccagaagagggcaggtagtgcttgctcctggggcaaaaagataggctttctgggatccatgcttccttcccagaagttgattgacacacatgggcttgacaggccgatgtaagcagcgaaagggtgatccgttctgaagatggagagacactggccagggtaagtgactgccaatggggttgggtgaatggtgagagaggaggccagaagcaggccctgaggatactctcttcctgggcaggaatatggtgttcctttcatggagaccagtgccaagactggcatgaacgtggagttggcctttctggcaattgccaagtaagagctgagcaggaaaggggagcctgaggtgggacggaggacgatctggaaagccagtggtgggggaggggaatgtcaggctctacactcccaatcccatcattcttcctattccagggaactgaaataccgtgcagggaggcagcctgatgagcccagcttccagatccgagactatgtggagtcccagaagaagcgctccagctgctgctcctttgtgtgaccccctaggggctaagaggaggcccagagacccttggggatgcagtactccaactgccacaccaactaggagaagctgggggctcagtgggcagcccctgccaagggagtagccattaccctaggttctttagcttccctgcatcatgggaaggattaaatactcatactttatcttaatatacataaactaataacacaaaaggtacccgtatgccccccaaaaccaaaataggtcgggactcggtggtcctttgctttctgggactaagttctaaaaggctgggcctctctcctagcaagagtgttactgcaccagcatagcaccagggggcgccaaagcactgctagggtgtgggagctggttgtgaccccatcaccaatcctcactaagggggtgaaggagaccccagacttctcctctcccagctcccagaaagataataagggccctcatgcagggagctagcccaaagccttgggcaagataaacatggaaattgtcctaagaggaatagcaattactaggtactgagtctgcttggctacctctggctttcccaaccctccttctggaagcgtgcacgggctttttcttcagcacacacgagcagtggggcacctgaaaacactccttcctgatctctggacctcacatcccaggggatgccccgctctcccatggaacctctcttgtcaactttccacctgggttcctagacaaccagaggtcagagtctggaaaaaacttcccctccctcccaatcccgagacaaggtgtacagcaccacggatatttaaggcagaggtcagagccagataaagaacttgttggctcctggaatgggtgggaggcagaactgaacaaagccataggccagtttttcccactaagccccagcttgctcgctctctctctctctccctctctctctttaacttcagaccaatactagggcaaaatggttttatcttttcctcttccgctaaatcgggttgagagggtgggaagttgtcgatttgggggcgggctgatgctatgtgcacaaaacaaggaagtatgagcaagtctggggtacggagaggggcaacaagccctgtaggcccaaggccatgtgtctcccaaagctctgatctgacccttagaaggaaggacactcggaggtgtgcagatccatgaccaaaggaagctttactacatctatataggttgggcagcgagtgaggctccaagaaagtatgcattacacatatctgaggttactatatttgctttcaaggcagaaatcttgctcccagagcaaagtcagcactctaaacttgggttgataaggaaactctctgtgacctctcataggaagatcagggaggagcctgggctccgggttctcttctggggctctgagctgattgctggagctctagtcacatacatagctctgggcctctggcatttctgtttttccagaattaaattgcagtattttggaaaatatactctgaccggtttttccccctctgtttattcccagaaggaggatcgtgttagagagtttgttacgtggcacgttgtgggaaactgttacccaatgtccgaatcattccatcttcacccattggcgtcctcataggttcaacttacccttaactgactaccctcccccacccccagcctctgtggccacatctgcgctggcaagagggagctggaatgcttatctcacaatccaagtcatttttctgttgaacaaagccagtcttccattccctctgaagtgaatcctgagattgactacctagctgtctcacccgccctctctccgtggctaaaggctactgccaaaactaagccctttatttattattcatttatctgttctcagacagcctgtcttccaggtgggctgcaaggagcctcagtctctaccaagccctacaagtttctagaagggatcagagcccaaacctctgtctatatgcatgtccagggatagaggggcggctccacaagaagaaactttgttatttaaacaactctactccggagttattctgttacagttaccctgttacagtgttactgtgttacagaagacatccgtccggttcttaagttggctctggggagggggaggagtgagtgtgggggagcatggggtggtttccccagcaactgtcgctcccctctctcgggccaagctatgcaacaggctttggctcaaggcggttaaagcgttgagaatcctttacccagagactagctcttctaaatccccctccacaacgtggaaaccagagcggagcccgtggggcctctgggctcagtacctggaaccccgccccagccccggcctcggccccgcccgatcagcccaactccgcacttggtaacaaacacttccacttcctgggctctcttttcttctcccgctgcggggtgccgcgccgagtgcaggccacgccccactctcctgattggttagatttgttcaccctggcgcaagagcccggttcgtgatttctgattggtctactgtgatccacacccaccgcgcggccccgccctcgggtttaggagctggggcgggttctggaacgctcagacgccgcgcagggcggggattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagcaggtggtgagccgcatccgcgcagcgttgaacgccgtgcgcctgctggtggtcgacccggagaccgacgagcgtctcaagaagctgggcgtctcgatccgggaagagctgctgcgcccccaggagaagtccgaacaagccgagcctccagcggccgccgacactcatgaggctggggaccagaatgaggccgaaaagagccacttggtaagtgcgggttgggcttggtgtaggactaggattctagagagactcgggcaccccggacttccaagcactttctgaaactcgagcagcgaggaggaaacggcttctgccctctgtcccggagccttcgcagtttctaaggcgagcttcggagtgcgaccagcgaccccaccgccctgtccgggctggctggggagcggagctcctttgccgcctgcatctcctgactgcttgaactttgcgaagacggcgcaaagaaacccagtccccttctctgctcccattccttggattccgccccacaacccggactcattcctgggttatccttgcctacagctaagctaagagctctccccaccaccccccgcatctccctccctccctccctctttctactctcttctcttcagtccctgtggatggtagctcaaagtggcttaaaggctgaataactaagggtccctgggaggaccccttcagccctacccacatcctgggtcctctagtttgtgcatcattaactcacaccggttggacttcatccttctcaagactaaagtgacttctaagaaagagaggaagtctcaacgtctcggagctaggggtgggggtggggtgccgggaggaggtgcagaagcgtcttgggggtggtggctctgccaccccggaggatttatggtcctctggaatgtgaggagtaagcgctcgctagctggtatctgggagcctggtgggaggaccttagaagaggaggaaaaggagaaagatgggtgggggagggagcaggaataggccaggcagcgtcctgcagagccgaccctcgcaggtggtcccgccctggtgtctcctcttctctgtccagcgattgtaagccggctggttgggttttgccagtggttggtatttcccccaaacaaccccagtttggatcagctgctggaggggcagttggcaaaacaggagctgttgtgctgagagcctccctgtcccttagaaaacaaggagggaaggaggccaggttcagggctcagaccctgggagcagggtcccttcagtacgcactggctctctcttcctgatcgataccgccgccacatgtagatcagcggtatccatggagccaggaagatcctccctccacagggaaagggcactgttcagccccgtaaggttgaaggcggagcctgagagtaccaactggtttggtggaagtgaggtcaccagaagcccggttctgccagagtttgactctgggaatgccagggccaccaagttcccactttctgccagtgccaaattggcatcggtaagcagtagtagagcccctggcagcaagttggaacaggtgacctctgctcttaggcacaaacccaatttgaactttgtgccctgtccattgattcaccattcatcccccacccccatccccacccttccaccaccaaccccctccgctcccgcccccgcctcccattctttcctttggactttagcaccagcacagatagccagcagcctcccctcactccacatacacaccaagttgcactctctggttgtactgttgggtgctggagggcagtggcgaggctgctgcggaaggctctgtatcagaatgttttgtatctaaaaagtctgtggctgcctgctggcagatctgtcttcctgagaggacaaagaatcagcatccctaggtggtagtgggacacctaaatttgtgtagatcctccctcaggccaggagagtctagaaccatcatggggcatgccaatcattttcagaatttgattttccccatctctaaaacaggagcagtggcagcgtggcctgtcttctcagtagttacggaaacaataaggagcacttgtggcccgttagttcactgttgcccatgaaaaccccagtcccttcagctttgttcccctaagtgtctctctctactatagagtcgccatatgatatgaggccttgcctgcaacattttcccacaccccatccaatattgcaaaatgtgccaataaacaccaaggaatccctttcctctaaatatgaggcacccagctgagatctgacagttcagcctgtatttgtttgcggagtgggaactgctctgttaatctcaaaggtgtgagcaggagaaggctgttgtagagactggctggtcatggtgggccaggaggaagcaaggctggtgatgacaggagcctggaacactggtggccatccctgggagcccgctgaggcccaggaggtagacagaggtttcttctctgaaacagggtttgattgtggccctctggctgctctgtagaccaggttgtcctcaactcacagaagttctcttgcctttgcatcccaaatgctggggtcacgggcatgctctgtcatcttgagcctccaccttgttcctaaaaacagtatccctcactaagacctgggactttgagctttgtaggggtagtgggtttgttttgagaccagagctcactatgccaccttgggctggcttgaaattatgtagatcaggctggtcttgaactcacagaagagccttctgcctctacctcctgagtgctggaagtaaaggtgcaccaggctggaatttacaaatccggctaagctggttgggcagtaagccttagagattctcctgcctccactttcccagggctaggattataaacctaaaactcctctgtggggtgtctttttgtttttgtttgtttgttttattgttgtttgtttggttggttgtttttttgtttttggtgaaggggttggtctggggattgaactcaggtcctcatgcttgcaagcaagagctttgtcatctatgctatctcgccagcccttcacctgccttcttattgtttttccctgctcagtgccagacatggaacaaggcctaaatccttgagcttgtccaaagtgggccctgggcagccctcctgagccagctcagctgtcctggctggccttcctggagcccagtttcttcatctccctaagcctctgtttcctattgtgtaagttggggatgatggtggtgacctcatgaggttattaggattacataaggatgtgtgtgtaagtcactcaatacctggcactaagtaagtgctcagtaaatgttgattgttggcatttgaagtaataaatagttcacagtgatgatttctccctacctcggcaggtacagctggccaagcccagccctcagaagcgctcaaagatcactgttgtttagtgtttatgtgatgagctgggtgtggtggctcaggcctataaacccagcacatgggaggtaaaggcaggaggattgccagttcaagccagagactggggacagagtgggattctgcatcaaaatttaataagaacaataatagttctatgtagtgccacagacctccacaaatttgctacccaccctcttactctcggccacagcaaagattcaaatcccctcaggcaagctgcgtatccctgtggccctgtacacactgtgctgatggcctctactacatgggaagccccggggcacagccttgggttattccaatcgctgttaccaactcagctctgaacctactctagggaggtgttcaataaatggtatttgaattaatgagtgaatatatagtagctataaaggacctttatcccagttcatcccggaccagcacacctgggcttgtttatgcaaccagtccacccagagatggaattccagatagaatcaacctactccttgctgacagggaggccaaaagtgtaggctttagggtcaggcacagtagcctggagagtctccgctctgcagcttcctggctctgaaacgcaggaagttcctcagtgcctgcaaaccttagctccggtgcagcgaggcagggtaccagtccccagcctgcagggctcttaggcagatggataagatgccaggcatgagtgtgagagcacccaggttcatctgggttcctcccagctttgaccctggtctagaggcaaaggtagtatagctaccccaggcagcaagattaggtaggtgggtacagtgagtgagccgactgacatgcagctgactcctccgcaggcagctgacaggtttactttggctacggtggaacttcagaagggcctactttggaaggaagctgctggttacttggatttgaaacagacaggtcaaggcccagtgtggtgatgcacacttttaatcctggtactcagggaagcggagacaggtggatctctgtgagtttggggccagccagtgccacacagtgagaccctgccccacaaaaagaaagagaaatggataggttgtgccatattggggatcatgttctctacgggttaaatgacagagcccctgcttctcagttcacctcggccagtttgtctggagtgattgtttccgagacgagacagaacggggctttctctggaaacctcagacttccccatctggagcctctgggaaagtgggaggacgctgagacctcagaaggccaaggagcagtgtcaaaatctgctggagctgtgactcttctctgagtgaggaaaatggactatagtggctgatcatacggtcctagcctgcccctaaggtagagcggacctatttggaaaggaaacttatttaatgcatgtgactaccatcacaagtaggtctcttacggggtggaaatagctgttaagatggttctccactagcaagcaaggtgtcttggctccccagtcatcactccattgtgtctgtacctctctttggccacacagttgggtcgagcttcagaaccagctcttcagataaatctggaccacatgaggatcatcacagaggcaaaactcacaggcttctttatgcacagtgataatctgtggagcttacgtaaggctacaggttcacatcccaacaacacagacatacaaaattggcagttcgggctgcttgacccagcttccccccagagttgggataagaaattcttgttgggccgggcagtggtggtgcacgcctttaatcccagcactcaggaggcagaggcaggtggatttttgagtttgaggccagcctggtctatggagtgagttccaggacagccagggctacacagagaaaccctgtctcagaaaaaagaaaaaaaaatcccacaaaaacaaaaaagaaattcttgttggagccaaagcttttaggcatgctatctttcagcaaagtatggatacctcctagtaagtagctcagcccagaagaagtagttcctatcctttcatgggtggggtccactcctcccaaccctaccttcccttgctagttgtgccatccctccccgaacccccagcctctgaaagcacagagattccaggaggctggccttgaaggttgcctgagcctttctttccttccaggtagaacaacctaaccttttttatatctccagccatggcaatgtctctcagtccttgtatcctaaacaaggacactgtagattccctggggtcagacagcttctaaaggcggcatggtaggtaacatgtggagaacattggccagcttcagatctcactcccatcacagacaaaagcagcctctctgtgtatgtgttaggtcacgggcccaaggcccatagcagcttcacagagcagagcatagttgggctgtctggtttcagccactggccacatgaggtgtccaagcggaagtactctgaacgtgagaactggctcaggttgatacccttcacctatcattcttggaactagaagtgttcagaactttgggtgtttgccaactttggaaaattttcccaaacctaagatataggggcaagaccccagtctatacacaaaattcactcttgtgtctttttttttttttttaaagaattatttatttatttcatctatgtgagtacattgccactgtcttcagacacaccagaagagggcatcagatctcattacagatggttgtgagccaccatgtggttgctgggatttgaactcaggacctctggaagagcagccagtgctgtgctcttaaccacggagccatctctccagccccacctgtgtcttatacgcctggtggtaatcacattttgtttaggaaccaaagcttcctagtatggaattttccatctgtgatatcatgccaaaaaattttcagatttggggactaggaacatagttctgtcgatagagtgcctgcctagcgggcatgatgccctttgttctgtgcacagtggcacataaaactgggcctggtcttcttggaactataggtggaaggtcattctttcatctgtaatgagtctgtggccgggccaacctgggttacaggagaccctgcctgggaaaaagaatccgatttttgggtcaagttgtactttggattttcagattaggaatactcagcctgcaaaaatacaaaaaaggtaaactacccaggcagtggaggcaaacatctttaactccagcacgcaggaggtagaggcagaggcagatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggccttaaactcagagattcacctgtctctcctttccaagccctgggattaaagatatgcaccccccacactatttcagatttttaagcaaatccgtacattgaaatggtaatattttgattacaatgtgactatctacttgaggggaggggtgaaactcactgtgtagaccaggctggcctcctgctcactgaggtc

SEQ ID NO: 1718 - DNA, 607 bp, Mus musculus
catctcctaggtgatgcttcttggagactcgggcgtcggcaaaacctgtttcctgatccaattcaaagacggggccttcctgtccggaaccttcatagccaccgtcggcatagacttcaggaataaagtggtgacagtggatggtgccagggtgaagcttcagatctgggacactgcaggacaggagcgcttccgcagtgtgacccatgcttattaccgagatgctcaggctttgctcctgttgtatgacatcaccaaccagtcctcttttgacaacatcagggcctggctcacagagattcatgagtatgcccagagagacgtggtgattatgcttctaggcaacaaggccgatgtaagcagcgaaagggtgatccgttctgaagatggagagacactggccagggaatatggtgttcctttcatggagaccagtgccaagactggcatgaacgtggagttggcctttctggcaattgccaaggaactgaaataccgtgcagggaggcagcctgatgagcccagcttccagatccgagactatgtggagtcccagaagaagcgctccagctgctgctcctttgtgtgaccccctaggggctaagag

SEQ ID NO: 1719 - protein, 192 aa, Mus musculus
VMLLGDSGVGKTCFLIQFKDGAFLSGTFIATVGIDFRNKVVTVDGARVKLQIWDTAGQERFRSVTHAYYRDAQALLLLYDITNQSSFDNIRAWLTEIHEYAQRDVVIMLLGNKADVSSERVIRSEDGETLAREYGVPFMETSAKTGMNVELAFLAIAKELKYRAGRQPDEPSFQIRDYVESQKKRSSCCSFV

SEQ ID NO: 1720 - DNA, 38054 bp, Homo sapiens
  misc_feature (1)...(38054): n = A,T,C or G
aatacaaaaaaattagctgggcacagtggcatgtgcctgtagtcccagttacttgggaggctgaagtgggaggatcacccgagcccagagaggtcgaggctgcagtgactcgtcatcatgagccacagcactccagactgggcaacacagcaagaactcatctcaaaaaaataaataaataaaataaaataatttgctcacaattacctttctttttcttttccttttttttcttttgagatgggttctcactgtgtcaccaaggctagagtacagtggtgcaattatagctcaatgcagctgtaattctggaaaatctcctggactcaagtaatcctcctgcctcagcctccccaatagctgggaatacaggcatgcaccaccaagcccagcttattgttttatttattgtagaatagggtcttcctatgttttcaagctggtctcgaactcctgggctcaagtgatcctcctgcctttggcctccccaagcactggaattacaagtgtgagccactgtacctggccaagcaaattatttaaataaattttttaaaacatagaaaaagattaaatgaaaagtaaaagtcttatctccatttcccacctaccagccccagaacctcaaaggcaatcctcttggcctctattgcctccctgagaaaagttaatcatactccagcagataaacctaagtaacatatacacattcatcatactatatacatcactctgccccctgcttcttttgcttaataatgaactttctcccaaacagtgagacaggagagttcctttgacccttttgcaggtaggaactggagggcaccagctctgggtccagtcggccatttaggcaccagcagggacgaactttacttgctcgaacccactgggttcagcccctcgtgagagggagcacacaggcaagtgggtgctagggctgggacgagtacttttgggctctggccccacggcagcatgaaggggtgtgttacaattaaggttcttttaggccaggcatggtggctcacgactgtaatgccagcactttgggaggccgaggtgggtggatcacctgaggccaggagttcaagaccaacgtggccaacatggcgaaaccccatctctactgaaaaaaaaaacccaaaatttggcagggtgtggtggcgggtgcctataatcccagctacttgggaggctgaggcaggagaattgcttgaacccaggaggtggaggttgcagtgagccaagatcccaccattacactccagcctgtgtgacagactgagcctctgtctcaaaaaaataaaagaaaagaaaaacacaattaatgctcttttagcagttgccatccacagatggctaagtgttagccagctcagcggagagtcaaggtgacagcctttttacaccctgccctcttggtacagagttaagtgttaaccagctcagtggagagccagggtgacagccttttacaccctgctctcttggtacccgggttcttgtcaggtgtccaggaagaatcaggtcacatagacttgaaggatgatgaatgcggagattttattaagcggtggaagtggctctcagtggaaggggagctggaaaagggatggtgtgggaagaaggtgatctttccctgaagcctggctggagataaccgggctcctctctgaagccgtgccatctgaagttaagccgtgtctatccgtatgctccgatgctcagttgcttccactcttgacgttcagctgcttgtctcttctctccttctcagctacaccactctgctcgtctgccaagagctttttatgggtacagggctggggacatggtgggccagggtggttttggaaaaggcaacattcaggcaggaaaacaggaatgcatgttctcatttagggccgcaggtccaggcttgagggtggagccatcgccaggacctcgccctcttttacccagtatttccctgctgcaacagggacatacagtacatacagatcttcctcatccttttactgttttcacagtactgcattgtatgtatattctagagtttacttcactagtctctactgctgaattatttgttcttacaaacactacaatgagcatccttatacacatatcttggtttactttttttttttttttttgagatggagtcttgttctgtcacccaggctgtagtgtaatggtgtgatcttggctgactgtaacctccacctcccaggttcaagtgattctcctgcctcagcttcccgagtagctggcattacaggtgcacgtcaccatgccctgctaatttttgtattttcagtagagacagggtttccctatgttggtcaggctggtctcaaactcccaacctcaggtgatccgcctcggcctcccaaagtgctgggattacaggcatgagccaccacgcctggtcctcttggtttatttttgcaaggaaagccatagagttgctgagtcaaaggaatttgcacttgaaaccttgatagatattgtcagttgctatccaaaatggttgctcaatgtatactcccactaatagtgtatgtatgagtgcctgtttccccaaatctaagccagtactgaccattaccaaacttttatcaagccgctatacattatattgtcattgtatcggttagggttctccagagaaacagaaacggtaagctatatatatggaaagaaagagagatttgtcagccaggcacagtggctcacgcctgtaatcccagcactttgggaggctgaggacggtggatcacgaggtcaggagatcgagaccacagtgaaaccccatctctaccaaaaatacaaaaaattagccgggcgtggtggcgggcgcctgtagtcccagatacttgggaggctgaggcaggagaatggcgtgaacccgggaggcagagcttgcagtgagtcaagatcgtgcccctgcaccctggcctgggcgacagagcgagactctgtctcaaaaaaaaaaaaaaaaagaaagagagagagatttgtccgagaaattggcttacatgactgggggctggcaagtccaaactctgtagggccagcccaaaggctgtaaattttcaggcgagagttgatgctacaaacacgaggcagaatttctgcttcctcagggaaacctcagttttgctcttaaactctttcaattaatcagaggacactcacccagattactgaagacttaaagtcagctgcttggagatgttaacaacatcaacaaagtaccttcacagcaacatctagattagtgtttaattgaataagtaggactatagtccagccaagttgacacataaaactaaccacatgtacacaaaaatatatcaacctattcacatcctttgttcacttttctattgaagttttcttctgagagctctccttatatgagggatattaccatatgtcatatgtctcgaaaatatcttccctgtaccatttctcattcgactttgtttgtggaatcttctgtcaaccaaaacatttttattgcagcaaatctatcgatcttttctttatggcatctgaatttcctgtcttgttaagaaggtcactcagagccactttaggagccatggtaaccatcccatttatcaggttttctaaaagctgtccctgaataataaagtcacagaaaagcagcaatagtgtacttagacagcattagcctggctcccattgagaggcctggataaagtaggatttaatgttatgccctgcatttatcaagggtcgatacaacagctttagaaaaagctttgcgtcttccgcaaagttgcaattgcccattttgttattcaaggccccttgcagaaggatccacttaacagattatagcagtgtataacaggagaaaatactcgatggaaaggactcaggcatacaatgtcagacaagtaccatacaccccacctggttttcccctttgccttgattgtcaggaaacctataaccaaacacaatgctcaaacgcagtaacaacctaacctcactctgggatggaagatttgccccagcccaccccacccctacacacacacccctattctttgtatattttttcaggcaatttcttgaactgccttctcgtacttgtgggtttgtttgaaaccacctgtccccattggaagtgaatgaggcacaaatacagatataaacaaaatgactcaagaaagaacaaagacgcttgtctgaatggtggcaaagttgacccagaggtttctgtctgaaccacaattaactaactttttttttttttttttttttgagacggagtctcactctgtcgcccaggctggagtgcagtggcgtggtctcggctcaccacaacctctgcctcctggattcaagtgattctcgtgcctcagcctcctgagtagctgggactacaggcgcgcatttttgcctggctaatttttgtatttttagtagagacggggtttcactatgttggcaggctggtctcaaactcctgacctcgtgatccacttgccttggcctctcaaaatgctgggattacaggcatgagccaccgcacccggccgtaacattttcataaatgcgaagagaaacacaaagagggaaggcatggtgacaaatctggacccaaagttgacattcagcttctccaagcagtgaaactgggaaccaacttggagaaatttaaggaattttcagcagctgttgggtggcgagagaagctctgctgggttatctgtgaaaccagaaaatctgagacaagtctcagttaatttagaaagtttattttgccaaggttcaggacgtgcccatgacacagcctcaggaagtcctgacgacatgtggccaaggtggtcagggcacagctaggctttacacattttagggagacatgagacatcaatcaagatatgttaagaagtgcattggtttggtctggaaaggcgggacaactcagaagcaaaggcagaagactggaaacatggagggagcttccagatcacagatagttgcattcttttgagtttccaatgagcctttccaaaggaggcaatcagatatgcatctatctcagtgagcagatgggtgacttagatgaatagatgggaggtaggtttgccctaagcagtttgcagcttgagctttccttagtgattttgggggcctaagatattttcctttcacatatctgtctcatgtgtccgtgtgaagagaccaccaaacaggctttgtgtgagcaacgtggctgtttatttcacctgggtgcaggcaggctgaatccgaaaagagagtcagcaaagagcagtgggattatcattggttcttacaggtttggggataggcagtggagttaggagcaatgttttgcgggcagggatggatctcacaaagtacattctcaagggtggggagaatagaaaagaaccttcttaagggtaggggagatgacaaagtacattgaccagttagggtggggcagaaacaaatcacaatggtggaatgtgatcagttaaggctattttcacatcttttgtggctcttcagttgcttcaggccatctggatgtatacgtgcaggtcacaggggatatgatggcttagcttgggctcaaaggcctgacaatatctaaggtaatggatttaggcagctccatccctaacatttgggggccagggctagaatacaaatggaggcccacataccatgtgtctcagtatcttaacattctaaagcaagctcaaaaagctacaaaatcaagtgtgtctaatcttccctcctgaacaaaataccttcttaccaacctggaagccaggttagcatgtaggattctcagaagttccacactaaaatgtggcagcctagggacaaacaacctcctgtccccagccccccacccacaagctcctctccttctcctcccacccttgggcaccccaaccccaaaggaattttcagcagctgttgagtggcgagagaagacatgtaacaagtgcttttggtttggtcagaagaatgcatgaggctccacatccaagctctgtccacagcccctgcaaatcgtcaccccttggccacaccacagacctagggatgccaccataagagcaaccttggggaaaagtgcagtcagtctacaggaggaataggagcctttggccatgtggacacctcgcttcatggggaggagcacagagaaggagcaggcctaagggaggtcctaggtttaggaagagatcattcaacaatgcttgtaaatagaccagcgctgagctctccacgatggcctaggtaaaaagctcttagagtcattatcagtagatttttttttttttgagacggagttttgctctgtcacccaggctagagtgcagtggcatgatcttggctcaccgcaacctccaccacccgggttcaagggattctcctgcctcagcctcccaagtagctgggattacaggtgcctgccatcacgcctggctaatttttgtatttttagtagagacagcatgttggccaggctgacttcaaactcctgacttcaggtgatctgcccatcttggcctcccaaagtgctgggattacaggcttgagccaccgcacctggccattgtcaatagatttctaatgctgataaaaaaaagacctagcagggcattgtggcttnnnnnnnnnnnnnnnnnnnnggcattgtggcttacacctgtaatcccagcactttgggaggccgaggcaggtggatcacgaggtcaggagatcgagaccatcctggctaacacagtgaaaccctgtctgtactaaaaatacaaaaattagccaggtgtggtggcgggcgcctgtagtcccagctacttgggaggctgaggcagaagaatagcttgaactcgggaggcaaaggttattgtgagccgagattgtgacaccgcattccagcctgggcgacagagagagactctgcctaaaaaaaaaaaaaaaaaagaccatgaccaatatgagaggatcatcctgccccaccccgagccaaggttcagctgaatctgaaatgctgaaccctatgtgcacccccggacctcagtgagctggaaaatgtcccgagaagacaggactgtttcctatgatgaaaattgatggaaactcctcaccctggaaaggaaaaggataaaagtgaaaagaattagaatctgtcacattctttaagacacgaatgaggggaacgtggatggactacccctcacattctggaatattctctctaggaagcacttcttaaagcctgaggaagttagattctagatgtaaattattaaaaccactgcacataacaaacaaatgagttctctaaccaggaggaaataaaagctggagaggttcaggaggtgggtgggggcacagtcatgggacatccaaagtcaatgccatggacaacctcatggtaagcagacgctgatatgcattcccttccatgtcactgccagagttgaacagtggctgggcccgacccaaagaggcccagccaatctctatgcttttacggtttagttgtttttatgtctttatgtttttacaagtccagctaaagtttgcacctcctagtcctttcacacagtcttgaattcttgtctttggaaagaggccactgtccactttacactaaggcatttatccactcacccattcattcatccattcattgagggtaccagcctctgggtgcatgtagagttcttctctgttgtttatgattttctttcaaacatttcatctgaacttccaagctaattatcgccccttctccctcccagttcagacctcccagaggaaggcggccttccccctcttttcccagaatctgcttctctttgaaatcttgtcttctccttgttctaagtccaagtgtgcaaggcacataccagctatctgattttgttttattctatagactggatttttggggctctcccacacaggagatctatggacattgtgttagtcccggtcttccgaagaggagatgtgaagagggaatcaaatgtgcaagggttttactgagggaaatgcctgtgagagaaatagagtaggtgccagggaggccaggggagccttcagaccatgatgcaggttggatccccgtgaaggaaagagggcagaaaggttgcatggaagcatcccagaccaccttgcagtatctggagggttgtgcaaggccatgagggagcccttgagctaactcaaccgttagaggggtcctgtgtctcccaggaacaggcctgcctcagtgtccctgctgtgctccgcctttggctggtaattgcctgtaggaagcatgaccttggtgcaaacatgacaatgatggctttcagagcacggcagtggggaccatcggtcatggatgcccctgtggatggaagtctgagagacacattctcatggtcacttcagatgctcattaacttggagggagatctcctctgtgccttcatgcccctttcagtgacttcaatagaaaatcgagactttagtgtgtttgtgtgtctgggtgtatgtgtgggtatctgtgtgcatgtgtatgtgtttttatgtgtgtgtgtctgtgtctgtgtttgtgtttatgtttgtgtgtatatctgtgcatgtgtgcatgtttgcgtgtatgctgcatgtctgtgaatgtgtgtgtctgtgtgtcggtgcctgtgtatatgtgtctgtgtgtctgtgtgaatgtgcatatgtatgtgtatatatatatgtgtttgtgttatacatgtctctgtgtatgcatgtctgtatatgcatgtctgtgtgtttctgagtttctgtgtgtgtgcatgtgtgtctgtgtgcatgtctttgtatatgtttctgtgtgcatgtgtttgtgtgcacatgtgtctatgtctgtgtatatgcatgtctgtgcgaatgtgtgtttctgtgtgtttgcatgtgtgcttgtgtctgtatatgaggatacatgttggtgtacatgtgtttccacatgtctgtgtgcatgtgtgtgttctgtgtgtatgtgtgtgtttgtgtgtacatgtgtgttttatgtgtactatgtgtatttgtgtttgtgtgtgtagatgtttttgtgtgtatgtgtatctgtgtgcatgtgtgtgttctttctatgtgtgcatgtatgttttgtgtgtttgtgttgtacaagtgtgtctgtgtctgtatacgtgtgtttctgtgtgtacacgtttttgtgtctgtgtgtgcatgtgtgtttctctgtgtgtgcatgtgtttgtgtgtgtgcctatgtttctgcatcatgtgtgttctgtgcatatgtgttgtatgtgtgtatgtttatgtgtgtgtgcctctgtatgcatctgtttctgtatgtatatgtgtgctctgtgtatgcatatgtttgtgtgtgcatgtgtgttctgtgcatgtgtgtgcatgtgtgttctgtgcatatatgtgtacatgtgtttttctgtgtctgtatgtgtcttgtgcatgtatgtttctgtgtcatgtgtgttctgtgcatacatgtgtacatgtgtttttctgtgtctgtatgtgtcttgtgcatgtatgtttctgtgccatgtgtgttctgtgtgtatgtgtgtacatgtgtttttctgtgtctgtacgtgtcttgtgcatgtatgtttctgtgtcgtgtgtgttctgtgtgtatgtgttgtacatgtgtgtacgtgtatgtgtgtgcttctgtgtgtatgtttctgtgtgtatgtgtgttctgtgtgtgcatatatgtttgtgtgtgcatgggtgttctgtgtatgtgtgtacatgtttttctatgtctgtatgtgtgtgtcagtgtcttgtgtgtgtgtgtttctgtgtgtgtgtgtgcatgttgtgcacatgcgtgcttagaaagaatccactcccacagccacaaggacacctctgaggccaactcacatcacaggccctcagctctctctctattgttcccttccagaccatcctggtgggtgacagtggtgtgggaaagacgtctctgctggttcagttcgatcagggcaagttcatccccggctccttctcggccactgtgggcatcggattcacggtaagcactggccggcactgccagctctgggcctgggctcaggaccccagcgtgtttctgttgagtgccagcaggaaacaggtggacactcgcattggatcattcaaggaggattaaggagaagactgttccccaaggtgtaggagggtgttgggtgaccaggagggagggtatactgcccctgggtagtccaggaactccgcccacctctagcctcaagcaggaagggaaggcaccctcaccagaacccagggacaaagcaggctgctgggtgagctgcctggcaggagctgcgtgggactttcagtggagggacacagcagcccatgggagccccccagggaggcagccaggagaacaatcccctgtcccaccttgctctcctcctgctccccatctccttctggggctccacattggatgaacgcaagtggaagccagaaagcaaaaaatattttaatatgggatagctcaggtcagccctccaaggcaagaagatctggagggacaaagggacgacaaagttttcagcacagtccaaacttagcagtcacacgggtctcagggagctggcaggcccaggttacagttccgtgtttagtcctcggtaaaatggtaaaagggcagctcgggttaaggaagcccagtgccctcggctttttctgcccgcagcccctctgcgagacaagggatccctcctttaccacacatcccatctccccgcgttgtcccgtgcctgcggctgcagctgcccttgaattcctgggaagaccttgggagagggttccactcctctctcgggctgtggcaggaagagcagggccttcccttgggactccagaatcctagcatctcaagatggggaagagcaaacatctcttcttggacaacgcggatgtttgggaacctctgagaccagagcacagggcctgtgagatcacgctcagggtcaggacgcagcagtgccacactgatgggaagagagagaggaaaactcagaaaaatgggcttgcccactgggtcacagccaggaaggcaggggttcagaatgaacatggcttctgcatgaccttccaggaggcaaagcggaagtgagtgcctggttcgggtgtgttctggggcctagaatcggccctgaaacaccagttcccagggctctccccagactgggaccggctgggctctggtagtgctgaatagggaagggctgagacccaggaggccaaggctacctggcaatccctgaggtctgggaccaggctgccatgaagcaaaccaggatgacctggtgccaggcgtcacccaccccagcccaggcccagtctgctctcagcagccagggcacaccctgccctcagggtcacacccgcatctcctcacccacccttctgcctgtctggtgaggaaggaagagagtggggtggatgtggctgtggacatgcaaagtctgactcacgttccacagaccacagaggtgagatctccaaattttgccgctagcttggcaagaaaattgaggccgatttcctgtgaaggaaaaagaaagtgtgtggtcaaactgtttgtctagcctgagatgagacacactgggctttcccactgacctcagggtgggcctcctagagcctgggctgcctgcttggtaccagccagcacccgatgttctggtgcatctcaggacaaacctgttgcctgcttacgctgagtgaggacctgagcccctggccagaaactcagcctggggacacctgagcaaagaactggtggacatcggggtctcctccagatatcagcggtctgggggtccccggagagccaggctacaagacacttgtttacccatctgtccttctcacggagatttgagatatggcatggataagggccctgccgctggccaggctgtagcctgcaactcctgcatgatgggaagggaggcaggtgctgccacaggctccgctcaggaggctgagtgccgcccaggtggcaggggagggacagagcccctggtctcccactttggaggagccagaggtgagcagggtgactacctcgggcatgccttcacccataaactaccaggcccatcgccttctggaagtgggacctgcccaggtcctgtgtagatgcctctcagtcaagaccttccctaaattctccactaccagccccatcaaactggctgtgggggtcgtgctgatggggttatggcacactgatgtcgatggggttcacacaggggtctttccagtccaccacagttcaggtcctccttgttacctctctcctcagtttcccccaaattccctagtcttgcctaaacactgatgcaaaattcctctttcaaaaccttcactcaggccaggcgtggtggctcacacctgtaatcccagcactttgggaggccgaggcgggcggatcacttgaggccaggagttcaagaccagcctggccaacatggcaaaaccccttctctactaaaaatacaaaaacgtttgccaggcgtggtggcacacgcctgtaatcccagctacttgggaggctgaggcaagagaatcacttgaacctgggaggcggaggttgcggcgagccaatatcatgccattgcgctacagcctgggcaacagagtgagactccatctcaaaacaacaacaacaaaaaaaaaaaaacacctcactctgctcatcccccacctgaacattcacggttcactattaccttccaaataaagtctgaatctctcatctgttggtcaagctgttgcacagtttagaccagtggttttcgaacactccttcagcgcacataaaagcctccagggggaagctcatctgaaatgcaaattctaagctccctcatacacatgctgcttcagtaaaaccacgtggggggcccagaatctgggggttctgacccagggggtccatgcgccacattttgcaaaacatgagttgaggccttgtccctccagtctctgcccgggtctccttcccacatcccgaccctgtgctctttgggctgtgctgttccccagctctgaagttttctgccatcgacctggatagcagggagtcccctgcccccatctctgcaggtgtgatttgaggtgtgtgtggtgaggtgatttgaggggtgtggcaggtgtgtggtgtgatttgaggtgcgtggtgaggtgtgtggtgtgatttgaggggttaggtgtgtgtggtgtgagtgtgtgtgtatggtgaggtgtgtgtgtctggggtgtgatttgaagtgtgtgtggtgtgaggtgtatgtggtgtgatttgatgtgtgtgtatgtggcgtgagatgtgtatggtgtgatttgaggggtgtgtggtgtgacgtgtgtggtgtgatttgaggtgtgtgtgatgaggtgtgtggtgtgatttgaggggtgaggtgtgtgtggtgtgaggtgtgtgtggcgtgatttgaggtgtgtgtgtgtggtttcaggtgtacacaagagcccccccatctttcaacacgcatgagggtctgtctcactgacacttggtacctccactatcagcagggctgcatgacaatgacagtgtgatctgtgatcaggagggtaggggtgtctatttgggggtattgtgggggtgtgcgtctcagatctggaggcaataagaggtgttgggggtcatttatagggtgatatacacatttggtgatggtgtgaggcatggggtccattggagaggcaggtgtttgcacagtgatgtggcacaggtgttgatggtgtgaaataaactgtgcctggagctgcactgtggtgacaggagtgtgtgtttggagtgaaatgaggtatgtgtgtttgagggtcatgtaagatgtgtatgtatgtggtatgatggtaggtgtgtttgtttatagtatgaggtgcacatttgtggcataatacaaagttgtgtgtgggacatgttatgaagtgtgtgtttgtggtataatgtagggtgtgaggcatgtgtatttatggtatgatgtgaggcagatgtgtgtggtatgatgtagggtgtgtgtgtatatatgtggtgtgatttgagagtgtatgtgtgtgatgtgaggtgtgtgtgatttgagggatgtgtgtggtgtgaggtgtgtggtgtgatttgaggtgtgtgtggtgaggtgtgtggtgtgatttgaggggtgaggtgtgtatggtctgaggtgtgtgtgtgtggtgaggtgtgtgtgtctgtggtgtgttgtgggtgggtgcacacgtgtgagtgtctgtggtgtgtgtctggggagagacacaggctaccacagcgcatacacagcctcagagtgaacgttaggaggcccaggtttcctccccagagaccacacggatcccttagtgagtccctattctgcacagcccctgttccctgttctgaatgtcttagaccctaacccacttctgactcacccgaggctgcccttgaacaccctacaggacattacagtggccctggggacagtgtacgcaccctccaagtatgacattacccacataccacagacccagcaggcctgcagcccctctccccatgttcaaagacttcttccctaggtcagattcctccatccagactagtgcagcaacgcagcagggaagtgcttcaggccactgctccttctggatgattcgtgctaatgttcaaccttctgtattccaaacccaccataggacaaagagggccttggagccaacaacgtgaaccacagctggaggctagaaatctgaactcaaagtaccagcagggccacgctccctctgaaggctccagagaagggtcattccttcctcttccatggccttggtggctcccaggagtccttggcattccttggcttgcagccacactcctcccatcttgcctctgtcttcacctggatgtcttttccctgtgtctctttcttcttatgacaccggtcatactggattaatggcctgccctatattagtataacctcatcttaatgagtgatatctgcaatgaccacatttccaagtaagggcatgatctgaggtactggtggttcagacctcaacctgtctttgggggacagaattcaacccataacagcatggtttacagtagaaggtgagcatgaggcatgccctgtcccctctctcattcttcctccaccatttccctcctgcaatgaaaacccgcatcctggctgggcacagtggttcacacctgtaatcccaatactttgggaggctaaggcaggcggatcacctaaggtcaggagttcaagaccagcctggccaacatggtgaaaccctgtctctacaaaaatacaaaaattagccaggcatgatgatgggcacctgttatcccagctacttgggaggctgaggcaggaggagaatggcttgaacagcccgggaggcggaggttgcagtgagccaagatcgtgccacttactccagcctggatgacagagctccacctcaagaaagaaacaaaaagaaagaaagaaagagagacagagagaaagaaagggaaagagagagaggaaggaaggaaggaaggagagaaagaaagagaaagaaagaaagagagaaagaagaaagaaagaaaaagaaagaaagaaaaagaaaggaagaaagaaaaagaaaggaaggaaggaagaaagaaagaaagaaagaaagaaagaaagaaagaaagaaagagaaagaaagggaaaagaaggaaggaaaagagaggggaaggaaggaaggcaggcaggcaaagaaagaaagaagagagagagagagaaaggaaagaaggaaagaaggaaggaagggagggagggaggaaggaaggaagggagggaggaagggaggagaggggaggggagggaaggggagagaaaagaccgcataccaggccaggtgcggtggctcacgcttgtaatcccagcaatttggaaggccaaggcaggcgtatcgcctgaggtcagcagttccaaaccagcctgtccaacatggtgaagttctctactaagaatacaaaaattagccaggcgtggtggcgtgcacctgtagtcccagctgctccagaggctgaggcaggagaattgcttgaacctgggaggcagaggctgcaatgcgccaagatcccgccactgcactccagcctgggcgacagagtgagactccgtctccgggagcccacggcattgagcaaacctcggcattatttgcagcaagagcctctggcatccaaatagcaaccaacaccacgcctctgtagtgtgctgcgcagcctccacactccagtctgaggctccctgtttgagtcccgccctatgcccagctgaggttatagcacgctcacctccagaagaggtaacccaagctctttactctactggagatcacctctgtccccactctgggcgcttctcccagctgacagaaaatacctccagctgatgtcagaaaatacagggctggaggctggcgtacaaagtcagtccccacaggcctatggtggcccataagccacgtctacccctgctcctcacctccacacctaagttaagaattgcaggccgggcgcagtggctcacgcctgtaatcccagcactttgggaggctgaggtgggcggaccgcctgaggtcaggaatttgagaccagcttggccaacatggcaaaaccccgtctctactaaaaatacaaaaagaaaaaatagccgggcctgatgtcgcgcacctgtaatcccagctactccgggagactgaggcgggagtatagcttgaacccgggaagcaaaggttgcagtgaggcgagatcgcaccactgcactccaggctgggcgacagagtgagactctgtctgaaaaaaaaaaaaagtgcaggtacccctctccagctctcccctccctacacatccctcaaaccgtcccgctgtaatgcacccgccctgttccttggtaacttgaagctgcttatagaatgtggagatgggggtaattgaaaggtcggcccaggccacagagcccctgagctctgctaccggcaaccccagctgcactccccactctctgtcaccaggagctgccgggtgcctgggatatcctggcagctctgctcaaaatgatctacgacttcatgaatttatttggctcctcctcggggccagggtgagtgtcatgggttaataaggccggccccgccttcaggagcggtccactgggagatgtgtgctgcgcagccctcttgcgaaagctctcccctggtgggacattctgggcacaaccaacaggccgggggaaatgagaggtgatccatactaaagggtcaaagtccccgcaccaggcagaggccccaaaacaccgcagcgtacatgtgctgcaaggcgagtacgggttggtaaacaaaactatattcagatgagctcgggccgggtgacttaacagatgaggaagtgtctcggggccatcggcggaggcgcagcccaggggtccccagctccccgcctcgccacctggggacagcccacggcccggggctcgggcgccgcctgctgtcgcggtgcgcagcgactacgggaactcttccgcagcagacggggtccccgcggcccgctcccccaggggcaagcaagcgaccacaggggaccggtcccggggctggatgtggctcatgtccgaagcgcacggagccgagccggtgttgctcagggaggctgcccgccccttcacgcagaccctgcggctctgcgtgccctcagggaacagcaaggtccgagccggtgtcgtcgagggggcgacgggacggagggaggagcctgaggggtcccggtcgagggaggggaggagtgggcggggcgggggtggggccgttcctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaaggtgggtgggcctcttccgtgagacccccgccctcctcggcgctagccccttcctggctgcgtctgggttggactcagcccttcccccaggcagctgcgtctcccagaggagggagggagagagggtcaggacacagcctctggggccgtcccaagctctaggtgtctctgctggcttggtgggggcgggtcgcggaagatcgcaaaaactgagtgatccccccgccggccccaactcagttctcttctgccacactctggcaaatatgagcccccgggagcccatgcttcttggtgagggttaagcgcgcaactctcggggctcaggctgggaagggctgggagatggggaccgaacggagactcggagaggacgtcccctgctggcagaggaactggcgttaatgccattttccgagctaagctcttagttgagatctgacatccaggtttaaggcctgatgtcccccagctgctcccctcccattccacccgctggaggcactgcctcccaccttcctccctgcagtcggaagccgctcctcccagaaggatgttgccagccggcctgcaggtcacttgggaatttttcgaacctgagaaagatttcagtggttggtctttcgcatcccgcacttgagagagctccagggctgctctctggggcttgctccctctacaggggtgtcctgtatggaaacaggtagggacagcagtggactggtctgtcgccttccatctgtgtccttggagtgagcgggtaccagaaactgaaagaactgctgagggagcctagagcttccactcttcctctgcagggttggggatggagtgagggctgtcctggattccgctgcatggccttgaaggagacctgcctctctctgggcctcggtttcctccccgacaccagggctcacccttgctgggagcctcagcctccaccccagtgtttcgggggaagccaccctgcaagtcatccgcccagagccgttgagataggcgtcctgtgtgggcttgtggcaggaaatgggcccctgcaccctcggagaggaggagctgctgttggccaggccccaggctgagggggactgcctgaccttgttgccctgcaaaccagctgggttgtttgcctaggaggtggccaggctaggcagctgtttgtgtttggtggaatcaccgagctgggtgggtagctggcatcgtttgctcaaggcagctgtgatctgtaaagtacacaaagactggccctccctccctccttcctgctccagggctgggacccaggagccagggaggagtgcaggctccagaaagctcctatcccccaccccttcatctgttccctggccaagcggcattggccggagagttggtccccagcctccccgggcctgccccaggggagtgagtccaggaccctctgagaaagcctggcaggagctccttggaccagactaggggtgatgtggcccacaggcagacagttcccaccctgggccactcttccctgggtcttaggtgattcaccacgatgatgggccctagccattaacagactctagaaatacctcaaagacattatccctcctccttctacccactatggaaaccatgccacagaaaggttaaggaatcttcctaaagtcacacagtaggccatttacaaatcaagacccatccttcataccccttctgctcagccacccctgcctctccaccagagttaactaatgccagtaccccatgcccacaacaggaatgcctttgggctccactgtcaatttcagagcctcaaaaataattcaaacctagtccctgcttaacccattaagccacctaaccagcagctgggaaattccagcattggatctagacccctgttatccaagattggagaacagtgggacaaagtgctcctctccaccattcctgcgtgtccctggggaagatgagcagagcagagccagacagtaaaggagagggccacgccccctccacaggttacctccttggtactcctgcccgcactacccacagcaaccccgggatgccgatctgcagccacatgtcccatgtgggaggtttctgctgaaagaacttccaactacacatctccccacttcagtataaatttcaaccttccctaattcatgcaaccttttttttttttttttttttttgagacagagtgtcgctctgtcaccgaggctggagttcagtgatgcaatctcggctcactgcaacctctacctcctgggttcaagctattctcctgtctccgcctcccaagtaactgggactacaggcgtgtgccaccactcctggctagttttttgtatttttagtagagatggggtttcaccttgttggtcaggctggtctcaaactcccaactcaggtgatccgtccacttgggcacccaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaagtaccagcctggccaacatggtagaaaccccgtctctactaaaaataaaaaattagccaggcgaggtggtgcatgcctataatcccagctactcaggtaggctgaggcaggagaatcatttaaacctgggaggtggaggttgtggtgagccaagatctcgccattgcactccagcctgggcaacaagagcaaaactccatctcaaaaaaaaaaagaaagaaagaaagaaagaaacttccaaataaatgttgtgacacaaaaaaaaaaacccaaacaatattcattatagagtatgcaaatgaccatgccccacccccagcagattctgatagactcccttgggtgggaatccttgtccaatatattgacacttccctttcctgtcagtatagcccagcccatgcgtgtactcacgagcggacgatggatgacacaagtacacagagggacggaatccctgcatggtgtggctatgggcaaatgtggccactgtctagattgtgcaaatgtggtggttctctggggccacagagcacacttggggacctgttcatggtgaggtctcaactccggcctctaggaacttgaatgaggacaggagggtcagagggagagcctaggaggctgagccaaggagcgtggagaggagagacagggtgaaggtggcggctggctttctggaagcaggtggcctttggtgcggtcagcattcgtgccagccccctcttctctgatcctctccatgtgtctctctcctggaatcccagaagctgcccctgactccccattaactgcctctgcccctaccccctaggtgatgcttctgggagacacaggcgtcggcaaaacatgtttcctgatccaattcaaagacggggccttcctgtccggaaccttcatagccaccgtcggcatagacttcagggtgaggtggctgcaggcacttgcttccagcagagagccagggctgtggctcaggcatgggggggttgcccccaccttgctcaccctggctcccagggactcccgaggctcatgcctggagggcacacaacccgctcccccaagaccacagaggtggccgggtcaaaggagactgggcaaggttggctccttgcccaactataggatgcaaaaaaatgagactgagtcttcgattccagctccattcctgggggacttctcccaagcagagcagccgcaggcacggcataagctgaatatcttggcccacagagcccctgctcattgctctcctacctgggcccctttggaaaggcctcaaaggtcaatcagtctttctggagttcccagaaagcacagccctgcactgggtttaagagctgggcttgggccaggcatggtggctcttgcctgtattcccagcactttgggaggccgaagcggtcagatcacaaggtcaggagtttgagaccagcctggccaacatggtgaaaccccgtctctactaaaaatacaaaaattagccaggtgtagtggcacgctcctgcagtcccagctactcgggaggctgaggcaggagaatcgctcaaatccgggtggtggaggttgcagtgagctgagatcgcgccactgcactccagcctgggcaacaaagtgagactgcgtctcagaaaaaaaaaaaaaaaaagagctgggctggccatgttgggagacagcagctcaccagggaccctccctctcaccttgacgactccatcttacaaatctgcatcagggatgctagacgctgcacacctgaagtgttcaatagagaaaaggtctcaccctggcaggtggggctctacagcttcaagcaggcagaaagcgaacacttccttcactagagaattagtgggcagctaaagaaaaggtgctgctgcagatgtagcctcaggtccccaggatgcaggcaaacaccccatctccaggggctcggtcacagtcccaaggctaggctccaggagagggagaccgaagtgggaaaagggcagggcctccagcagcaaccagccctccagccctgggctgcctgatccctggagagagccaggatgtttctcaggctcctcttgccctgctgttgtgagaaggcagttacagtcctcagaagggacgactccacagtggaggtgtctgggtatggggttcctgctgccctgatggtatgatctggctggagacggttctggggctcactgcacccactctaggcctggagagggaacaagagaggacgtctgcagagctgaggagccacatgactcctgccctcccatcctctgcctttttctctttcagaacaaggtggtgactgtggatggcgtgagagtgaagctgcaggtgagaccagaggctggagttggggagggaggatggaggacctgcccttccttctcaccctgaaccacaggaggcctgcagccctgccctccgcctggggcaatttcctgtggggcccacgggaggaaatggcttttgtttatttgacatctgcagaaaaagcagttcccaggcaccctctcatctatgaacagcagctccaaatgccttcagacaagcttagcctccatccatctcctccccagttgccagggctttatctgctcttaggagattggacatccccaacccctgagctaggggagaggagaagattctttttttttcttttcttttctttttttttttgagatggagtctcgctctgtcgcccaggctggagtgcagtggcacaatctcggctcactgcaacctctgcctcccaggtttaagagattctcctgcctcagcctcctgagtagctgagactacaggtgcatgccaccacacctggctaattttttgtatttttagtagagacggggtttcactgtgttagccaggatggtctggatctcctgacctcgtgatccgcctgcctcggcctcccaaagtgctgggattacaggtgtaagccaccgcgctcggctgaggagatgattttgaacgagcttgagaaatcagtaactgctactgtccaggtcattggatgctcaggggctcatgagaacctaaagaagaaaacagccccaccttcccacagatatctcatacaacaaagcaggcctgctccacccagcacattccttgcacctgcctccttctgaccatttctccatcccatcccttcccagatctgggacaccgctgggcaggaacggttccgaagcgtcacccatgcttattacagagatgctcagggtgagtccctcgcaccctccaacccctaccccagccccttggtagcatccgtgctgctgcctaagtcccctctgtgatcctctcccctccagccttgcttctgctgtatgacatcaccaacaaatcttctttcgacaacatcagggtaggtcctcccttcccctgactcccacccataagcagccaaggcaaggtctatgcaggctggggttgcttcctgccctgtggaaagcgggtggagcgtggagtcctcctgccttctgaaaaacacctacttgtgactcagaagtcatatctgctgctttgtatttggtggccatgtgggcatgaaggccaagcaggctgttgtgaccctgtgccacctgcatagccctcactgtgattcacgagtgtgtttcgtgacaaagtgttcagaacagcccccactccaccctggataattatccacagagaccaagggaaaaacacaaccagaaaagtccacacatacatccagggcaagttgcaagaaagtgactcagtcagacagagtgagtggttgtatcctcacaaccaaactattatagagacaaaaatttgataaattcaagcaccaattttgttcacgacattgtataggtttcatgaatcccctgacctcaaggacagtttgctgataagcaaactaggagaataaaacgtttatatagaaagaggaaaatccatggcactcatactcctacctccaaccccatgctcatggcagacatcactaatcaatcacagtacttttgatcactgaaacccttatgtggtcttagaatctttaacaggacactccaagaaatcactgctgacagccaactgatttgtgagataaggtctccatgcatctggatcttccatagaactgatagttgcacagcataaaatggtgagggtggggccattgtgggttgagccaccaaggaaggccatccaggcctggatgggccagaacaaaggtacagatgagagaacgcacagggtatcgtgttcaaggtagtgagtaactgaggatagtcaaacggagcagaagaagaaaggggcagcaggaggaagagaatgccagtctcgcacgccctctcccacaggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatccttcctgaaaaggactctgcagcctccagctcaggggtcagacatatctggaggcttctgcccatcccatctgccccttccagggaaagtccaagttgttgcctgagaaatcaaggggtgcccagttctcagcccccattagagcagagtgaacagggtcccaggtcaggggctaagagtgcaaagggttagccccaactgctgtcctattccaagaccctttaccaaaggtgagatcccagagctgggagctacactgggcagaaaccctggccccaggccaatcacacctgcctgcagtcccttgggccaccagcagagggcaggcaacgcctgcttctggggcaaaatatgggcccgctggggcggaggcctccttccccagagtgacccatttgggcttgacaggcggatatgagcagcgaaagagtgatccgttccgaagacggagagaccttggccagggtaagtgattgtctgtgggacagggtgaagggtgggggcaacccgacgctggccctgaggacactctctcccgggcaggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagcacatcctgtccactgtttctttgaagtgagtggggggggggggtcttgttgaaggaattgtcattcactgccaaaatcattccatcctccttcctcagtgtctgtcctcagatggtcagctccccgctcaacagactgtctcccgcctctgtgaccagcctctctttggcaagagggagctagaaggctttacagtcctaatcatttttctgttggaaaaaaaaaaaaaaaaccaaggctcctttccctgtggcgtgtacccagaggttgattacctgagtctgtcctgcctctccccaccccacctccctagccaaacgctgctgccaaagcccacgctattgccctagatggcctgtcttcagcgggctgcccctcgaggtcccaggctctccgcggagccctcaccttcccagcagggatcagaacctgcactcctctatgcgagtcctgggacagcacaaagtggattagggttagggttcccacaaacggaaaaatgttattcaaacaactctgtagggtccgaggaggccctccgtcttaattctcgagactgaccggccctcgctgccccgagcgggagcagttgccccggcaacagccgctccctctcaactggagctgcacccaggctttggctaaaggctgttaaaacgttggccaggtgcggtggctcacgtctgtaatcccagggcggatcacctgaggtcaggagtttgaaaccatcctggccaacatggcgaaatttcgtctctactaaaaatacaaaaattagcggggcgtggtggtgcgcgcctgtaaccccagctgctcgggaggctgaggcaggggaatcgcttgaacccgggaggcggaggttgcagtgatccgagatcgcgccacggcagtccagcctgggcgacagagcgagactccgtctcaaaaaaaaaaaaaaaagttagggtcctttacccgagggccggctttcctcactccccgccacaggtaggggaaaccaggccggagccggcgggcccacccgcccagaaccgggaattcggcgagccccgcccctgccaccccagcgccggccgctcggtaacaaacacttccacttcctgagcgctagtcttcgcccgccgcggggcgccgcgccgagcgcaggccccgccccgcgcgttcccaatggccggcgccgttcacccggccggagcgcccaggcctgcagccccctattggcccgcggaggtccccaccctcagcgcggccccgcccccggggtaaggagccggggcggactctgggacgctcagacgccgcgcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcaggtaagcggggcccgagccgcgcaggctggcatggagtgggaggaggatccggagagacccaggtgccccggccgtccagccccgcgcccgccgtcgtttttctgaaactcgagctgcgagggggagaccgcttccgcccgccgaccaggcgccctgacacatcctaggcaggcctggggctgcgtcccgcgacctcctctccttcccaggctgtgctgggagcttgagcgcctttgccgcctgcacctcttgttccctggcctttgggagggcggcgcaggggaacccagcccccttccctcgggtctgtgggtgtctgctcccgttcctcggaatcccccaatcctgctccttccctggtgccctctcctcgttcaccccagtccgcagatgggccggggagaaagggctctccgccccagaggtgccagcttcgcccgccactcctacttcaaaagctagaggaatagcattactcctcctgtgtggagccccggcgcgaggaggccctctccgcagcccgccggtgtgtgtcctgaacttcagtcctgctggacttcatcctcccggagtcctgtgtgacttctaagggagaggaagccccaccatctcagggcggtgtgggggttgcctggcagggaggaggagccaaggcatctcggagtggtggttctgccacctcagaggatttacgattctcaggaatgtgaagagtaagcgcctagaactgtatctgggagggaaggggaaagaccttggaagaagaaaaagatggccatggggaggagagagagctcctggggctcacggccctgtgtgcgccagcggagctcacggtgagccggtggtcttgccctggccttgccatggtcactctggtgcccacacagccagcaggccggttgctttttgcccatgtttggtgtttgcccatgggatcccagtttggatcagctgcaagaggggcagctggcaaaataggagttgtgctgagcctcctgtccccagagagtggagtggtgcattgtgtagggcagggcgtgagcctcccaggaccccttcagcttgcaccaccagctctccctggtggcagtgtctgatgggagtgtccgtggggctacgaggagcctcctggacagagaaagggcacagttcggcattaaggtagaaggcaaagccctagaggatcaactggtttggtggaagtgaggtcaccagaagccctgtccagccagagctgggtgctgggaatgccagggccaccaggctcccacttcctgcccctgccaagctggcattggcaaggggagggggaagggatctgagcacccggagcaaggaggttgatgccagggagttggggccgatgatctccagtcccaggcagaaatccagtgtgaactttgtgctgagtccatcgatcgatttgacattcttttttttttttttttttggactttggcacccacacaaatacccacccacccccaccccccacaagttgcagtctcgttcagctcctccctttgcccttttggttatgctgctgggtgccagagggcctgggaggcgaacgtggaggcctggcatagcacacgtgcgcaaaggcagcagctttgagcttcctgggtgagcacagactcagattcctgcatgttttggagggacacctacatttgtgtgtactttgttaggccaggagatgagaggagagccaccagcaaatcctggggacaccatcaccagccaagtcccaggacttctgagttctggttctcccatctgtgagatggaggcattgggcgatgtgatgcctgccttctctagaattatagaaatgacgtgaagcacttgagccccttactaaatgctgaactgcactccttcatgcctggcgtttgaatcccagctcctctaaactgactcctagtcaacaccattgagtccttctagcagaaaatcctctcctctcaatcctgtgtgttgagcatacagacacccatgtggttattagaaaaaatgttaacagacattgtaagagttcgtttttctaaaacacacccgtttcctacataaagcatcaaatggaggtttgccaattcgttttagtctgaatttgtgtgcaaggtggggctgttcccttgtcttcattagccctccacttactaagtgatgatatcagtggaaaagtgtggcgcagagagtggttggctgggtggcctctggctgggaagaccagctgtgtccagaaccactcagggcagaggctgaggggtgcctgtaacactggccatccccgctggggagtctaggcctaaggaggtggaagtggctctccagctctgcccaccggctttgctttgtggatggccttccccgcctgccccgtggggagagaggagcagcaagacccgccctgctgttcccctgcttaaagccctcctccccccattcaccaccagtcacaggatgaggcctaaacccttgagtctgggttcagagtgccggccgggcagagccgagccagctcagctgtactagccaggctgtgcgaagccaagttacctcacctctgtaagcctccatttcctcttgtgtaagttgggggttatggcagctacctcggaattgcatgaggctgtgtgtaaagcacgtagctcagtgcctggcactgagtccaggctcagccagcctttgcagttggtattggaatgaatacatatttcatagtgatcattgcacacctatcatggggcagctagcgctgggtcagcctgcctagttgggcaaatgccactgtggccaagcctggcacacagtcagtgcctgatcgatggtcactgtgggttaagaatgatacgttgtggccaggtgtggtggctcacacctgtaatcccagcactttgggaggccaaagtgggaggatcgcctgagcccaggagtttgagaccagcctaggcaacatgacaagaccctgtctctattaaattttttcttttttttttttaagagttatatgctgttccatggcccttctccatctggcagcctgttctcaccactgcctccctacccccaaaaccacacccagggtccgaattcccctctagcctctaagccttcacaccctgacacttctgtcccctcccagggagcctgtccttaatccagtaggcagagttagcatttcctttccttcactttttttgtttttgtttttgtttttgttttttttgagacagattccacccaggctggagtggtgtcgcaacctcgcctcgctgcagcctcgacctccagggctcaatcgatcctcccacctcattctccctagtagctgggactacaggcatgcaccactattcccagctaatttttaaattctttgtagagatggagtttcaccgtgttgcccaggctggtcttgaactcctgggctgaggtgatctgccagcctcggcctccgcctcctctttgtccttacatcttttatcgctctaaacacacaatattttaatcatctgtttgtgacctttttctccactacgtggtaagcccaagggcatcaactgtggcctatttgtgtttctatccccagcgctgtccttggcacatggtagggaggctctcaaaaacagtttttgaattaatgaatgaatatataacaacagtcagggacctttgtcctcattcagctcatcccgccccgcccagagattggaattccagatagaacctacccactcttctttcttgcctgctagcagcttctatttgaaaactagaaagccaaaagtccaggctttggggtcagccagatcagtgtttgaatcccagctctgccgtgtgctggttctgggatcctgggagttcatttttccctgcaaccctcagcctccacctctgtgaaaggcactgcctgcagggttattgggaagatttggtggcatgacaggtttgtaaatgaaagtgctagtttggggtgtttcctgccagccctgaccctgatcccagagtcagagtgcaggcaccccagggagcaaggtgggtggtggggcacagttagctggagggccatcaacctctttcccagggcgggcgggccattttacaccaaccaagttggagctctggtagggcagaacagagcttgagctgctgggtgtttggatttgaaatggacagggtatgtgattgtttgtgtgttgggatctctttctttgctggcaaaacagtgtagcccctggttcttaccttcaagctcctgttaactcagtaattctggagatgattctcttggagatagatgggggcttcctggccgggcgcagtgacttgtgcctgtaatcccatcacttcgggaggctgaggcgggaggatcgcttaagcccaggagtttgagaccagcctgggcaacatagtgagacctcgtctctaccaaaaaaacagggggaggggggtgaatgggggcttccttctcaaggaactccatatgtctagatggggtccttctcccctttcccagatgtcccatctcaatggtccctgggaaagtggggtgggaaattaataagaaactcaggccaggcacggtggctcacgcctgtaatcccagcactttgggaggccgaggcgggtggatcagttgaggtcaggagttgaggtcaggagttcaagaccagcctggccaacatggtaaaaacccatctctactaaaaatacaaaaattagcgaggcgtggtggcaggtgcctgtaatcccagctactcgggagtctgaggcaggagaatggcttgaacctgggaggtggaggtttcagtgagccgagatcgcgccactgcactccagcccgagcagcagagtgagactcatctccaaaataaaaaaaaaagaaagaagaagctcagccgaggtcttgttggtgctgcaggactctttacagggagaaaccagagctctagaccccaataacaaatgttcctctgttttcgttgctctaagatagagtggccctacctggaaggaaacaggtttgtacagtgcctttaggcactctacctatgacataaagatgttgacatgcatttctttctttctttctttctttctttcttttttttttttttttttttcctgagacagtcttgctctgttgcccaggctggagtgcagtggtgtgatctcggctcactgcaacctccgtctctcaagttcaagcaattgtcctgcctcagccttccatgtagctaggattacaaacacccgccaccacaccctgctaatttttgtatttttagtagagacggagtttcaccacggtggccaggctgggtggcacctgtcacaacaccctgctaatttttgtatttttagtagagatggggtttcaccacattggccaggctggtttcaaactcctgacctcaggtaatccacctgcctcggtctcccaaagtgctgggattataggcatgagccaccacacccagccaatatgcatttcattgtcccccagacaaattagctattgttttctctattttgtaggttgacagtaagtgttcaatacatgatagctactatttgtgtctagcactgtgctaagtactaaccttgcctgtctcatttaatccacatgaccaccagtgaggcagatattggccccattctctgcctatggaggctgaggcttgatcagttaaggtggccatggcgggtcccaggactctgagctagcgactcctcccacacagcgcaggggtgtgtcttggaacccaaccctctgactctagtgcctgcacagccatttggccacatgagtaggctgtgcttgaagcctgactctgccaggtgtttctgcccatcatattctgagccacagctggaccatcacagtggtataaattcaggctgcttgaactggcttcctgtaaggatccagggcttccaggtgctcctgtccctagcagggcatccttgcagtgcctcagcccataagtggcaggctcctgtccccatcccttctcacgtgatgtgataggtcaatctggaatctggtaaccaagtatctacccccgccctcactccccagaacctgcacagagagcccccctcaagggtggtcttcactgttgaccgaagccttcccctcatggtaggacaactcaccatgtccccagactcctaggcaatgtttaggtccctaggccctagaaaaggacaagagttacagattccctgaggtccaggtcacctcggggtggtgtgggaacacacagagaatgctggccaggttcaagtcccactcactgctgggtgctgagagctctgaattctccgagacaggctgcagcctctccctgtgctaaggtcaggggaacagcaatggccaggggtatttagaggagtgtgtttggggcagtctcaggcagcacaggtctgtgctgtccgggcagcagccaccagcttcgcgaggctcccgggcactcgagatgtgctggtccacatgcagacgtgctgtgtgtgcaaaatgcacaccagattttgaagccattgtacaaataaaaggatgtacaatagctcaattgttaaaaatggattacacattgaaatgataatattttgggtacattatgttaaataaaatattcaattctactatttttcctgttttttttttttttggaggcagagtctcgctctgttgcccaggctggagtgcagtggtgcgatctcggctcactgcaagctccacctcccaggttcaagcgattctcctgcctcagcctcccaagtagctgtgcaccaccacgcccagctgatttttgtatttttcttttttagtagagatagggtttcaccatgttgaccaggctggtctcaaactcctgtgctcaagtgatccacttgcctcgtcctcccaaaatgctgggattacaggcatgagccaccacacctggcctatttttcttttctttctttctttctttttttttttttttttttttttgagacggagccttgctctatcacccaggctggagtgcagtggcgtgatctcggctcactgcaacctccgcctcctgggttcaagcggttctcgtgcctcagcctctggagtagctgggaccacaggtgtgcaccaccacatatgtctaattttcatatttttagttgagacagggtttcaccatgttggccatgctggtcttgaactcccgacctcaggtgatccacctgccttggcctcccaaaatgctgggattacaagtgtgagccactgcacccggcctatttttcctttttcaaatgtgatgactagaaaatcttacattccacacatggctggcattatatatctactggacagtgctgctctggatctgagctcaaatcctgcctttgcccgtcagccatgtgtacttgagcaactgactccagctttttgaagctgggtttccttttctgtgaaatgctggcaataatactttccttttaggactataattggctcttaagaagaaaacacatgtaaagagctcggtgcctaacacatagtaggtgttcagtaaatagcagctgctatttgttacttcagtgttgagccccaatttcacaagctccttgaaggttcttaatagccccttgggacaacccctgggggttaaatctagagacttctgggaggagggtgagggatgaggaaggatgcagcagggaaggcatggggcggccagccctggatggtgtccagccgggctgcagcccaggtaccagcctgctccatcccaggcttgcccagccctgcagagacctgagccagactctgccccctcttgcccccgtgggtctccatggctggcacagggagaagaggttactagccagaaggagaacctgtttcagacctctgagtcctgggggtgtctgtcagaccagcagacctcactttagtttgtgtctccctcctggttcccaccctaccagactccagggaaagctcttcccactgagaaataggaaggaagagatcaagggctaggagcagtg

SEQ ID NO: 1721 - DNA, 2615 bp, Homo sapiens
accatcctggtgggtgacagtggtgtgggaaagacgtctctgctggttcagttcgatcagggcaagttcatccccggctccttctcggccactgtgggcatcggattcacggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagcac

SEQ ID NO: 1722 - protein, 229 aa, Homo sapiens
TILVGDSGVGKTSLLVQFDQGKFIPGSFSATVGIGFTVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 1723 - DNA, 20174 bp, Mus musculus
  misc_feature (1)...(20174): n = A,T,C or G
ccctaaaggatgtccagaggggtgtcagagaagcagaggggcagggcaagctctcggtggaggtgagggctggagatgaaccttccatgtgatgcaggtaggtagagctactggaggagctagtgatgcagatcacatatttggaagagaaagggaggccggggaaagtgagtcagcctccagcgaggccgcctggtcagggcgctgtctccatcagttgcctattttgggaaagtgagattcttgattaaataaaacacagccagactcatgttcagagtccccgctctgagctcaagaggcttgggtcggggcgggctcaggcaggcctgcctgtggagcagatggctcccccaaggctgtcagcaccatgctggctgttttcagccgcctggtattctcagcagactcccctctatcaatgtcctgaaagaggaggcctccggccccagggctgctgagcattcccaaatcaaattgtgtttctctgaaggacagctgtttgacttctcgacgggaaaggccgttacgggagacaaacattaactgacctgtttttttcccccgagtcaagcattttctatacattatctcatttaatgcgggtcatgaggggtgagaattatgattccttcccttcaaacgtcataatgcttgaggttatataacagctggcacttaacaagcatctattctatgtggacattaagcccatggcatgccttatctaatttaatccccactcagctcttttatggccgaggaaacaggcacagaatggttatgtaactcatccaaagtaacacagctggaatgtagggaaaggaaaaaaaaagttagctgcaaatccaggcagttggatgtgcttgtggtcacatcccagtgcactggcctacttcttgtacatgacaaatgactccaaaaccttcctcttcccagtcagtgacttgctcctccaaccttgagatgtttcctcaatacacgtagtggagctttataggccacctagtcgaatgtgcagtgggcacgttctgagacctgcaggcaccaagaaggagaggagaggtcctccccgtggtggctgcagatccgagtttgaatccccagcacacagggaaaaagccagccattgcagcacacaagcctataacccctagcactgtggggtttagagactgatgatggggcttcccagctgcctgcctaattccagcttcagtgagaggccttgtcctgacagaacatggtggagagtgggggtgagggggcctgaagttatcatctgtgcccacaccacccaacatgggcacatagaatcctggaaggggagctgcagagctcagctgcgggtgtcagcatctcggcaggagctaaggagagccactttcactggctgtatgactgtggacctgcccttccccagctccatgcctcagtttccttatctgtaaaatccagccatctccagggctttctatttcaatttcagacttctgtgaatattaagcagttacaaacaaacaaacaaacaaacaaacaaaagtatagaccttttcaaagataagtaaagatagaaggcagggggctggtgagatggctcagtgggtaagagcacccgactgctcttccgaaggtccgaagttcaaatcccagcaaccacatggtggctcacaaccatctgtaacgagatctgactccctcttctggagtgtctgaagacagctacagtgtacttacatataataaataaataaatcttaaaaaaaaaaaaaagatagaaggcaggtatgaacccccagagatgcatagcgccaatccatcctttatcactatgtagttttcttcctctgggccccacccatttctccctcctccagtgtatcactttcctatgttatcagtatctctcggtctgtctgtctatctgtctgtctgtctatatgacaactcctaaagacacagaaccatgaagacacaatcacactcagaatgatagtaatctgtctaattcctcagtgctttgaacatggagctaagccatttggaagtcctcttggatgataagcggaagctgaactggagcttctaatattgtttatagcactttctgaacttgtacccagagaacaactttggagagagatgtaactgttcccctgaaagacagacatttgactcatcaatgtgaaagaccattatggaaggaaatgaataaatttaagaaaagcacacacacacacacacacacacacacacacacacacacacatatatacatacaatatatacatatgtaattaaagaatacaatcttatttgataacctgtggctgcatatatgcaaggtcttttttgtcctgtgtcagatagcaccctcaatactctggggcagcctctcctttaacccttctatggacaggatctttgtcaaggatagagtgacctgatatcagaaagcttatgaccagtgatggatgggtcatgcacgtaacacaaagaaaaaaagtgaatagaaaacatatgtcctcagtttaaggcatcaaactagaaataaaaatcataaaaccctatgaaacaaaatcgtttaaggctcttgaatgagtagattaatgtgctttcccccaggatgtaataagtctcgtcttgcggcaagctgagcagttctgctgcgcactccataaagttgcctctgagcctcgtattggctctctgagatgcacctcctcctctttctggctctgctcaggaggcgtcctgtgagctcccatgccccaactacctcttgtgcctccatagcttgttgccctcgctgttcatctgtcaatctctctctgtctagtgccaggccctgtattgctgtcttgaactgctatttaaattcctgcctatttgtcatgtttccttaacactggggctccatgcccagcgcctgccaaccatgggcgtgatggattcccccatttgtcaagcctttgccgagtgcagaagcctggagctggagccttggcagtaggcagggaccgaggcatggttccagagcctcttcacggagggaaattgccatcctctcctgtgagggcccaagttggtaagccggctggtcggtgccttgccgtatgctcaggctacttatataagcagttcttcctccaaagggttttcaaagcagcctttagaagtagctaattgaagaacactccgagagaggtccctgcttgtggacgttaattgtgacagtttactctgcctgaacgatcatgaaatcactggaggccccttagcagggctgcaaagctcaagggaggctattaaccatttagcattctctaagcaccagggaataaaaattccacttacagcagagcagggggaggcaatgtttattacgacgaaagcccaagcctggagacagggaagtctacagcggcagccagcattgagtgcagagcgtactttacctcactggcagccaggactctcccaaatgtgctgacgagaaaaacaaacttgctaggagcacattggtagagtctctaaaggctatccctgaatggcagctatctggatgtctgctcccgtggcagtctagcctgcttccaagagggaagagtgttcagaacggcagggtaggaaggtgaaggggtacttagttagggtgactgcattaccctccttgagcaaatcattaatggggccttgtatgacggggacaaggagaaggaggtagccacgagtcactgctagagaagcagccaatgatgccatggagtgagatagccgtggctatggttcagaacatggattgacaggcaggtggcagtgctccatgcccctgcccctcacttggcttgggtgcctgggagaagctagttttgttgtgcttacaactatcaggtggcaagctgccaccctttccggagaatccaaacaatatgtatttatggaagcttctcgacctcgccttgaccatgggtgggtacgtgtagaatccctggagagctttccctgtgctcccatgcccagacgctaccttgaactaactgcgtttggatctaggcacgaactctgcagctcaaagtctcaaggcaggttttgtaggcagccctttgaggctgctgagaactgcctcctgggcctgacccctgaagactggcttcctgggaggtacatctgcagggagttttaccaactccccctgccaatcggggcaggccagatgctctccgtgggtctctcagatagtgagaactaggctgccagggctatgctccagtctaaatacgtatgctgtttctagatagtaattaaaccagtctacaaagaaatctgagttgagagctagagaaagaaaggaagggaagaaaaacaaagcagaatcaaaactcacaaaaggctcaagtatcaagctcaagtagagtgtggtacaacagaggtccttaaaaataccattgcaaaagcagtggctgttcccctatgatgatttgaaagcaaaaatcgctaacaatcccacctaccagacacagccattgtttctcttttgtggctctgttttccatgaaatttcaggttggcatacgccaacaagtgttggcatttcattggcattcatcgatggcatcgctattaaaagctgccaatcagttcgtgatggttggacattctctaggcactttgaattcctgctacccaagaggccccagttcgaactctacccctcaccagagtctggcaatgtatgaggcctgaccttggtttgtgcctgcctgccctgttgacagtccggtcagatggtcattgtgacttttgtatgtcaggtatgtttggaactcggactccagccatctgagaactgctaaggtcctgcttggctgtgaggcaaggctgtgtgagtggaggccccataactttctgcttactgcatgtccccagctgaggtggtggctaagaatctctgatggggacaaccctctccacctagccagcactaggacagctaacctcctcaaggtagcctgagctcccatggcatcagagagtgcagcatctgctcaggttttctcggacctgactaataaatactaagtattctgtgaccttgggaaggggaccgaagtcaatactaagtattctgtgaccttgggaaggggaccgagcaagcttggtgctttcctctagagactgagtagaacttctctgcccacctcacaaagtgggaagaaggaaggaactgaagcaggcggaggtgctcttaggaagccacgcgtagactgtggaacctttgacttccttgaacagaccgtgggagactcactctctgctctccttccaggcagcatacgcttattggctgcatgagctttggggtgaggtctctcttgactccggacaaggtgagttgctgggaagctcctgaagcaatagcccaccaaggccctggctggtatagtcacgttgaccctggaaatgcttggcttgagctgctctctgtgatgttgtgtcccactgaggtagatgttggtagtctaaattacaggctgctgttgtcactggcctggctgagggtttgggttcccttacagaggggagtttggcagcccctaggctccctaggaagtgctgagtctggcagatgccaggatgccataaagggtcctcttgatctgtcttctgggctcaggagacgcttggatggggctagaaagcactgacactgattgcagtcctcttaggctggctgaggacacaggctcaggattctcttctttgcatcactgtcacttagctggccttacttggctctgcagccccaaactaaaagcttaggagtcgggaggggtacatggcttttgcacatcttgaaaatgtccttgtggcccattttgagaccctaccacgcagctttgtgtcctggaatgatgtcaagagatggctcctgtgcgggttctcttgatctcccggccatagctgtggctttggtctcctcagaaaggtgctgctcatggagactgcacaggggtcttgagtatctgcttttgtggcctctccactgttcttcactctttcccttttgttctgtaaacagatatttaatgagcacctactgtttaccaggctcaatattaggtaggtcaaagagtctggctgcaggcaggaggcaggaggcaggaggtaggaggcaggaggcaggaggcaggaggcaggaggcaggaggcaggagggaggcaggaggcaaagcccgtaactgtccaggcataagaggctaagggaggatcacttccgtccagaaaatcagggaaggcttcctgaaggtgtaaatggcaaccttggggcacggaggctgaaccatctgctttgggggaataatggccagctgcaggtgtttgtttgtttgtctgtttttgaagggttagtggtagcttgacctgtgccttctgcttctctggactgatcatatctttccttctctcacgacaggagatcagtggctggtactatctgctaggggaggacctgggtcggaccaagcacctcaaggtggctaggcggcggctccagcccctgagaggtgtgtacaagcccttcgaagctccctgaccctgactgagtgaggcattaacctctgcctctctggcatttcttgccagtgcctataagattgcaggctactcctgaccatatgatagactttgagtttgtgccacctcgcttcacacagatcagtcccctgctccactcacagaagcttcaggacttcccaaaattctccttcccagactctatgtctcagaagccccccatccccgtggcaccttgctgaccattagaaccccaccaccataggcacgcatgtttctagggcctgccatggccctgagactccgggcttggattacatgttccttcggtactgttctttccctcacagccctggctctcaagcctctgtttgctctgagccttggcatcctcctatcctggaaggcaggaattgtcccgacagtctcacccatggtcggtttgtgcttgggccctcatgccagtaggagctttctgactcagctctattatcttctagacatgctgttgagaatgccaggagagggggaccctgagaacggggagaaactccaggtaggtgggcacactcctggctggggctggtagaacctgagcatggctcccagggtctctggtggttctcctctttgtcagcctcttggttctggaagtgaccgtgaaagagggcagcttgggatttggaacacagcaagtcatgccttgtgaaagagagttcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtctctgagaacctggcaccttcacaggttaagcctgctggggctaagaagcagccgtaactctgaatcagaaagtgacgggtttctggcttcctaccagctgtgaatctggagaggaacgtcatacagggatttgggtgaattgtccaaagttaactccatctctttggagaacctgtcatggtgactcacggttttctttagtaggagaaggaaaatcaaactctctacgatcaatcagcccctggggtgagattgtgatctaactctcatcacctcctgtgaggtggctgtcaccaccccaccttacagataagaggacatatagatcttaggtgttatgtcactgtggccactcagccagcaagagattggcagagcctctttatctcttctgggcaccatgccacacggtctctggagtgtgtcctcaccaaggagacctgagatgtcagtgctccttgacctcttgtattgcagttaaccccttgggtgctattgtgcacccgttcatccaatcccttggacactatggggtggtttacacctgtgccgaccccagcctgctgctgggttctggacagagccttggctcactcccttgtggaacatacagttcaacatatcactggccatcacagtagctgcctgccgcctgcagcttctgagcacctggctggagcaagcagagctgaggaacagagccacagcttctagttcgtgttaggtaacgtcagcgtgtcctgtgcaaacatccagcctctcttatagtgcttggataatctgccagatgtgttttttatggcttcactaggagtctagaggcttcctctagctccagggatagctccaaagatctccccactctctgtgtggagagagtaactatgggcccaccctaggaatatgtgggaatgacttggatacctgcgttgcaggtctctaggtggcccatgaaagacctgctttgtgttagattcctgtctactgtcccatgtccccgaggacactgttctgagttggatttgggggtttgtgcacctgatgatgtccacagtgctcagcagagacagtgactggcagaggtgtggggaagtgagaggtcacttattcaaatcctccatttgaaagaccttgaggtgtaggtcacctgcccagggtcactcagcaatcaaaccaaggcacagcctctgttctaactacatgagtgagcaggtgggcttttctgggggtctcctaggagggcagaggggcttgggttcatgctgtgctacccacgagaactgatcctgggatgtcaaggtactgactgcaggcctgggtcctaacctggcatttgactgtaacctctctaggcctccccttctttgttgttacgatgtggagtcaggtgccccgtggctgggagcccatttgcacatttgaccatttggtctgcgtgccatcatttccttcgcatagcctgtctattgtgaattcagaagctgactcttaagtagctcctgagtgtccatcagcctccagatgtttcgaatgccctgacttaagatgggttgtttatgggtatagtgttcacagcatcctggattgtccccattgggctggtctactggattttggaccctgggactcacaaggaggtgtgctgttacagaacagggtgtgttttctgcttgagtttccctccagcaggcagtcagggctgtttgtgagaacactgctctcacagagcgtcccagggcagagaatgcagccagaacaaaggcgccctctccccgccagccaggcccgaggaatactaactagttgacaggaattttaatataaaactctccctcttccttgtcattctgaggtttcaggaagccttcgggcttatctgcagaggcacacagcacagacagggcccggggaggtgagaggtgatttcctgccattcttctgagaggcgggcttcccagggcggtcatgccaggctgacagggtgcagtgtgggctcccgctactggggggggagagctgggttttcatggggaggcagccgaggcaggatccgcagccatgaaccgcttcaatgggctctgcaaagtgtgttcagaacgccgctaccggcaggtgggtgcttgatcccctgggtactgtgatagtgggaatcagggatggggctcatccatatagaatctctctctccacaagcccatctatgcctccccctgttccctgcaggcacattagagacaggggttggtcccatggcccagcctgctacctactgccccgggttataggcagctgaggccagttctgagtgttttcctatccactgcctgggatccttgatgagatgagttagctgttgctgcttggtttttgcttttgcttttattatctaggaggaggtgattggaataaaaaaagcgccatgtcaggtctgagattagtggtgctgggtttgggctggggggctaagggactcccgaaagctgcagttttgctgactttcctgtttctggtgggcagcggtacccatgatgtcccttgtgtgtactggtgtgtgcatctaggtgaggtgtgttgtaagcgtatgtgtatcttttcctcccggctgccaccattgccttgaagtgactccgggattgctgtggctctggaggccaacttcactgcatctgtctcttagctcctgggctgggaggcagggaagagtcaggagtgatggtcacgttcaccccaaagactcttctagaactagcttttctttctttctttctttctttctttctttctttctttctttctttctttctttttaagatttatttatttatgtatgtatgtgagtacactgtagctgtacagatggttgtgagccttcatgtggttattggaaattgaattttttaggatctctgcttgctccagccaaccccacttgctacggtcagccccgtttgctccagcccaaagcttcattttttattattatacataagtgcactgtagctgacttcagactcatcagaagggggtgtcagatctcattacgggtgattgtgagccaccatgtggttgctgggatttgaactcaggaccttctgaagagcactcagtgctcttacctgctgagtcatctcaccagcccacttttatttcttatacataggaatggggatcaggagtagggatgaaggtaaaatatatccagatttgtgtagtgtccaagatggagggaccacacgaattgccctgactgtaaaaaatacagagaagaccctctttagaatctggagcttaactctatagtgtataggtcacaggcagaggcccatttcccccccacccccaccccccccccggcacctgcctccatcactggggacccagatgttctttctaacattttcctgcaccgttgacctcaatctatgctccctactttcctgaagttagtccctgtggcaagaacatttagatgtttataaacataagacagggtgagcgccggataggaggtaatgaaatcccaggtgttcttgggaccaggggccagggcacaggaatgtgctggtgaccagagtgggacctggtacacgcatgggctggactcagggtaagatggctcccacatcgacgccggggcagcattgaacatactagaccttctgtgggaccagagctctagcccactgtggtcccctttaactgatctattgagcagcttacagtcgcttgtccctaaaacaggagtggtgacatatggtcaagcccgtgggaggaaaaggtgacccctataaagtcttgtgtctgctgctcacctccagggagtaggtaataaatgctggcagttagggacaggagcccacgtgtgacagaacgtcagatactcttcaggtgctggcatagctgagactcgggaggggcggcagtgcttgcccctgacaggcaagagaaagagccaccctgggaagggcacctgacaggacctgctgaggttccagagtcaggagagggctgtcccctttcttgagcccaaggtcagagaggatcgctggggggagtatgccctcactttgggccttgcttaccttctctgtaaaatgggcttgctgaagccgtattctttggggtctaggacagactcttgtcttggaggactgactctttggacactactctgtgtgctcagaggcctccattgcagcctgctcctcccacagacctgggcaatgctctcattcctttctagcccctttcccgtcactcctttgctagccaatggggtaggattgttctccgaggtggcactcaggaggcggtgaagagcctcctggccctggccggaccagagtgccagagcgccacatttatcttcagaccaaggatctggggcttaccctccagacaggaggggccatcctcagcgccctgtgacataagattggggcagggctagaagtagtcctgtgtggtgtggaaggtaggtcccaagttccctgtgagccccacagagtggctcctgctgtcttctctgggcctctgctggattggcaactcgagatccctccagctctccacgttcactcccggctttgttttgctttctttccatatttttttccttctcttcctgtcttagctatgtgttttcccagaattcttatgggaatagggtattttcctgcctccctccccctcccccgcttgtctgtcagatttcctgttttacaaacttgctttgaatccaggcccaggactggtgggaagcagagcctggggacctttggtcaccctgggctcccgcctgctccccttcctcatgcctggccttgggttaccagcaggtgaatacagtgcccagccctgagagacagctcaaggctctgcatgcggctgtgccctgcctgacctgtgctaggctttcggagatgccttcctcctctccccgtctctgtccaggacaccttctctttgtgcctcattgggactcaccctggtctttccctgccctaggggtatcttgggactcccccttgaagccatttttctgacctaagtaatctgaatgagccagtgggccatgctgcacacagaatcgctctttttgttttttggaagattttgtcttaaaaaaattttttttaattttattttaaactatgcttatatgtgtgcctggccatgtgtaggtcagaggtgttggattccccccgaagctggagttataggcaaatgtgagctgacttggagactgggaatagaacccaagagctagtattagcaagagtcagtgtctatgcacctaactgctgagccagcggttcttgacctgtgggtctcgaccctaaccctttctcaggggtcagatctcagatatcctgcatatcaaatatttacattacagttcctgacagtacaaaattgcagttacgaagcagcaacaaaaataattttatggttggagtcacaacccgagacttgtattaaagggtagtagcattaatagcattaggaagattgagaaccactgcactaaatcattttcaaagatgggcgggcgtggagggggtcctttgatcggacctctgaaaacagactgtggcctcccacacccatactcctttgtaggcagaatgaagcccgtggctagtacaggtttatccaggaggctgcggctctgcccgtgcctgtgaaccccatcactcttcagctgacacttggccatgggctaagagagaacatgctacatcttcctgcctggccctcagggagggcggccacccgcttggcttgatttctaaataaaataaagtgtgtgtccttagcccaaggcaaaccatgggcttagatcccaagacctccgtgggaaaggaagctggtcttcagtggggagaggaggtagaattccagacggctcttgggtaaagggttggggctgttaggaccaagaggaaaacgggtttcccttttccttgatctcatccattctgctctctgcttgactttgcataagtcagggttaagatggtgggtcagagataggtagaggaggctggctgactccttctcagctctgactccctgtggagaggaaggtggctctgggtggagcttagaggcttcccagttttgaaactctggagtaactggacaaggttatgtcctagatcaccatccggaggggcaaagacggctttggcttcaccatctgctgtgactctccggtccgagtccaggctgtggattctggtaagtgaatggcctaggatggcagcctcaccctcctgccaggcagctggactttgctgtttggagctggacagggcctcacactggatcagactctgggttttcaaaggaaaaagaataatatttttaaatgacctacagatgaatctgaggtttatgaaaatagagccttttttgggggggggagggttgttttatcaaaatgaaaatagattctgtattttgattctgctcgtttctgaagaggagctaaaatcgaattccgatggctgcaggggagatgtatgagcttgcatcccatccgcaagcccacttaacacttagaagtggacatcccgagctggctgtggtggctcgtacttataacccttgaacctaggaggtagaggcaagaggattgctggatattcaaagctagcctggcctacactgtgagtctctctctctctctctctctctctctcacacacacacacacacacacatacataaacaaaaagcaagaacataataggcagaggctgggaatgtgacacagtaaagcactaatacagtaagagggggattcatttggtctccagaaactgtgcaaaaaggaaaaagaaaaaaagaagccaaccactgtggctcatgttttaattatatcctcctgcgggtggggtcggagaaaggggaatagttgagactcattcattaggcagagtagcctacttgatgagagtcccaggccagtgagaaaccctgagagagagagggagagagggagagagaaagagagagagagagagagagagagagagagagagagagagagagagagagagagatgagtgcctggcttctatatgcgtgtacacatctatatgcatttcccctccctcttcccaacttccacccacagcacacgcgcacacacacatacacacacacacacctccactgccaaaaaagatatcagtttcttactcttctaagggacccttggagagggtgggggtgtgagcacgtggagaggcgaaggcctttgatcaacgcccagttcagcacctctgtgtggaacaataaagaggaaaaggacaactcttgctcagtgtcaccagagaagcaaaggattccaggttctctgaggaagtcttaggcctcagtggtctctgagtggcttttctttgtctttgcagggggcccggcagagagggcgggactgcagcagctggacacagtgctacaactgaatgagagacccgtggagcactggaaatgtgtggagctggcacatgagatccggtgacagggggcagtgggcggcggaaacctcagctgatggcaaatcttccccacccagccctgggctcactgccttgctctcctcctctcagtctgctctcggcccagctgtgagcaatttacatcgctcctcagggaatccatttcttggcctggaaatggaaggttcaggcccagatgaattttgatcccacagcaaacagcaggaaagatgctctgaacctaccccgtggtccctgctgtggttccaaggggccagttccactttagccaattgtccctgctactgaatggctaaaccctttgtttaagggactgcagacagtgcagatgttttaatatcacaagttaacgtgtattcggtaaaatatctgactttgtgggctagcaccccaacggtccgttttggatccgcttcatggagatcacatttcgcttgctcctgcctggcctctttctgcttgctctctgccctgcgagcttcctaccctgactggttctgatctccccaagtctgaactcctctgtggaatttctaggagctgtcctagcgagatcatcctgctcgtgtggcgtgtggtcccccagatcaagccggggccagatggcggagtcttgcggcgggcctcctgcaagtccacacatgacctcctgtcaccccctaacaagagggagaagaactgtactcatggggccccagttcgtcctgagcagcgccacagctgccacctggtgtgtgacagctctgatggtctactgcttggtggctgggagcgctacactgaggtgggcaagcgcagtggccagcacaccctgcctgcactgtcccggaccaccacccctactgaccccaactacatcatcctggccccactgaatcctggaagccaggtatggacagctgagtgtggaagggtattgggttcctgtggtaggttaggatgtcaaaaaacaaaaaacaaaaaacaaaaaacaaaaccaaaaaaaacgggaagattggattgtgagacatctgtggtatggctgttagggtcctatcattctcaaagtccatggagcacactttggaacaagcggccatgaaggaagctgtggtctctcggggtgccaccacttcatggagcatgaagagcttctcttccaccccttccccttaagagaactgctatgcttctctcataccctgaaacattatacttcctgtcgtcagacctgtgtgcagccccctgctgggctgctctgttccattcttgggactgagctaggtttcttgtctttgcagttgctgcggcctgtgtaccaggaggatacaatccctgaaggtgagctgtccgagatgctaagccctctcagcctggagagatagttgaggtcagctgaggtctggcccaacttcccgttctgagtttagaggcccttctgatggagctggggttacccagcatctcgaaacagatcccaccccctgatcctcctggtatcgcctccccccatgagtgtttttttccttaaatttccttaaagtcagaattaagttggtggagaggggaatctgcaagaaccacctaagagacaggtgcttggcatttatcttggctgttagccagtgttgctgagcaaccgtatctgttaggggcccgtggacaccaatgcttgaagccgcagggagagcactcctggaacgttgggctttggggtcttgggtccaaatcttcactgtgggactcgagcagatcactgcctcctcctttcaaaacaggatcagttgttcctgatcagtgctcgggagctcatctggagggttctaggggaatacggttgtatgctgttgcctgcatgcagaaagatggtgcaggagagctgcctctaagctttttgtagctgtccctgctgattaaaccattcttctcctttggcctgcacattctggggccagaagtgggagctggcagaaagcaatcactcctccaggaaccctgggatatgagactctgtgcaagagttggtgggacagacccttaggccctcacacacctgccacagagctctgaccccaaagtccagctggtctagaaggttgaagccagccttgccatgtggcctgtgaggcctacctggagtgtgactgaacctttctgtgcctgtagacaacacccttggccttcttcccttgagagtggcccttcccatctcatctcagatttatttctgtgctcttcccccctccattagtgatacgatgatgattcttaaagtgggcacttgggccttagggaagagagggctcctatcaggctcagaatttctgatggaaggcacctccttcctctccctgctggggcctgtgagcacttgggcccagcctgccggaaatgaagctgtgttcctcccagggaggagtctgatagtgattcaacagtaagtgtctaaaagcttttagtgggcacattagggcaaagtaaatatgtcactgctaaatggtgattttattagggggccgggccgagctcagcatatttctgtaggctcaacctcagacccagggcctgtgaggcaacagaaacttggtggaacttgggcagaacggctgaggagaaggactctggttgttggtatagttttgaagccaagccactgaggaagggaccctggaagatgtgtcacctacttgggcatatgcattcggtctgggagctcttcaatcctttcccacgaagctccagagttgcctgtatggttggtcccaagccatgtctgtgttttgactcctctctgaaaatacagtgccaagaagggcatggtcacccaagcctcggaggaaagaacaagtcaggaagagatggcggtgttaataacagtgggagtgttctgagttccctctgtccagatctaacatggtgtgtatccacacacatgcacatgtttgtatgtgtgtgagtgtgtatgcacatggaggcaaaaggtcaaacccaggagccatccaccctattttactgagtctcactggggcctgagacttgctgattcagctaccctggccagccagtgagccctagggatccacaggtctcggcctctgcagtgttggggtcacaagcacatgccaccatgcctagctttttccctgggtgttggggagtagactcagggccacatggctagtgcagcaagcactttaccaactgagccaccctgtgtcacgatctcgacttcactcatatttcagcacagtgatcctcttagtatcagaggatatctttctcatggattaattctttgcagccccaagtcgtgagttcagaggaaggagtgaagaattccgggcatgtggtttcccctcacacacctggggttacccagaggttagggcagtcaccagggtgatggcctctgattcctctggcctgcaaggatggtggcctttcaggatggagagctcagccaccctgctttgaatatcaggaacagggacagcttagccatcttgcgttgaacagggtctgaggcctttccagagcctagagtgcctgtccggctgtagttggcgtatgccccaaggccgctgttctttgaaagtttaccaccgccagagccagagccagagggctgccagggctcgcctcagaagctcagagcaaagccatataattactatgtttggtcagtgaaacaggcgctagaagaaatggagctgatacaggtttaggccagacatcctcacaagaggtgacaggtggaagtttgccttcgtggggctcagcagccggcctgcaatctggattgttctaaaaaaaaaaaaaaaaaaaaaaaaaaaagaataacttggaaaaagaaaattcagctccggagaaccacaccccttgccccatatcctcagagtggcttgtcagtgctcctttagggagtggctaccacctagattgggcaggtcctggcttgtgtcctctactagctgaatgaccttggtccattcatacaagaacgctatacctctgtttgctggaaaatggggctaagcagttctctcctctctggaagcagagagacgggtcaggtggctgctttgtgactcttgagatctagggtgaagattctttgacagtgctgggcagccgggcctagggaagaaatctcttgtaagtctgagacttagagcccccacacctggatttttccactgtggattgcatccttccctcattttggtctggatgacctcagcccctgcttgtcagccctgcatggttttaccttccctgatccaggctgtgctttgtccggctagcctgtctgtttccagactgttctgtgacctaacttacggcgtgcttccaggccttctctgccatgctaccgccaatggctggcttcgtgttggaggtaatcaatccatcctgcaatcacacaccagcctggcctccaacccccgtttctcatggggcctttttgttagttccgcactgactcagctggacagagagaactgtctcaaatagggaaggagcctgctccgtgcacagttgctcagcattccgggctgcacagtcagcttttgagtgaggaggacatggctcacattcaaggtgtcttgtccaactcaagtctagggtaggtcttgaaacataggttgtatttttaccagtggaagaacaggctactgcacagacaaccaacctgtcaacccccagggccaggccagaaagaa

SEQ ID NO: 1724 - DNA, 63 bp, Mus musculus
atgaaccgcttcaatgggctctgcaaagtgtgttcagaacgccgctaccggcaggcacattag

SEQ ID NO: 1725 - protein, 20 aa, Mus musculus
MNRFNGLCKVCSERRYRQAH

SEQ ID NO: 1726 - DNA, 122614 bp, Homo sapiens
  misc_feature (1)...(122614): n = A,T,C or G
gagtgatagtggcaatactaaattgcagaggctgcccctccttgagtctccatcattccaggtgttaccaaggactgtgttatcaatgagcatttgctgagcactcggtatcaaacaaggcactgtgctggtcactggggaagccgaccagcctacacatggaaatttattctcaaggtgtccactgttcacgtggggacaccaggcactgcatggagagaaattacaataacaacatgtacgtgctcagttctacaggactctaagcaccttgaaaaacaggactatttcttttttagtcatcacagtacctagtgcctggcatatagatgtttattagatattggctgcatgaagaaaagaatgacatgagtaataaaggccatcagtatgggaagagggagagttcactgtggtctgagatgatcaaggaaggcttcatggaaaaagtggaattttgaacttgggcacagatgaagaataagacaactaaagaagaaggttggaaatggcattccaggcagggcaaagcatgagcaaaggcaaggaggcagaaatactcactgtaagctaaggctgccatgatgaggccaggtaagggagtatagaagttttgtgtaggagaatccaaacaggctgatcttgcaggcagtgcaggacacaggagggctgaagtggccattagtgacggcagttagagcggagcaggggaggagtgccgggcaggtgagcatgagaattggctgttgagtgacagcaatgcactgccatggcccactgttagcggcagtggctcatttggctggtgcagcctaaggaatctgggataccccatggtcagtatcatttgcggagcaatcacatcactgaatggtgactgaaaaggggcttccgtgaatgaaaatcagctcaagtcaccagctgagacctggaaaacatttttgggttcaatgctctttagtactctaaatgttattagctaatatgttttttaaaatcggggtgtatttaacatacaaaacgaaggatttctcttttaataaagtatccacttttcatcctagggtagtatagtacaataaacctcattcattcattcatccagctgccatttcctgggtatcactgtggcaacaacatgctggggatgcatgcatagggtcaaagactttcctatcggatcaccgatagagacttggagctgagagtgaggagggggacgtcatgttaataacaatagcaattgctgactgggtgctgacctggagccaggggttaacagtgcattgtctcatttaattcttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgtctcatttaattcttacaacagctctaagaagagtgtggttttgtcctaagttttcagaagaggaaactaaagtttagagaggttaggaatttgcctaaggtcatacagccagttaacaatagagccgggatggaatccaggtggttggaccccagggtctttcctctcaacactgtactgactcatgggtggacaggtgaaaggacagaagaaagagccagtaaagtagagagggaagggcagggcaagagtggagtgaggagggatctgcaaactcattgacgttgctggaaggttaagtacaaagtagggactggctaaagattagctgaagaggttggtataagccaagtcagatgattctgtagattctctttggagtatggggtttctcctaagggccggtggttctcgatcctggatatacatcagaattccttgggatgcttgtcaggaacctagattcttaggtgccgcgtcagattaattacatccaactcttcatgggcagggctgagaaatctgcatttaaacatgtttgcagggtgaacctcctgcagtcactttggtgtttgggaatgtctggccattgggagatactgaagtgtgtcaagccagggaatgatggatgcacattctagatctatcactttggtaggtctttggaaggttgaggtgagagagaggctttggggctagggaggggaaaacagactcaggccatatttaggagattaaatcagtagtgcttagtggtgatttggctgtgagagcagtgtgagaagtcaagggtaactcctgggcggctggtggtgtctccacctaagacagagttactggaggtggaggtgagtcagcttgggatacggtgagatgcaggtgcttggaggggagccaggtcagagctgtgaagtagggctcacctttgcctacctggaacttggaagacagagatatgggagccatgagcaggaaggcagtgggtgaaattctgagcaagtgagattgtcaaggaaggtcatcgaatgctaaggaccaagggtccgctccctgtctttgaagggacaggccaatgaagggaaggtcctgaaggagacagcagagtgtcagagaggcatatggacgcccagaaagccctttgggtggaggcagacaccaaactgctggagaaggagccggtcatgcccttcatggcttttggaaaagaaaatgaggccagggaaagtgagtcagcgtcatggggcagtgtctccacgtgttgcctattttgggaaagtgagatgccttattaaacaaactacagccaaactcacggtcacagtcccagcccgaagctcaggaggatcagggccttgggagcagagggccctgtgaagctgtgagcagcacgcaggccggcctggcctccttgcgctctccttttcctctctcctttatcgatccatttcggagcgagaaggcctctgagctggaggaggcagacagagtgattgcaggaaacttcggctctgctgaatgctctcaaatcaaattgtgcctctctgaaggatggacattcaacttatcaacatgaaagacaattgtggaaggaaggaaacaaacatttatggaattcttctctgtgccaagcactttacatacattatctcattttatcctcatcatgatcctaagaggtaggacttattattgcccctctcttcagagaagaggaaactgaggcttatgaaagccgaggcacttgcttgaggttatgtaacagctcatatttaccaagcacttactgtgtgtggacattaagcacatggcactcgttctccaatttaaccctcacaacaacataagaggtaggtattattatttttgctcttttataggtgaggaaacaggcacagaggcgttacataacttgcctaaggtaacacagatagggtgccgtgaaaacaagatgtaaatgcaggcaagctgacgccaagtccaggttctcgcagctacattacggtacacttgaccatctcacatggatgataaatgactccaaagcatactctttctgtgtcagtatgcttgctcctcaggactcagggtgcttctctttgcatttatagtgtagtttcattgattgattgagacaggatctcactctgtcacccaggctagagtgcagtggtgtgattagagcttactgcagccttgaactcctgggctctaatgaccctccagcctcagcctcctgagtagctgggactacaggtacatgccaccacacccagctacttaattttttttttttttttgtagagacgatgccttgctatgttgcccaggctggtctccaactcctggctgcaagtgctccttctgcctcagcctcctaaagtgctaggattacagacatgagctaccgcagaatttataatggagttttatgtaaattattcagccaaatgtgtggtggtcacattttgaaactgataggagataacaggaaagcatctgtttcactaattctcacgatccttccagggatggctgtgaacttgtgttagagaaacaagatgatctacaaagaagttctggggaagggccagatgatttcagttcatcatggtgatcacagtgggaactgaggagaaccaggcctcagcacagtagattttggcttagctttgactagctgtatgaccatgggtcagtcccttccctgcgctgagcctcaatttccttgtctgtaaaatgcagtgatcactaatgtttctttcagcttcaagtttctgggagttttttataggcactttcaaatgtgtgcagaggtagaaagtatcatataataaaccctcatatactcatagcggagtttcatcaattatcaatatatggccaatcttatttcatttacaccccatccactttccccttctccagtgaattattttaaagcaaatcccagacatctcatctcatcggtatatatttctaaaagatggctttaaaaaaaatcatgatgacattatcacacttaaaaattaatagtaattcctcaatatgccattgaatatggaactcagctttaaaaattctgtttgataatatggcaaaagacaaattgaagcttccagtattaatcagaacttgtggccagggaacagacttggagagaattataatgttatgtactaaggtaaaaaatgcatatatgtattatatttatacctccaaagattatgttcaatatataatatattattataaattatataatatataaaatataatatattatattatattttatattggtatatataattatatataacttaattataattatattggtatatataattatatatataacttaaatataattatatatcgttatatataattatatataacaattataattatatcagtatatataattatatataacctaattataattatatatcagtatatataattatatataacctaattataattatatatcagtatatataattatatataacctaattataattatatatcggtatatataattatatataacttaattattatatattggtatatataattatatgtaacgtaattattatatattggtatatataattatatataacttaattataattatatattggtatatataattatacataacttaattataattatatatgagcatatagaaattatatatactaatatataattatttatatattatatatattctttatatattattatatattaattatatgtaaacattatttatatatgtaattaaagaatgttatatatatgtaattaaagggcataatctttttttaaagtaatttttttttctttttttttgagatggagtttcactcttgtgcataatctcagctcactgcaaactctgtctcccaggtagcgattctctggcctcagcctcccaagtagctggcactctgcaggcgcatgccaccatgcccagctgatttttgtatttttagtagagatggggtttcaccatgttggccaggctggtctccatctcctgacctcaggtgatccacccgccttggcctcccaaagtgctgacattacagccatgagccaccgtgcccaggcaaggacataatcttttttttttgagatgaagtctctctctgttacccaggctggagtggaatggcgcgatctcacctcactgaaacctccacctcctggattcaagtgattcttctgcctcagccttccaagtagctgggattacaggcgcatgccaccacgcttggctaattttgtatttttagtagagacagggtttcaccatgttggccagactgatctcaaactcctgacctcaagtgatctgcctgccttggcctcccaaagtgctgggattacaggcgtgagccactgcgcccagccagggcataatcttttatactaatagtaggtacatttagggagattctacttgtgatttgccctgcactgtcccaggcactgtaagtgtatgctctcctttaatctgttttataaatgagatctcagtgccaagtacagtggcctaacgtcagaaagcttgtgaccagtgatgggtactgagcttaaggaaaaagtgaatggaaaaatctaagttcaatttaagtcatcaaattaaatataaattaggattaaatggtataaccctgtaacagaaataatttacctgagagggagaactaaagtgcatttcctcaaaaaataatctattttttcatcttgtaatgagtctgcaaccctatgctcaaaagtaaactgaatactattccccatatgtgctgcatgaagttacttcaaagcctttgtaacggctgttccctctgcccaaaatgctcttcattctctctggctcagttcataggtcttcttccagcctgtgagccctaaactacctcttgtgtccccgagccttcagaatttgttgcctgcactgttcatctgtcaatcgcaccctgtcttgtgacatcccctgtattgctgtcttgaactgctatttaaattcctggatgtttgtgttgtttccttaacgctgtggctccttgcccagtgcctgccaaccgtgggcgtgatggattcatccatttgtcaagccttcactaagtgcaccaagcctggagctcagggactggtagtcagaattaaccaaggcttggttccggagactttgcatctagtgagagttcaggcactcccgagggtgagcgctagttcccaagtttataaactgactgctgtattgtcatatactcaggttgctttaaaagaagtctttcttcctccaaagatttttcaaaagcaggcataagaaatagctaattgaagaacacttagagagaggttcctgcttatggacattaattgtggcaatttacgctgcctgagttaccatgaaagcatgggaggccccttagcaggaagtaaaactcgagggaggctattaaccatttaacattctctaaacaccagggaatgaagatttcgcttagtgaagagcagagagaggttgctgagctaatgcattggcctggagactttgaaagtttcagccctacccagtaggaaagaagtgtacaacagagtagtatgggcacctggatagcagctggagttctcttgaatgtgtgacaaataaaatgaaattggtatgaggactttggcaaagtcttgccaaggcttttctggaatggcagctcagattagttttggctgtttatgatagtcactgcaactgcctcctattagtgctgacttggctacttcccaagggggaggagtatttgtttttggtggtgggctggggaggtggatgtggaagggcactttattggggtgagagcattgtcctttttgaatagattattaatagagccttggatgatgagagaggcaaggaagaaggcagcagatggagccaaggctgaaggagctgggagcaggagtgatgaactgagagcagctgttgagagacagccagaagcaggggcctcagctctgggccatggggcagagcatgggtttgcaggcaggtggaccagttttgaggagcaatcccccagcatcctgcctccccacccctcgcttgacttggctgcctgtgagaagctagttttgttttgcttaggactgtccggtggtaagctgccacgctttctggagaatctgaacaatatgtcttttttgagaccttctagatcactggtctttgactggggcaggcataagtgggtgcttggcaggataccctggagagctttctccaggctcccatgctcgaaccccaccttggaccaactaattttgggttctcaggaagaagtcctggagcatatacctcagacaggctgttcaggtggttttgtggtacacttctggatagaaccactgctctagctcaggcccccttagaccaggttttggaaaacacatctctagggagtttactacctatccagaagcctgttccatctttggttttgatattgtgccttccataggacatgccaaatctctcagctatgtgggtccttcagctattgaagccagcctccagggttatgctccagcctaaatatccacgatgtttcttgattaatagttattaaaccaacctatgaattagtccaagttgaggatggggtaagagagaggagaacagaaagatgacattaaaaaaaaactcttactgtcaggatagaacaggatgtggcacaataaaagtccttaaaagtatattgatactgtctttttttttctcctgattataaaaacgatacttgttccctatgcaaacagtgaaaacccataaaggaaaattaaacccctagtaatcccacctaccagatatgaccattgttagtatttttgtgggtgtctttctcattaaactcacattactcattaaatttacagctttgtaaacttctttttctctaacaatatcaagatatttttggactttattaatattaactgatgttatcattattatttttttgagacagtgtcttgctctgttgctgcaactgcctcctgttagtgctgacttggccacttcccaagagggaggaacagtaacacacaatcacagttcactgcagctttgacctcccaggctcaagtgatcctcctacctcagcctcctcagtagctggggctacaggctcatgccaccatgccctgctattttaaaaattttttgtagagatggtgtctccctttgttgtccaggctggtctcaaactcctgggctcaagtgatgccttccaaagtgctggattacaggtgtgagccactgcacctggcccatgccatcattattaaaagctgccaactcttagtccctgattattggacattgagcctcaatggtggacattcttcaggaactctgaattcttcttcttcttcttcttctttttttttgagatggagtcttggctctgtcacccaggctgcagtgcagtggtgcgatcttggctcactgcaactccacctcctggtttcaagtgactctcctgcctcagcctcctgagtagctaggattataagcatgcaccaccacgtagggctaatttttgtatttttagtagagacagggtttcaccatgttggccaggctgttctcaaactcctgacctcaagtgatctgcctgcctgtgcctcccaaagtgctggcattacaggcgtgagccaccgtgcccagctgtgaattctttttaaccaagaagattgaatttagcccctcgccatagtctgacatccccatgaggcctgaccctggcccatgcctacctgccctgctggtggccaggtcagattggtctcagcagcttttgtgtcaggttggtttggaccttgatctgtagccatctaagaactgctcagctccttcctggacctgagatagaacttcttgagcttgaggtcccataactgttctcctccactgagcatcaccaatgatgtgggcaaggaggttccctgtggggaccagctcttcagatctacctagcaccagaacggttaaaactcatgaagtaccgctgagcttctgtgtttggtagaggcagtgctgaacttgtcctgtgaccttgggaaagggaccaactctgagtctccatttttccctctgtaaaatggagataatagctcctctctatcctgcctcacagagtcagaaggatcaaacgagatgatgtgggtaaaaagctttgtaaaccacagtgcatcaggcaaacccatgctatacttgataatggacctcccgatagagcccagaaaaaaaatgctgactcaagtctcacttgttctcccagacagagtggactcattggctgcatgagctttggggtgaagtctctcctgactccagacaaggtgggtcctagggatgcttctgtcaggatcatcccaactgggccggggctggtacaggcagagtttctctgtcagctcttgggcagggcttctctctgtgagatggtgccccactgagacaggtgccctgtggggtggcctgcatagcagcactgtgtttattacctgcctagctgagagtttgggtccccttcttggtttgtcttgccagagagcagtttgttaggcagccccaagtcttcccaggaggctctgagtctggtgtctgctgttgaagacattggcagatcccttggggcccagagcactcctgggcctgccccagaagatgagggccaggtgcacccgtggtccgttccaggggtcctcttcatgtgtctaccaggcctgatatttctgggcctaacaggtgctcaaggatggagtgagcagcaccatcctctgtggagctttccttcaggctggaggaggactctttgggacccaagactcctagctctgggtcactggtcccttatcaatttctacgctgcactggactccccaaactggaaggtggagggtggggagcactccttttgcacatccctggaaatgtcctggtggcttgtggcatggcctgccacgcagatttttgtcctggggtgggtggctgaggaccctttatcctgcatgtgagtcctaaagagcttctctctctctctctcttttttttttcttttgagacggagtctcactctgttgcccaggctggaatgcagtgttgtgatcttggctcgctgcaacctccgcctcccaggttcaagcaattctcctgcctcagcctcctgagtagctgggattataggcatctgccaccacgcctggctaatttttgtatttttagtagagatggggtttcaccatgttggccaggctggtctcaaactcctgacctcaggtgatccacccgtctcggcctcccaaagtgctgggattacaggtgtgagccaccgcgcccggtctagagcttctcttgactgcagccttggcttcattctcctagaaaagatgttccccctggagactgctcaggagccacaggatgccttttggtctctccatccctctttcactccttcacttctgttctgtcaacaaatatggctcctactgtataccaggcatagtgtgaggcacatcaaagagcctgtgcacaacttagtgggggagacaggcaagtagatggttgtcctccagggataagaggctgtgggaatttggcagaggggagagccagatctgccctgagcatcacggaaggcttcctggaggtgcaggcatggcagctcggggccaggaaggctggagagtctgtctctcctgtgggtgggtgtccagtggctacttttggagggggattggtggctgcctgacctgtgcttctgcctcctgtgtctgagcgtgccattccttctctcgtgacaggagatcagtggttggtactacctcctaggggagcacctgggccggaccaagcacttgaaggtggccaggcggcgactgcggccgctgagaggtacctgcacacccccttcagcttcccttcccaggacctgccccctccctcctttcctgcatagcggcatcagtactggtatttggtggcccctgctactgagaatgctatcagcctgctgggtgcagggacttctcaggagcacttgctagagtgcaggctgcaggaagcctcttgcccatgcctccactgtttatctggttggacttttactgtagaggctatggtctgaccccatgtggtttagctccctcccttgtggggtactttatgcttccccagtggccccttcccagctccatgtctcagggatcccccaggctgccttgctcatcttgggatacccacctctacagacagggcgtttaggtcctgccatgatccctaaggctcagaatgtggatttcatgacccttttccatgttctgcctttcccacatgcagccctggctcctgagtccctgtctggattgagcctcaggtgtccccacatcctgaggccaggagtggccctgggcagccccatgggcctgtttcccagtgctgtcctctgggtggtccgaggaggggagacttctctgccaccagaagttttctgattctgctctgtcaccttccagacccgctgctgagaatgccaggaggtggggacactgagaatgggaagaaactaaaggtaggtggggacaagctagggcattgctccaggagctggatctgctccttgacagcccctgggcccgggaaacccctaaaggggcagcatttggtgcttgaaactcagcaagtcatgtactcagaaggaataatttcttgattttcctgaggtgtattacaggaaataaatgctcttctcagggtatccatgatcgtggcaggggtggggaaatggccaggcccccacctctggaaatggaagcatctggatcttactaactttgggcctctagaaaccgagtcctccccttcccacagacttctcggccccctgcttcccctgggactgaggccgaatcaccctcccaggttaggcctgcttgatgtcagggggcagctgcgattctgaacctgagaccaaggtgttctaactctattagggcttcaagtctggaaaggagcctttttcatataaggagttgggagaattctccaaaagtcattccatctctttgcagggcatggcaggggatctacggttttctttaacaagtaagagagggaattacttggccaggtgtggtggcccacgcttgtgatcccagcactttgggaggccgaggtgggcggatcacctgaggtaaggagttcaagaccagcctggccaacacggtgaaaccttgtctctactaaaaatacaaaaaaattaactagacatggtgctgggcgtctgtagtcccagctacttgggaggctgaggcaggagaatcacttgaacccaggcagcggaggttgcagtgagctgagatcatgccactgcactccagcctgggtgacagagcaagactctgtctcaattgaaaaaaaaaaaaaaaaaaaaaaggaccgggcacggtggctgatgcctgtaataccagcactttgaaaggctgaggtgggcagatcacttgaggtcaagagttcgagaccagcctggctaatatggtgaaaccatgtctctactaaaaatacaaaaattagccaggcatggtggtgtgcacctgtagtcccagctacttgggaggctgaggcagaagaatcgcttgaacctgggaggtggaggttgcagtgagcggagattgtaccgctgcattccagcctaggcaagagaacgagattccatctcaaaaaaaaaaaaaaaaaaaaaggagaaacaaactcccagcaattcattagcccctgtataccaggtgctgttacctaatcttcactgcccgctctaaggcagctgttacttccgcatctcacagatgagagggacatacatggttcagagcattaggccctctctgtggccacacagctggcaggtggtgaaggcaggctctgagtgagggctggccaccttttcagtgtgctgtggcacactgcctcctgtgcatggcctagctgggaatataagacattgctgtagttcctaatagtattttacgtattacacaatatcggcgtattacaatctaccaaacattttcacgttcactgactcaagtcattcactcattcatcattcattaaatatttccacctatgtaggctgggccctgtgctgggtgctgggatgcagctctggacctgtctaaggccctgccccatggagcagtctagagctgtgctggccagtgtggtgaccacctgctacctgtggctattgagcacttagtggctagtgtgactggggaactgagtgtcaactttagttttaagtaatttcagtttacctggcacatgtgtctagctgcgactgggttagacagagaaacttgccaggagtaacttgtcaggtttgttttctgtggtttcattagttgaaaagctttcctctggcttctgtggggaactgcaaagacctttcctcctctctttctacttgccaagcacagagaggatggtgatcagggggcctccctcgtgattcatggaaattacatgggcatcaacaccgtaagtttgcttcctccaacatcacaggtttcttggtggcttgtaaagtcctcctgcgtgctggattctgcacacaggccctgagccccttgttctgaggtgcactggattttcctgaacttatgtgctcagagatgtctgtgggactcagcaaagagggtgtgcttctcagaggcttggttggggccgggggagagcccccagaggccatctcttcagctcctgtgctgtgcaggtggggagatggaggcccagaaacctgggtgacctgcccacagtcacacagcaaccaaagctgggttgaaccaaggaaccctctgtcatcaaggacttgagtgtgtggctgggcttccccaggggctctgagatgggcaaaagcagctgggctcaccatgcgctgctctgcaggatgctatcctgggactgccaggcaagaaataggacccaggttctggtcctagccccacactgccctgctgtttgaccataacctctccaggcctcagtttgtttgtcagtaagatgaggacgctgggttgtctgatgacctggaaatcccttccacatttgactttatggtccatgtgtatcaccagatcctgacagcaaaccacttccatggacaaaggacaaataaattgacttttttttttttttttttgagacagactctttctctgtcacccaggctggagtaccgtggcatgatctcagctcactgcaacctctgcctcctgggttcaagtgattctcctgccttagcctcccaagtagctaggactacaggcgcctgccaccacgcccagctaatttttgtattttttaagtagagacaaggttttaccatgttgaccaggctggtcttgaactcctgaccccaagtgatccatctgccttggcctcccaaagtgttgagattataggcatgagccaccacgcctggccgaaactgacttttaagtagtttccaagtggcaggcaggtcttcagactccaaatgttttatgttccctgtcatgagatgggatgtctgtgagtgcaaacccccccaaggtatccttggattctttaggctggggcagtctcctggatttctagcagggtccctgggacttgcagggggaggaggtgttgttatagagcagccacgttttctgcctgggttctcctccagtgaggggtgtttgtgagaacattggaatcacaaagtggcccatggcggagaatgcagccagaacaaaggcgccctctccccgccgggcccggggaatactaactagttgacaggaattttaatataaaactctccctcttccttgtcattctgaggtttcaggaagccttcgggcttatcgtgcagaggcacacagcacagacagggcttggggaggtgagaggtgatttcctgccattcttctgtggggcgggcttcccagggtgctcatgccaggctgacgggtccagtgcgggctcccgctgctgggggagagctgggttttcatggggcggcagccgaggcaggacccgcagccatgaaccgcttcaatgggctctgcaaggtgtgctcggagcgccgctaccgccaggtgggtgcttggcctcttgtggggagcctgtggggtgttcagggataggggtagagggaccatctgagaaggatctcgctcctcacaaggtcttctttgacctttcctgctccctgcaggctcacttggatatggggaggaggatagagacaggagctggacccaaggcccctttagggcccagctctgtatggagtcctaaccactggctgggtggtgtttttggtgagataatccagctagctttctgttctttttatctggggaggggctgtgggtgtgagattgaaaatgccatggttgctgagcagctgggagcagagtttgtatttttgctaacttttcctgcttctgacaggacagcagtgcccattctgccccctgtgcgtgtatgttggcacgtgctcatatgtgagatcgggtgttttcgtgtatatgtacatatgtataactttcctctcccctactgctgatgcctcactatggctcaggattcctttggctttggaatccaactttacagtgagggtttggcctcttagcctccggtcttagaaagggggaagactgggccattatgatcccattagctcccctgagcctcttctagaactgtgatgggccattttttctcataaaataggaatggggttagggatggtgaaggcaagtgatatctaatctggaagggagttctgaaattgtcctgattttaaaaaatcacatagagaagcccctctatttgttttaatgaccagattggactgtgggtcttgactcctctgactggcagtgcttaggtcccagggagatgcccagaggggtccctgcccccccacctgcctgctaggggatccagtgttttctctctagccctcccccgctctcaggttctgcccttcaggccccactctgtgtttcctgccctcatggggctgggaaaagcagcccctgcgacactagcgtctggatggcagagtggtgagacagagagagcactggttgggacatctagtagtccttggtcaccctggggctatgggctagaagactgggcatgctggctgtcagagtggggccaggagcaattgtgggctggacctagggctcagggactcagagttcaagatggtttctgtgttagaaaccagtgcagaattgagagcagcaagctttttgtcaggtctgagctcaaatctagctctgttcctctttagctgtggcttttgagcaagtcactgttcctctctgagcctttatctcctagtcagtaaaataggataatgaaatccagcgatggtgccatgggagtgaataggatgatgtgtgtgaagagcctggctcagtgtctgctgtgcatatttatctaggaggtgtttaatacatggcagaatttggggattacagtctaggcaggacagaggaacagaaactagacaggagagcagaggtaaggggctggcatgggtgagacctgggagcagtggctgttcctgccctggacaggaaagagcgagaaccacccgcaggaaggacaggctctgtcagaagccgccaaggcctcggggcagggctgctcctttcacctccaggtcagagcagggctgagagccggagggtggagggggtggcacttcgagtcttatctccttgtctgtaaaatgggcatactcattcccctaggggctgcagggatggtcaggttctttggacactaccctctcaatgtggtcagtgatcatggtggacagagtgtaattctgcttcctccgagctaggaggtgagcttgcctcccggcaccctctcctcttcccctccttcacactcccatctggcttggactgtggtctgggctggcacttcttaagctggtgcccaggagggtgaggggcccccagcccacagtcctgnnnnnnnnnnnnnnnnnnnnnnnnnnnnnnnnnnnnnnnnnnnnnnnnnnnnnnnnnnnnnnnnnnnnnccccactctccagttactgccccataactggccatccagagcccagggtgctgggatgggttttctatgcagggggctttggccctggatggggtaggggtggggaagtgctggataggctttgggaccccagcttgtgcttgggttgagggttggcttgtgaggcccctaaaaaatccccgctggttccatggagggggccaggctcctggcgtcttccctggcctcaggcgggcccggcaactagtggctgctcctttcccccagctttccacactcgtacccgcgtttgtttttctttctttctttccatttttttctcttcctgtcttagctgcgtgttttcccagaattcttatgggaacggggtattttcctgcctcctcccccttccccttgtctgtcaggtttcctgttttacaaacttgctttgaatccaggcccggggctggtgggaagcagagcctcagaggtccctgcagcttccaaggcccttggtcactctgagccccctcccactcaccttccttatgcctggccctgggatggtgggtaggtgaatgagtgcaggtgcctagtcttgcagggacaaccctcaaaggaaggagacagaagtctcctgacaaggcttgtgcccttgaccttttccaagcttgctgagctggcctttgtctcaactcacttgggacacccttccctgtgcctcaccagggcccaccccaagtcccagtttctctagggggtctctcgggaccccttgaatcccttttctgatttgtgctgcctttagcagccggaatgggctggcagaccaccctacatcctcctgtgtgtgggacactgccaggctgtcctccctgcattagcctctgctgagttcctaccatgtgccaagcatggcgtccatagtcggagcataaaggactgagaatggcccagtcctcctgcttttctttagtgcccgctgtgccctgcttcactctggagaggtttgtgtaccctcgtgctcctctgggaaccagagaccaaggctgcatgcctctgtatgtccacagagcctggcatgctgtaggagctcaataattgtgtgccagtttgaaaagagcatccagatggcaaggccctctcatggacttctgaaagtaggagttgtggacctgtcaagcacatgggcctcagcaggcacatgagtcagtggctagttcaggttcagccaggaagcctatctgtgaccttacctgggagtcctcatgggatgccttggggccctggccacagattggcccccagaacctcagctctcttcctctgacccttggcctgagatggagtgagtgtgtcccagtgtttcctcccctgtgctctgggagggcagtgaccaggctggccttgactttgggcccttagcacagggcccgccccaggctaacgctctgtgaacctctgtgagaaaggaagaagggagccaggaaaacagtggatcaaaggtgaggctgagtcatgcagtgctggtgggcccttggatcaagggctggggctgctggggctcaggatggcaaagtttgcttttccaagaccttgtccatcccaggccctccccacatcagcctgggtttacttgctgagctttgggccttcctgcttggcccacaacccagtgctcaagttgtctgggctgagatagggacactgaggggctggctagctcctttgtgcctccagttcccttggagaggagggtggctcttggcaggggtgggctgtgggcttcctgaccttggggtagaggcaagagcctccagcttctggcagtgaccgggcagggctgtgtcctagatcaccatcccgaggggaaaggacggctttggcttcaccatctgctgcgactctccagttcgagtccaggccgtggattccggtaagttattgacagggggatgccaaccccacttgcccaccacacatgtgggctttgcaaacatagtctggaactaaaaggggagccccaaactggagcaaagtgtcctggcttttcaaaatgaaaagaataatatttttaagtgaccgtagatgaaactgccatttatgaaaatatgcccactttttttttgttgtttttatcaaaatgaaaataggtttttatattttgtttcccaatcagtttgaacaggaactaaacctatattttcagcaatggctgcaagggaaaatgagagtcatttgtgaactctatttgaagctgttttgtatcctatccagagcctgatcagcacttaaaaagagccatccttccctacttttcacaaatgaagatttctcttaatcacagagtgagcatctcaaagacagaagccagggctcagtggtcagggtgtttccagtgcctacacaagggtgggcatgaggttcgtgcacaatgattggcagagaaggaataaatgtagtgtgggagcctggccccagggaaggttctcaatggggtaggaggccctggggaggggtaagggcccgggtagaagggtggactgcagagaggtaagccagcagtaggggaggtaagccagcagtaggggaggcaagcagggagaagggaaggcaaagggatgccttctttcaaggctcttgagaggcaccaagttcagtccctcatttcacggatgaagaaacttagagaaaaagggaggtccttgtctgaggtcaccatggcagcaaaggactccagatcctttgaaggggtcttaggcttcaggggcccctgaatggcttttctttgtccctgcagggggtccggcggaacgggcagggctgcagcagctggacacggtgctgcagctgaatgagaggcctgtggagcactggaaatgtgtggagctggcccacgagatccggtgacaggggacagcgggtggcctggggcctcaggctgatggcacaccctccccacccctgggcacactgccttgcctggcccagctcttgctgctccctcttttgcctagctgtgagcaggcaattccttttgctcttcaaggaatctgtttcttggcctgagaatggaaggttcaggctcagagcacttttggattccagagcaaacagcagggaagatgctctcagactctgtggttcaggacggggcaccaggaggttgctttctgctttagctaatttttgttacctaagagctaagcccatttgttatttaagggcatgaagatgttgcaaatgtttcaattgcacaattaaaaaaatattcttgaaaacattggagtctcccaaattttgatcctctagggtaaaaccccgatggccccattttaggtctgcttctggaataaccagatgagggcttgcacttaggtgacctgctagctttacttgcttatatcttgcttttgataagcatcatggattgagtatggaactctttcctgttgaaactggcctggcctcagggtccttctcaaccactgcccgtcaataggaattgacctaggtgacccatttgctgtctcttctttaaatggcttcttgcatcccttcctgccctgacactgggggcttcccctctggtgtctgcctcctcttcccccattatcctctctgccctgtgggccctcactctggctgatactggctttccccaggctcaacctgtctgtgtgatcccccaccttccaggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccaggtacggacagctggtgtggggaaggtgaagggtactgggtccctgtgggaggccaggaagacttgaagacccaaagttgtgtgatgagcagcctgtgaggggctgcgatgttgggcaaggagatggggtatgtgctagctctgccttctgcaaggctgttcttggtagggaggacagatgggtctatgtggcctcagggcacagattcaagaccagggcatgcacaggctggaagatttcaactcacagaaggaagagctttctactagcctgtgcttttccccagtggaatgggctgccttggtaggtggtgagcccccatcataggaggtatgaaagcagacactgcatgattgcatggtgggatgatggagtgcgctccccaaaacattagtcccatgagatgctctgggaaaaaggtgttctgaggtcaaataagcttgcgacatatcccataccctcttcctcatctaggagattctcaatgcaaaggagcctagtagaggctctgctggcatcctgtactacagcaggtgtcaaccaaataacaccgcatttcccaaacttgcctaatgggggcacactttagggcgtggttggtaccgtcttaccattccagtgttccctagaatgcactttggaaccagctgctgtaaaggaagttggggacttgccaaggggttaggcttcatgacccataaagcctctttcaacttgaatattctgggattttgtgttctctcccagcctcctccctcagctggttaccagaactgctgtttttctcttgtgccctgaggtgctccacttcctctcccctggggcccccgtgtccagcagcctcctgggctgtcctgccctgttcctggggctgaggtggttttcctgtctttcccttgcagctgctccggcctgtgtaccaggaggataccatccccgaaggtgagtctcctgctgctgctgtgccctcctagctcagagaggcagcaggggtcagctgaggcctggcccagcctccgcccctgagttctgaggcctttccaatggagtcaggtcacttagcctatcgacacagactctctttccacgtggtaccttttctccctcacggaaccaatgtctttcttccttgaagccagaactgagaaggaggagaggggatcttaccagggcattttgagagaccgtgtgtccaggcctcaggcattcaattgagattcatccaattttacagagcaaccgatatatattaggtgccagaggcaatgtggttgggcttgcatggaagggagtcagggagcgtggaggtgggaggtcttgagttggagttctagctatatgactttgagcaaatcatgtctccttggtcgggcgtggtggctcattcctgtaatcccagcactttggcaggctgaggtgggtggatcacgaggtcaggagattgagaccatcctggctaacacagtgaaaccccgtctctactaaaaatacaaaatcactactgggcgtggtggtgtgcgccaatagtcccagctactcaggaggctgaggcaggagaatcacttgaacctgggaggcagaggttgcaatgagccgagatcatgccactgcactctagcctgggtgacagagcgagactctgtctaaaaaaaaaaaaaaatcctgtcccctcgctgagcctcagtttcttcatttataaaatggggtcaataattcctacctcagagggttgttggggggatcccatgagagaatggttatgagtagttgcctgtatactgagagaggctatacagagggtagctgtctttgaagtgcacagatgtctctgctgctggatggattcttcttctttggcttttaaaatcctgatcaggggtggaagctgagctcaaaaccactttcttctcccaggaaggctgagatattggtcttgaggctgaagctggctgggcattccttgagatccttcgcgtgcctgccagaaagctttgactcagaagtccatctggtgtctggaccgccttccttgacagtggcttttgcttagccactcacagacttgcttccttgctgttcccctctcagtggtgtgaaggcgatgcttctagggggtagttggaaaagtgcttgtgccttttgcgggtgtgaagcgctcccatcaggctcagggatgctgatggaagacatcttctttctctccggtctggggcatttgggcagttgagcctggtcagttggaaataaatctgtgttccttctggggagaagtccgacagcaattcaatgatgagttttatttttattttttatttttccatagattattggggtacaagtggtatttggttacgtaagatttttagtggtgatttgtgagattttggtgcacccataacccgagcagaatatactgcaccccattcgtagtcttttatctctcacccccctcccatccttcccccgaagtctgcaaagtccatggtatcattcttatgcctttgcgtcctcatagcttagctcccatgtatcgttgagaacatacaatgtttggttttccattcctgagttacttcacttagaaaaatagtctccaatctcatccaggtcgctgcaaatgccgttaattcattcccttttatggctgagtagtattccatcaatgatgagtttttaaaaagcttttggttggcacattaggttagagtggagatgctgcagctaagtagggacttcattagggtcaaggcctgggcctggcttatttctgtaggtccagtgcaggacccagggcctggcggatggcagatactcagtagaattttggttgtgtgactgactgaaggagaacgacttgggttgcctctgaggctttggagtctggtcgtggaggaggggggctggagaagtgtgctgcctggagtgggcccatgcacacaggctggtgtctggggttgattccttctcagttgagaggtacttctgtgtctcccttctgtgctcccagcctgtatccatgtttcattcccctctgagagtataatacatagtaagtcagcaagagcacagttatctaagccatggggaaagggacaagtgaggaaatgatgatgatattaataaccatgctagctctttgaatgcattgtattaagatcctgaccttactttatgtattcttcataataataaatcttcactctttaccagggatcaagtctttgtagctcacaattttaggattcagaggaaagggtgaaattcagggcacacaatttcccttaaacacacttgggattgtccagaggttaaggctgtcaccagggtgctggcttcttagtccccctcctctggctgggctgccaagagatagcccttcaggagtgttgggtcatcctgagttgaataggagggagagttaagccatcctgagttgaatagggtctggtgcccttccggagcccagagtgcctgcccggctgtggttggcatgtttcccagggctgctggtgcccttggcattgtccctgccctgtaaaggtgacctggcctcagattcgccactgccagggcagggtggctgccagggctcgcctcagaatctgggagcaaagccctgtaattactgtatttggtcggtgaagcaggtgttggaggagaaaagggtgatatgggggtttggaccagacatcggtagcaggtgggaagtaaatgagtttgccttcacagagctcagtaactgggttgcaagctgtactgttctaaaaaaaaaaaaaaatcagttttacagagccactcccactagccacatattatccaggggtgggtggagattgggcacaagggcatgactgctgcataggttgggttaatcctgccttgtataatttactagccaaatgaccagtcaccctaccattccagacctcagtttccttgtctacaaaatggggctgagccgacttttcctctctgaaggcagaattatgtgttgggtacttcaggtgaggcccttggtgaggattctgtgacagccctgggcccctgggctagagaagggaagaaatcaattttttaagaagtccgagactgggggcccaggacccagattttggcatttacagttggtacccatctttacttttggtctattttgttccagtcatctgcttgtcagtcctgcatggttttgccttctctgctgtaggcttaaccatgttaaattagactgtctagatccaggctggccatggggtttcattcacagcatggtttgagaccgagcagccctgcctatccttctactaaccctggtaggtggattacttggaggcttaggatttgtgataatcccctgactactcacactgtggtacaatccaccaagctcttttccatcaggtctcttgtgtgaacctcccactggccctggggcaagcgaggcagcaatcagtattatctccacttcaaagtggagaaaactttgattcagagaaggaaggaagctgttcagggttacacagactgtctctgacttgggaagtcagtgatcaagctcgggtgtcttatccaactcaaattcagtgatgatcttgagactgaggatggtgctttaaacaaagggtccagggcctggcagcacacatccctctgggactgatatgtagggccagatcagacaaggagctatgtgacatcttccttgtatctgttcctcctgtgcccatccagggctcatgctcattctactcctctctccgtgactcacagaagaggcaggaagtggtttgagttatcatggtttgagcgctgcccccagatttgtctatgatcagtggtcacttgtcaggggcacggggggagtcaacttgtttttcttaccttgcttggtgagaaggggctgggggtgggaggaggaagcaagtgtgaaaccttctgaggtgagttttatctccgaggctgtgggtgcgcgttggtggggagcttccctgaggtatagctggggtcaggccacctgttcccccctcgctgccagggctgctggcagcagaagacagcctgcacccaggacccaggctgggcacccaggtcagtgaggacctggtagttgcccatacagtagcaggaatgccttagaaggggcccaggagtgtgtggagcctgactgctttggagtttccctcccacctgcttggtccaggaacccctgactttttagcgactttgtgttttgtccctctgcctactagacggaatgtaacaaaaacctgtgcacaggctgggcatggtggctcatgcctgtaatcccagcactttgggaggctgaggcgggcggatcacctgaggttgggagttcgagaccagcctgaccaacatggagaaactgtgtctctactaaaaatacaaaattagccgggcgtggtggtgcatgcctgtaatcccagctacttgggggactgaggcaggagaatcacttgaacctgggaggtgggggttgtggtgagccgagatcggccactgcactccagcctgagcaataagagggaaactccgtctcaaacaaacaaacaaaaaaacaacaacaaaaacgtgtgcaccaccccttgttcagggtgaggggtgtgtgtccatcagtgtccccttaaagagggacccctccccccacaccgccgttgcagcctctgctgtccttcctgggggtggtcttgtttctctgtttctctctctctctccttatgattagaatgatttgtgagttggtggccaagccggagtacctcctgggtacagtgaagcctgggattcccagagtcctatggggcacctgactcccaaacttgcttttccaagtggagaaatcacaacaacgaaacaacactgagtttgcagctaacttttatcacacacttactaggtcccaggcactgttctaaagactctaagtgaacttagagtatttcatttaatcttcactgtaacccagtgagcttggcactattgttacagttgaggaaatcaagactctgagggtgaaataagttgcccaagctcactgagctggtaagcaggggagcaggatttgagcacagccacctggctttgaagcttgtgcgctttcctgtgacctggggcagcaagtgccactccttattctagactgactggagtgggccaggctgctctagctcccttggctacagagggaggactccagtacatcctgggaaagcctttggtctccgctgccactgctgcagagagtggatttttgtctgtggggcagggagggaggaaacagattgggctgggctgagcttgtgcagggagtagtgggaatggtgtgggggtctgttaaggagagcgcgtaccctgccacacaggctggtcaccactctgctccaactgattgttccacgtgggactgtgggctcagtgaggacagatcttctgatttttcaaatatgagcgatttcttgatttttaaaagactgaggccaaaatggaaattctgatccggggcctgggtcagcaggtggagtgtgctgcctccatcatagctggtggtgcccagcgctgtgctagccctggacttgcttgctcacgtgtcaacgtctctcactagagtgcgagggaattccttgaagcccgagcccatgtgaagcctccctgtgtttcagcatcgtgcgcagggcctggcacaaagtagctgctcagaaagtggttgttgacggaatgagtccgtgtcccctgtttctacagaggggacacctttgcaggagtgacggaaatgtctcatagtcccccatctctgtttcacagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcaggtgagcccgtggctggtcttaaaggttccctcaggaggaacggagaaagaggagggcccttgccccaggactcagggatgatgacttatcccaggactgagggccctgttttgggaaagataagtagctttagatgcataggattctaggggcttatactgagggagcagagatttccagggagatacacaggaaaaagtgaggccgggatagcccagtaaggaaagggtcctctccttcccccacctcgcctcccctttctctggggaaagggcaggtgcaccccagctgcttgttgccatgtcacagggactgtttgccaaagctcccgctccctggctcacccagtggttttttatttgaaaataactgagggagacccttggggtctgtgccttatctgctctccctggtctctgcaaacaagtttggcctgtattcactggtggcctgcgattcactagatcgctcttattctccaacgtcaaacaaagtgcttgaagaaagataatgaaacaaacagcaagctgggcctgaaatcccagctacttgggaggctgagatggaaggatcgtttgaggccaggagttcgaggttacaatgagctgtgatcataaccctgcactccagcctcttcttcttcccccttttcctccccatttatctctccttctctttaaaaataacctttattgggccaggtgtggtggctcacgcctgtaatcccagcactttgggaggcctaggtggtggatcacttgaggtcaggagttcaagaccagcctggtcaagataaaaaccccatctctactaaaaatacaaaaaaattagctgggtgcggtggcaggcgcctgtaatcccagctattcgggaggctgaggcaggagaatcgcttgaacctggggggtggaggttgcagtgagccgagatcacaccactgcactccagcctgggagacagagtgagactctgtctcaaaaaaaaaagaaacaaaacaaaaacctaaaaatctttatttattccatcacccagatatgatagtgtgaacatttcagcatcttttctgtgtgcatatgcacattaaaaaacagaccttattctatattttatatcatgttgcctttttaaaaggaaaattgtagcatgaacctttcccacaccactaaatgctctgtgttttacggtggttgcccactcttcttttatatgggtatactgtatttatttaaccagttctgtattcagatacttctgtctactcttttgctattgtaaataaccctgtgatgaaaatccttgcgcatggattgcctctctgattattttccttgggagagattgctgaaagggaaatgactgggtcatgggtcataaacattttaaaggctctttacacatattgacaaattgctttgcaggaagattctaatggtttatcgtcttatcagcagcatagacatgacttggccccacgggcttcatttctgcctgtgcctctctggtctccctggcatcccagtctgagcctgtcactgtccagtaggcacactttgttaggatgcaacacatctctgggagctcacacgcctccccttagacagctctgtcagcagggcctggccttagcctttctgtgggtctcttctctttcttagcatgtgacacaaagttcttggcatctacaatgtctaattttctttctttttctttttttttttttgagatggagtttcactctttttgcccaggccggagtgcaagggtgcgatctcggctcactgcaacctccacctcccaggttcaagcaattctcctgccttagcctcccaagtagctgggattacaggtgcccacgaccatgcctggctagttttttgtatttttagtagagacggggttttaccatgttggccaggctggtctcgaactcctgacctcaggtgatccacccgcctcggccttccaaagtgctgggattacaggcatgagccaccacatgcggcctgtgtctaattttcatgttcattttaatatttgtataagaaactacttctatttaagagacagtctctcgctgtgtcccccaggctggagtgcagtggtatgatcacagctcactgtaacctcaagctcctggcctcaaatgatccttccacctcagcctcccaagtagctgggatttcaggtccagcttgctatttgtttcatgatctttctttaagcaccttgcttgatgtcatgtacttagaagccatattagaaatatacagtcataaggacaagtcctgctgggtaatccagagcttagggagcttcctctgggctgggctgggcaaggtgagggagtagggtgagaggtttgggtgataattgacccttgggggattgcctgagaaggagacagttcaagtgtgctatgagtgcagagcagggactggcctggctttgaagggactcaagtgaccaaatctcttggcatgtggctctcaggatgcctcttggtcctgtgaggcatgaacaggatagatgggggatggcgggggctgggagggcccaggagcccagtgcagtggggggtgagagctggggctgaggactgcagagggcctaagcctgtggttagacttcctgtcaatgagtgtagctctcacggtgagggttgatggggaaggtggcagcaacagttccacaggacagcagcgtctctctttctgtttccatcttatgtatgagggggtgtgtgggttctcgggtcggtggcgggctgacagtcttctctgggtcagagggttctctgtggctggctttgacaagctgctgcttcctccccccgggtcctcacccagcctctttttgaactgcccactcagcctgctttatttccagcctctagatctctgtaatcctgcccggaccctcctgctgtcagaggagctgctgctgtatgaagggaggaacaaggctgccgaggtaagactttcacctgcattttttagggggctttctgggtgggcttcattggcattctccaggcccctcactttggtctcttcctgagtatcttagaattgtacattctcagggtaggggagacctgagaaggaccccgccactctccctagcaaaggctacccagctttttcttgtacatctcctttcaaaagctgtcgaatccttctttgatggttagaaagtttccccagcccctaaagacaccccattgtttatcccaccttcctctcaggagcagaagagatggcaatttaccctggctgtggggagtgactttggtggcaggaagagtaaagctattagccaaagtgaatttttagaccagcatcagtttacctgagttttctgggcctgttttaacccaaatcccatgtcctcttctgagagacgagtctatgatttcgcctgggttgtagctctgcctgtggggtgctgacatgggacctgtgtcacccttcctgggagctggcctgggatgcttttctctaattgggagaacttcattcatctacacaaccccagagctggtcagttcagtctctgagcttaaactacttgggtacagaagttggagccctgggctctgccctggctacctggggccatggggtgagggtagcaggctctttgcagatcaggccccaatgtagagctgccttggctgagtcgagtggcagcttggggtagtggaaagatcaggaaacttggagacaggaagtttgtatcgagacccaggtctgctgctggctcacatgtgatttcttccttcttcctcagtctttccatctgagcagtaggtatgtgtgtatttgaggcagtaagggcagggtcagaggttggtctgtaaggacgctttaaacctcagccttctgggacactatgtgtgactgtggctgaagcaggaggttggtttgttttttaagtaagcagactggactggaactcatctattccaaatgtacattatctttttcaagggagtgccctgggggactgcatgctcccttccaccgctcgctgttgcctactgtatttctggacctcctcttttccgaacctcctcttgggaactttgcaaactttgggaacttaacaatctttgcatatcttctgaattgtctcagtgggagtaaaacttcatctgttgggagggatttaagttttagggatgagaagtcacttagagctatgtttggtgaatgagagtgtggtggacctaagtctggcatccaagggtcagaaattgaggtgtggccataaattcacagactcataagaagccagttagagatggcagccaccctgaaacatatacataagtctaaattcactcttctgtttgtccacttacccttgaatctgcaaacattgagcacttattgtgtatcctcattgtgtatgcattttacatacttgaccccaattagctcttgcagcacccccatgaaaggcacgattgtccccactctgtagttaaggcaactgaggctccagtgagattcactgggacccaagagtctccaggctggtaaggaatggagccgggtcatttctggctcagtgatgctttccatgaccccacactgcttctggcatgtctgcataaagacaaactaaggaacacaagctgaagccagagccttgtgacagttgcaattcgtccagaaaaccctgccttatagatctctggagacttagaaccaagagacccctctcccttagccttgaagattgaaggaaacaatttgaagacaagtaaaataaatattaatgtattcctttttgttgaagtatgatggcaaccaaacatgtagatctgggcatcctgtcatattactcacaccaaaaaaaaaaaaaaaaaaaaattcaaagggatttggataaattcatgaaatctcagcattggttaggctttcaggagtcatccatgctaattgcttccttgtaactttccagttaaatggttttctgattggtgcttgaatcttctagggcagcccattagagcagtggtttttttttttactgggaagggctaaattgtagagcattctcccttacactcaacagaaatctttatttgtggaatgttcctccttggttctttgtcccatcacttctctgggcatgctcaagtttgctaacatctgtgagctgatccagtcccgcaccgtgaactaccctcatcacagccccttccagaagtaatagacttgattaatgtgccctgaggtctatggccctgtgcgaggttctgggaataccatgaagcacaagacagacacaccctccctttacacactgactcatggagtttaccattaactaaggcaccaaagtctttttggtaaactctgctcttaggtcagattcccaagaagaagcttagttagggccacttgggagaagccaccctccaagtggtaaggacccccttaccaagtgatccctcaactctgaccctttggaaaatcagatgtgtccttggagcaagtgtggggaagacactgggtgacccccgtggcctgtggaaggcgacaggtgattgggccatggagatgggcatcactctcccatgggctgccgtggcccctgctggtgctggtgagatgggggagtccacatgccctccccggcacgcttgcccctctgctctgcctccagctgtgtgccagctctggcctttccctgacccaacctttgggaaatttttcatttatgccttaatcacttcctgtctagaccatattctcagccctgggaatctgagccagagtggtggcctgggccttttctcaccttgctcatggttcttccccagttgctggtggctcctcctacttgccctacttccacccctctctgggcctgggctgttttttttttttttttttttttaaactttctaggctcctgacagattgtcggctccagcccttcccctgccagcctccctctgggtctggaggtgactaccagatttcccttgagtcagcgacacgttttgtgggaccctgagggtttgctttgtgtttctggctagtttagagccttctttccattgctcggactttgaagtcttctcagacaaccaattccttgactccttctgagctcttgagtcattttcttcacctcatctcttaacattattattatcattattattattaattattatttttgcctcatttgctccacctctttggtctctggattctttcacattcaggaactgcacagctgtaagcacattggtatctctctgtatagtgatagctttaggtcagctatacctgggtaatggtccctggctgtgtggccatggacaggtcacttaacctgtctgagctctagggtcctcatctgtaaatgagggcagtggtgttatttataagtgaggatccactgagcagaaaggaagcgttcaacacttgaagacttctcttgggctgcactgagacagggctgtggtgggaagggttagggtcactaccaagatgccttatagcccagggttctggagtcctcatgtttgggccccattggagaagccaaagcccctgagagctccttcaaggacgtctccctgttgtctctgcagcccagatttcctcaagcctctgtatttgtgctacactcaagaagccaagccatattttgatatatattctatatttttaaattacaaaagtaacagtgattgcaaatataatacacattaaatcaaaatgtatcaattaaaatcccactccctggagtgaggagtgtggcatcttaactattttaaaaatgtataactatagagaaatgtgttgttttgttttacaaaattggattctatgctagatatttttgcacattgtactattttgatttacgatagacagatttctatttctgcccacatagctctactttattttttaatagttgcataaaattctgccgtatgaagttagcacaattcattttattcatcttctcttgatgaatgtttgttattttcttaaattacaaaaatgctgctgagaacatcctcatatgttcatatttatacctccttgtaagtatttctgtaggatagagtctcagaagtgaggctgtggggtcatctttaacaggttgatagctgaatgtcaacctgttggctttttaaatgtcaccaacagtccaacacacactcacggtacccttcagtgcatgccaagcccttctggctggttcttcttcagaagagacaaggtgtcaggtgtttgatatctcaaagggaagttcacatacttaataacactttgttttctttggagaatctaaaattggattttattgcttttgactaaaggccactgcaggatttgcaaaacaaagaacagtgtaatctttagtggcattaaaggatcaagtggattttcttagcataaaaatatgctgagcgtgcctgttggtttacctataatgtctaagaatagcctctgcctttatttttggagcagctaatgcatgaaaaagataaaagtgatgtccatgtctgtactagagtgtgagtaactggctgtttcttaaactgatttctcattaatgcaattaaacttatccacaaggaatttgataatattagctcacattgtgtggcgctttactaggtctgcaaaaagctcttggaaggatcctgtaagaatgccaagcagggactcttctccctgtttgggctgttgagaaaactgaaggggttaaggggtttaagccaatatttttgtggctagttggtggcagagctgggataggagcctcctgacttctgactttcaagtccagtgctctttcagccagacacttagagcagaataaaagcaaatatggaaaatcttacagcttaaggattgctccaagccccaggtgctgggctggaggctccaggagcatttggtcagagatgtaggcttcggggatcaggctgtggagaggcttgcagagaccagctgccatggagggtgagggccacttttccccttctgtttgcttttttcctactttgaggagtggaagtataggaagctggagggtgatggggccatcttgactgcaggtcaggactgcccttggctgaggctgtactgagcactgctcctggttttgtgtgagatgatgaggatgcattatctggggaggctgtggctccccaccttctcggggaggttgtggctctcagcctccagaggacagcaaagtagccagttctgtttgctctctgtcaacccaggtgacactgtttgcctattcggacctgctgctcttcaccaaggaggacgagcctggccgctgcgacgtcctgaggaaccccctctacctccagagtgtgaagctgcaggaaggtaagcagatgccgtaggtgcccagagcccctctcaacttgccccagtcccactgctctgggcagccctctgggatctggctgccagtcatccgtagggcactggagtgtgtgctgctgggctctgtccatgggctagtaggtctcagacactggcattctttctaggctggtaagccttctgatatacctgaggttttcagggaagtttctattctagagactttccagagaggctgtggagtcgggtaggaagagctttggattcagacagacctgtgctcaaatcttggccctgtccctccatactgggatgactgtgggcactgtactcagcctctctgagactgtttcctcccgtgtaaatagggataaaaatagtaaccgagaaggttgctgtgaagattaagctaggtcataaatgcaaagtgcctggcccataacaggtgcccaataaatacttgttgccacccactcaccccacagatctgtggacagagaccgcaactcggctctactcagctgcatggccctgcggagcccaagccgctggggctcaggcacatgtgggagcgtggagggaatttctaacccaaactttccaccacgccctccactcgtgggaggggaagccagctgggagtatctgtcagtggtttggtttggcgcctgaggtctctgctgagaggggctcggtttcctctcccagatcatgaaaacaacagacccgtttgaggatgggtgacaggggcagagaggaaaatattacccagtgaaagaattctgttttggtggggtttgctcgggaaagcttcctggctgtttgcaaactgtcctgcctgcttagtgcctgagtgttcctcctcctcggaaacccattcagtatgagaaccgccactctcacttccccacaggaagccactgacaacttctccatctcgggctctggcctttcccctgtccatggaagggaaaagcaagtcacctcactgggtcagctcctccctccaggcgggctcagcctgaccacagggcggtgggaagaagccgcctgagcaactccagttccggcactggcattcccagagttccccatgcctgctggagggcattaggttggagttccagtggcctctgttcctgggctttcctgccatcctctccatacccccagcccctccctggctccctcacacccagcttcccatatgcccattctccagcctgcagtgtgcatattcacacatgcactcacaccgagtcccttcttctctgcttccccctccctgcccccagcccagacagtctaggaccccatcacatttgagggaggagcactggatgggccagggctcagtaatatgccctggttggtacatgaatggaaccctctctctgttgtgcacattacaaggctgaagctataacccaggaccctggtttgctcagcttcctgcgagaaggagggagggaagagaagcaaggctcacactggctacaatttgggtggaggtggaggttgcggggagaaggtagtagaggagctgagggcagtggctgggagtctgggatctgggcgtggtactgctgtgctgtgctgtgtggcttcagctggccctttccctttgccttcagtttctctgactgggaactaagggtggggccagcgctttgtgtccctcccagctctgatgccctcacacagaaccccagagcttgctgtgagcagctgctggaccatgcctatattatcctgcctctacccctctgggggcctggttggggaattggttgggatctccccttctggaggccccaggccccagacttgaagctaggggtggggtgtgctccatcctccactgggttgtgatggtcaaggtgggtggtgtggggccttggggtgtcacagagactctccaggtgctgagctgcttttgagctgcagccttgtgtaagcttggcactgtggcttcctctccctgcagatggagggcgagctgcacaagggctgaggatggccaaggcagtacttctcaggagagaccaccatggacggaagagccccttgggttggtgtgggagaggggcctgtgtgtgtgtgtgtgcatgtgtctgcctgccctggatttttttggatagatggtttggggccaaactccagggagcctgagagctgctgagagggatggaaatggctccatttctaggtgcacaatccaacgcttagatttctttccaggcaccgatagagcccttgccttcccccagctgcccccactcccctgagacaggcttgtgggcccagaggctcatggaagtttagtgaccccttctcctgcagtctaaattggagccgcaggacccagtgttctgagtcctggcgtccaatttcctgcctgcttcccctgtgccccaagagacctgctgcagcagcaagggcctgaggcttttaagggatgcatttgggacctcagctggagcctctgttggcagaatggtctctgattaatattgctcatgactcctaggtttcttatttgtctctttcaaaccaccatgtatgcagaattcaatttggggcaaagaagatggcaaacaaggaatgcacccaacctttctggctggttggggctggcaggggctgctccctggcaggggagaatcagccccatgctagggaccaaggtatccctgtgtaacttgtctgaagagtccttagctccattggccaagcatactcccagggcctagcctggggcatggaacactgtgggtgcctaatcaatgtttgttgtgtgaatgaatgactaaaaggagagcagaagtgttgcctcagttcgggagctgggggtgcacctctcccccagggctcctgggtggtagtcacttaaatcttgtctggccccgtcctgcccagcctcccctaggcttcagcagggctgaatggcagtgtaatgggaacaggcggagagctggcgctaacaattggaacatctccggtcagccggggcccattgtggtctcttcctgcctctgctgcccgctagctttgctactctttgtgttgctgcctcccaggtggccagcgtcatgcccatagtgtgtctttctggcctgctctggtgtctcagaagtggcctggaaatgttttgctgattattaggctctccagtcaccttagagccaggtaggcagttgcagaaagtcagttgctttggtctcagctgctggaatgtttggagttaactcttggttagtcctcattttctgagcacgtcctcagaacccacatcagtgatagcagtgctggggtggtagcagtggaagggacacgttgccacctctggggctcatagcctggtggaatgcagacgagtaaccgtggaggggtagaagtgtgacatggtggtcaggacgtaggctctggaggcaggcagtcctcacttcaaagctcggctttgccacttactcaatgtatgccctattcatgttgttctccctccctgggcctcagtctctatatctggagaatggggacaataccccttctgcttgcctcagacagcgaagggggtttgcttaatggttgagttttggatctcagatcaggtgagagagggctctgggaaagtgacggaggggtcagacctgggccaggaagctatctctggggcccacccagcccgtgattggggatccctcctgcatggtccatgtattccttgcgggaagcgaggtccactctggaacccaatggctccttgttgcatttcaaaatgccaaggcagttggaatgtttaaaggaaaacccagatgcgtgctgcccttctcctccctcctagcccccagttctaatgttctagaaggggcagaatttctctcctgggtcagccccttgcagcctgttttctacagctgcagctcctctccggcacccttggcttcctcagtttgttgttcttttatgaggctctgaaccatgctgagtgctgcccccattccgtcctcctctcaaagtactgccagcacaaggctgtgacgtggaacagatttcagagaaagtttgcagtaatgcagggaggttggggaaggaggcaagggtgtcacagcacagaaaagttgtcaaggcaatccatccaccattccctgccataggaaatatgtctcagggagtgttcccccaacctcagcctcctatttccctgcagctctcatctcctggactttcctctcccttctagaaccttctcttttcttgccgccagcttctaacccccaagtttctgttattttcttacatagatccttttgactcttacttggcactaggatctgcttctggaaggccaaagaaatgtcccagtgtgttctcttaaacaaaagaaaccacctcctcttgtctccaccctcagcaacacaaggaaccagcagaagctttgaaattacagttttcttaaacatgatggacttcttaggcaggactccctccctccccagtccatcgctaggtgggaagaagtagaaagatttattctccctaagtccgaagtgaaccctcatttacataagggagattttttaatctggctgtgcctggcagcccttggccctagggatagctttgtctcagaactgcccatataccttgcttcgagggggcctggccttcacccacaccagggccctcattcactgcttttcttaggaattgacttgacccacagtctctatttttatcttgctgtcttctctttgcaactaattttgctgtctttgacaatttctttacttcaagtatgtgttaagggttctaccttgagcccagcactggcctggtgctttgagaggacagaggagctggatagggcatatgtggtgggcatttgagaggtgggctgtgtagtggtaggagtgtgggctctggatccaggctacctgggtctaaatcttgattctcttccttactcctgggcaagttactcaattcatctgtgcctcagttttctcaagagtcttgggtgaaaagagccctgtcttccaggggttgttgtgagggtcaagcatatccatgggaagcataaggaacagtggttggcatggagcactgtggtgcgctaaggtcctgtggccctttaagcatttactgttttacgtgctgcgtggttgcttccctcaacaatgacagtttgcctagtgagacccattgcacggtcacagggagtaaccatcccaggaccgtgcccagacaagtgacctaagcgggagtgctgccaggccctgaggagtggctgcagtgggcagggcaggtgtcctggagggagggaccaggctgcttctctgcacttgctcttccttgaacacaatttgtgcttctcttggaatgtcctttcttcccaccttgagtccaaactcaacagggccctccttcaggaagcttttcccagaagctgggtgtcatctcctggtcctcctgcttctgaagcgctctgagcaatcaccttccctcggcgttgacattggaccttagctcctctgctgaaggaggcagttgctgacagccctcccagatgcctcccaggtggaggggagttagtgaatggttgcaactgggatcctggactaggggttaggaggctataggaaaacatacagagaggtgaagcctgggcctggaagctgtctctgggctccacccagtctatgacagggtatccacctgcacagcccaccattccttggcggaaaacaagcctccctattgaatttcaaaatggcaaaggcagttggagcatttaaaggaaaatccagatgtgtgctgcctccaggtctctcactgcagaaatcatggaagggaggaggcctcctgggatggatgagggctccccccagtacctgatgcccagagggtgctgctggctacctctcctggggatgaggtttcagcattccttgggccaggctgacccgcaggcaaatgccttagagctgtacattaccctggttagttacgtagccaattttcctccagagacttccctgcctcccatgcctgcctctctcttttcccaggaggtgccacacacagccttctgggcaagacagctgactgtgctggagcaaactgctgaggctctttatccagttctaatgcaaatcttactttttgttccctcaaaggttcttcagaagacctgaaattctgcgtgctctatctagcagaggtgagtcctttcctctggatttgaggagagagatcttcgacctggtgcttgaggggagacactgggctgggatctagaccagtgttctgatgccagcctccatacccactcatgccgaagtcctgggcaaggccagagtagcggttttttgctaggtagaatgggactagccattcctgcccctgcctctctcacctctgtgttaaagagcagtggacaggaaagtgcttagaacagacccttgagattttctgtgcaggacctcctgaactgcaggaatctcagtgggggtgtggccgggcaactgtgcatcaccctgtttactggttaatagcccttcctctagagatcgccctgattcctgtacctgcctcttgcttccacgttttccaggaagtaccaccaacgaccccttgtacagggtcttgtcagtgtttcaaaaggcctgaaggtatttgtacctttacctgggccagataatacaggctaaaacaaacatccagtgtctgggtttcaggctggaatgatacccactcagtgtggttgagattcctggttatctcagtctgatcagaagcttagataggcagtgctgtgcctttgctgagcaacatctggcaagtaacttattacttgatttggtttggtagataaaatatcattaaggctggggtttaacccaagagatccttgaagatgaaaaagttgagagccactgagctatacaaatacttttcaattttcggtgaattttctattcactgcagggcggtgtctgttcaagcaaggatgcattagacacattcctgcctctgccttcgcttaagtttgtctcatgcaacagtccagggaacctgttttgtgggaggtgggacatggtctatattggctggccaagaggaacacacccctttgagaaggaactgtacacagtttgtgattgaaaatcattctttcagttcctggctaagaagtgcaaggcctagagagagtttttgaacagccccctggaggagaagacagttgatgagaagttagctttagcggagggcagagagttccaaagaggcagtggacattgctggggctcagctggggaactgggctgcctgaaatacagacctgagggccaagagggcattggatgtcctcccctgtgtcaggcacattcccccggagcacaggaagtggctgatggaatcacttcagtgctggagggtgtttagttccacagagccaagcaagcagagaggagaagccatgaccaggctaggctcttcctccagcctcaccacactgggttctgattctctggggcagttcctgaaaggaggctccaggttctttaatgccaatagagcttccttccaggttgggttagttttttcccagagaaaaggacttctgctccattagtttcctgggatctgtgacgtgctggcttccagagattgtgaagggatattgatttgcggctttttgtttcagtaaagtgccaggtgatctgatctccaggggctgtgggattgagcttacaggcagctagaagcctctctcttctcttaatgggttgctatttagaagaagtactataattcagggaagacaagatgccttcttgctctgtagcctggaccactcttaacatgggtggttttggatcctatcaagagcctgaaactcacatcttagttggaacttctgacaagtgatttctcttcattgcctgacatgcaggtggcatccagagaagaaaaagagagtcaggatttggagaagttttttgactctgtattgagaaaggcccaattgcctgggtgatggcagctctgattgttctctagctgcaagatcctgggtggtgttatccgaaagtagtcctgggctctgggtctctattgcctggacaggtgtgtttctcagttcctgcaaatacactggacagatgcagcccacaattggcttcagaacacagaaggctctgaagtcagttgggtccatgggcacattggtcagggactattctctaacctagaatctgatgttggctccattaatttaagagtcttggagttaggaaaacctagatttgaatcttggctctgccattttctgagtgatctggggccagttacaaactcatctctgaaatggggctggttctaccctgcagggttgtggtaatgattaaatgagattcaataagacttgcatccaaagcacttagcacagagcctggcacacagtgagcgctcaataaatggtagctattgttattgtcagtttcaaaacaaggggaagggctcttcatattcatttactctccattagagaaatcacaaatgatttattggtcttttaagaagaaagctaagaggaatagctcatattctttgtaatgtgcatatacagttatacaaatatggtaagatcacagactctggaggaggcagaagacaaacagtgaatctctcctctcccgagacctcctggggccagtgacataacctctctgagccttagttttctcatctgaaaaatggtagcagctgctttccttcctacctatgtcatagggtcattaggagaactgaattaaatgacagaatttttatcaaagcaaatgaaccaacttaatttatggctgaagaggttttgttttttacaaagatacagttaattcaggagcaaggaggtaaggcaagagcgggattttaaagaggccaagaggagctgggtgtctggttggatttcaggatgcccatgtttaaatgcacaggtctgtgcccagtgcttctgggccagggccagtgcatctgaaaggtctgtgcttggctgaccaccccatagtcaggaggcaccgtctgagtgagttatgtgaggaagccttcagggtggcttatggccttgaccacagagcctgctattgagggcacagtgggcatcagtgttgggactgacgagttggatcacaccctggattaaaagagatggtttacctgtgagggaagccaggaaggtaatgagtgtccccaatttagacagatttaggcagatgggaattcagcctccctggagggagctggcttagtgctctctctcttggcttggccaagagagagagagaccaaagcttaggtctcccgaaaatgtttgcccatctaagccagccagctctgccccctgccttggaagccttctgggtcctctagtattacagcttcaagctctgagagccagagacccagccctacactctgctgttgagacaggcaatacggtcaccatctcaggtgaagaaataatggctttccaaaggagattcccatggggcagggcagcagagggtggttcttgtggtgtcagcaaaacaggcataatcatggctattaccttgcagtgtcgttggaagaaatgtcgaggtatcactggtaaggggcttagcactgtgcagggcatgggatttgagggggctgcctcagtattgagggtaggtggctctctcactgtgagaggccctcccaggatggggggagctctttcatacttttgtagggagggggacaccatcctggagcttagagcagtggacagttatacaaaaagctgccagcgaactctgcagctgctctgagacccagctacctacagaatttctcctggaggctttgcattctggtcgcctcttggtccagtctgcaagagggagcattcctgccagccacaggtgtggcagcctgaccaggtgatgagacctccccaggtgttggagatgagatcccagcatgtggttctccaaggctttgagctggagctctgctcctcattggcgatgagactcagggaggtccttagctgctctgaaccttggccattcccttccataaaatggggacaacaatccatgcccttcctgcctcttcactgcattgccaagatcagcatgagatcgtgggtgggaaaattctgtttttttttttttttgagacagagtctcactctgttacgcaggctgaagtgcaatggtgcgatctcagctcactgcaacatccgcctcctgggttcaagcgattctcctgccccagcctcccaagtagctgggattacaggtgcacaccaccatgcctggctaatttttgtgtttttagtagagacggggtttcatcgttttggccaggatggtctcaaacttctgacctcaggtgatctgcctgcctcagcctttcagagtgctgggattgcaggcatgagccaccgtgcccagctggaaagttctttttaaaattgataatcagacaaaaggaattattagtaaggcagaattcctgcttcagaacagaaagaaaagaggacatggaggcccagggagattaaggaatctgctgaagcccacccaactgggtagaagcagggctgggaggctcgggccagggccagggccagcttcatggagtgatggcctttccaagctggaagggaccacagttcctgcctcaccccccacctttacatgggaacactggagacagggagcagagggccttctggtcagcatctgcctcacccggcttctccctgggaaatcttggggtcttttgctggccatatccttcccctgccatgggctagaggactctgggcagcggagggaagctgttgttaagtagaagctccaggagtgcctcagcgcaccacccagttccctgaaaccagcaggcagggctttctttcctctttccccagatgctcttaggaagatcaacttctgagcacttttgggcctgagaggaatggctggcactcagcatgggaagtgcccccactctgaagggtggcattcctgagggttgggttggatgcagggtagaagaagtccctagatattatcagctgatgtgatagtccaccccagctcaaggcctgctttcgctgcttctggaacagcttctcccaaacattgtttttgctggccccttcttaccgttcatgccttagcttgtgtgttgccctttctaagaggccttttctgatcacctcaagtatgacctctccctttatgaccttggtgacattttcacaagttgtaattacagttgtccctcagtatccaccaaggatttgttccaggaccccacagataccaaagtccaaagatgctcaagtccttgacacaaaatggggtagtatttaatataacctatacacatccttccatgtactttaaatcatctttagattacttataatatctaatacaatgtaagttctgtataaatagttgttaaactgtattgtttagggaataatggcaggaaaagaaatctgtacatatgtagtacagatgaattttttttttttttttttttgagacaaggtctgccctgtcgcccaggctggagtgcagtggcacaatcattgcttactgtagcctcaagctcctgggcttcagcaatcctcccaccttatcctcccaagtagctgggactacaagcgcacaccaccacacccaattaatttttttttaaaacttttggtagagactgggtctcactgtgtttcccaggcttgtctggaactcctgggcgcaaatgatcctcctgccttggcctcccaaaatgctggtttacagatgggagccactgtgaccagcctaaaatattttttcaaatattttccatcctctgttggtggactccatggttgtagaaaccatggatagggagggctgtatattatttctttaattgtttatttgtataaataacaaatattattgtctttgcccctaacctgagagcatgggcttagtctgtctcatttacctctttatttccaatgcctaggactgtctctgacacagagcaggtgctcaataaatagttattttattttgtttttttttcgaggctgagtcttgctttgtcacccaggctgagtctggctttgtcacccaggctggggtacagtggtgcgatcctggctcactgcaacctctgcctgccaggttcaagtgattctcctgcctcggcctcctgagcagctgggattacaggcacatgccaccacgctggctaatttttgtatttttagtagagatggggtttcagcatgttggccaggctgttctcgaacacctgacctcatgatccacctgcctcggcctcccaaagtgctgggattataggcataagccactgcgcccagtcaataaatagttattaaacaaatgaattactgaatagtaatactagtgactgtttgttgaggcctgattgttgtcctccttgcttgccctcctagtagctctgaaagccaggtgatgccattatatccccatttcacaggcagcttggtactttcctgaggttgacagctgggaagtggcacagctgggattcaaaccaggcctgtccaactgcaaaatgagaaagggctggatagaaacactgtcttttttttttctgttccaagggatcagctgatgctcttagctccctggctgagttcatctaatcgcagccctttggggttataatcaaattctagtggaggcagacagagcttgtactcccctgatgagagtacccggttgtgggtggcaaccctgggcatgtaccaccatccctaccccgcccctagcacactctgctttaggggtggctctctgggtccttgaagctccctggtgcttgtgccaaagctgacctggatttgaccttatcccagaagtccttcctggcaaccagagcttaccaaggccattgcttgctaagcactatatgaggcctagatgaaaaaggcctttctaggaggggtttgtagtttagttggggagacgagactgtagtacttaacaaggttgaatagcgaagcgggacctaaatgtcagcagtgcctgggatgttgctgccctcgagtgagctgaacagtcacagattagaccaagatcatgtgctgggcagtggggctgcagagggccacatgactctgcccgtcaaagactttccaaaggaccctgagttgctgtttgggttctgttggtatgcccgtccaaccacccgttcagccttggccttgggatcagagaagagcgctgtgaggaagatgggttctgtgagccaggggaggtggggagggttcctggctccacagagaatcagcctgaggccctggccctctgggcttcccacgtgctccctcagctgctgctttgtgctgcctgcccctgggggtgacctcatcggctctgtcctgctctccacaggcctctgctgtgttgggagccactgccttcctcccctcccccaacctgtgggcccacagctcgccagctggcccttgaacccacttccctgcgcctctggctgcctcaatgtcactggggattagtgtgcatttgcggcttttggcggacactcccctcctggctgcagcctcaccctctggagcccagggatgggcttgggcctgggagccccctgaaccagggagcagccctgaccgtccgtttctctattttccctgacgtcagaaggcagagtgcttattcactttggaagcgcactcgcaggagcagaagaagagagtgtgctggtgcctgtcggagaacatcgccaagcagcaacagctggcagcatcacccccggacagcaaggtaagggccttgacagtggctgtggcctggctgcctcgtttcccctcagccagcctagacccttgagcctctgcattgagctgggggccagcctgagcttccaacttggctctgggcaatgagctcttggcaagcggggacctgtgcccgaatgtctctcccccttggcatgtcattgggtctgctgagtgggtctgacagtgctcgtgtagagcgacagagccaaattaagcgtggcccatcagttctgcactctgttcttcggtttgcctatggcaaggtttaattcgggctggcctccctgatgctgcctggcatgcgttcacctctgccattgggtagcctgtgcctgggggcagcacactggtgtttaacattggccccaggcggatgcgatagaggggatgtttgcggcagaagctgttgtatgctgtatagttccatgtgggccagagccaagtagagctgagtgtggactgctggggtctggggactggctggcaggagcaccggggaagattagagactcccaggggaggctgttctgggctgggcactgctcagcccatccagtgcctggggagaggggatgggataggagctggaccacacagccttcccctttgacactccgatgccagccacaaagtacagttatattaccccatttgtgagtcattcaggtcccttcttttgctaaaagtgctggccatttgggaattgggtctggttggctgcaaaagttgctgaggtggttgctctgctggatctgggcgaagaggagagatgaaagaaagctgcagcctgtaacttgctggccttttcacttctccctggtgcagtcagtcccctatgccatgggcagcaggcctatgcagggggcagttggggggcaggcctgctgaagcaggaggtagggaagaggcagttggcagcctcttctgagggccagaggtggacagcagctccccagctattcccgaaaggagtgaggatctgagaattacatcatcttagctgtgaacgttctcttgttttacactagctagtggcaagaataacttggatgagggaagacagtaggaaaagcacggacttctgagccaccctctaccaccaactggcagtgggaacttgggcaagtcactttgctgctctgtactttgatgtccccatcagtaacctgggacaatagtccttccctcaaagggttgttgtgagaatgaaatgagagggtgcatatacgggctatagcacagtgcctggtatgcagtaggcactcactcaaccatagctgtggggaatgcattgccccctgcccagccccaggtggtttgttgcagcactggctggttgccactgtcaggttcttctactgagcagagacctgtccccatgcctataggctgccctgccccactgatcctgggttggtcacagtcagaatccaggccgcttcctcttcattggggtggcctctgggacgtcgaatggctgaacctatgccccagttttttttcctttgggcttgtgcctccttttctgggggaaagagctctttgtgcctcgctctcagagtttgctgactctggagtgtgttagcagcagccttctcaataccttggagaatctctccatcttcaggtttgggaggccagagggtgactgaaggcaggctgtttctgaggcaggttgtggtccctgtagggctttgggcttggctggctgaccctggaacggcccaagggtttgaggcctggcttcagggccacactagaatgtatgggaatcctgagcagagcagtttggacacctcttcaaatccaaactcttcaaacgcgtgttccatggagaagctgtgtgctggacaggagaaggatgaaggagggggcccaagtgctgggacagcctcagaattacctcccgggcctaagaactgggcctggagccacactggcataccccacttgggccaccctcctaagaaggccatgatgtagctgtcttttgtcaggctggccctagaggtctcactgctcaaaattccccatccctatcaccaccatgcacatgcaaagagtcttagcaacttactccttctagacacttatggaatgctccctgagaggaattccagtaaatagattctctccagccctaggtagttctagcaatgctttagcaacctcactgacagggcccgcctggctttccagctggtccacagcattgtccacttgcgctcagttccgtcagttcctggcagcctcggggtgaccaggaacctctttaccaagggctggccactaaggtctccatctctagggcagaagaggaagggccaaacggagcccggaggctggctgcttgctcttcaggtataagggtcctgctggaccgatttgctctgagatggagtgtcgctctgtcacccaggctggggtgcagtggtgcgatctcagctcgctgcagcctctgcctcctgggttcaagcgattctcatggctcagcctcccgagtagctggtaccacaggcacatgccaccatgcctggctaatttttttatttttagtagagatggggtttcaccatgttggccaggctggtctcgaactcctgacctcaagagtagcacacctttgaatgccttttctgtgttctttctgtggatgctccaccttctgctgaacaaaggaaaacactgcctagacccccaccccacccctgcaccacccaaatgcctctctgggaaaagggggtttgtaaggcaactccccaaactcccatgctcttttcaagagtgtctgctgacacccagatgtgggggattctttaaatgtcttaaggaatgtaaagctcttcccaaattcacaaaacgtaataagtgcaatttaccttgaagatgaaatatatgcttgttgggaaggtagagggagtcaggggaagatggacttaaagaacagttgggaggtcactcccttgctgtgggaccttcagcagccgctggctgctgtggtgtcagtagtcccatctgggcactgggcccgtggctctttctatctctccaagctttgtgattttcgtgaaagctgagggccgggggccatctagtatccattttttgtagaaataaatgaactactttctctcttgtctcaacttcctactcctgttcatcacccgctccttccttttcagagctctgcccctctgttgcttcattatctgtagctggggggcgcctacctttcttcttctgcctgggaatccttgtactaaactccctgcatggggactgctgcgaggcttctaatctagaataactcagagctgggcccacctgtggccattcaggttctaagctagaagggagagacaattatatattcttttgattattcaagcaaatatacataataaatgccttctcagtgccagatactggtttagatcctttgggatcacagagatgaatgagacctggtccctgtcgctatggaattctcctaataggagagagatgaggagggcactggagtggtgatctaagcatgaaagccatgcttgcgggtcctaagaaggatccagtggggtcctggctatccaagcatcatccgtgccgtgagcctcctgctcagtacccttcatgtgcctggtgctgggctgggctccaggaagccttctgagaagcatggaaaccaagcctttaggatgagaagggcagacacagtgcagtggggcctggccccattctcagggcaggtcctgtgctccacggggagggacgcacagagcaatccatcaccccctttcctcgggagatcacagtctggtggcagagacagacatgacagatagttcaaagtaacacagtaagcaatgtgacctcaggtgagccagttagcctctctgagactcagtttttgcatcagtaaagtggatggattaagaggcttcttgtgaggattgaactcaggatgtgctttgcaaagtggcatgcaagaggagctctgaactagccgctatcgttctcactgtcatggttttaaagtgctgtccatatgggaagattcatcgggggccttgttcattgaagctgctgctggtgctcggagcacatatgacaactgctccatgtcacttcctggtagacatctgccatattccaggggcccaggcagggaaactgaggcctccttgtctgctctggctctaagacttctcccagatgtgacggtgaggtgcgtgccaccttgtcatctccactggggccactagagacagccctggagatgccagggtgtgtgagtgccttagaaaggaacagaggcaggtcctgcagtcaggcagcccggcctgagtagacagcgagctaattccagttctgtctggttccacagaaactccaccctttcggctctctccagcaggagatggggccggtcaactcaaccaatgccacccaggatagaagctttacctcaccaggacagactctgattggctgagcaaacccaagggcgggactctgcttctggcaacttaaccctttcttgggcatcccctaccacacagtaacctcacctcaactggacctgaaacagaggaccaagatggtgggtctagggtcatctgaagggagtggtcccaagggtgcatgtggatgtcaacagaaggaccacaatggtgtgagaggccttgtgggcatgcagagactggcagcagaaagtcccaagaggagaggactcagaggcttcttccttccaaggaggaggaggaggaggacattccacatctgggcttccagtggtggctcccggacctgccttgggggcagcaggagaggttgggagaggtcaccctgatgaagaacaatgccatgatctgctgctgccagaggacatctccgcccatccactcattttccacctgtacacattggctcattcattcgatggatatttcgggtgcatctactttatgccaggctctatgctaggagctggggatactgtggagaaaaagtcggatatggtctcgctctcatcaagatttcagtctagctgggagtgagcgttaaataagtcaataccaacacacacacgtgcacacacgtgatggcaagctgtgatcatctatgaaagaaaaaacacagatttctttaagagggaattgtacttagagtgctgtgtgtgggggtggggatggggaaggacataacttttaaaccgagacttgtgggctggagaggaaggagccagtcctggacttggggaagagtgttcgcggtggatggaatagcacgtggagagtccctgagatgggaaggagctcagtgggctggaggaatggcgagcaggccagtgtggctggagcttagtgaggtgcaagacacagtgggtgaggtagttgatgtcttgttgatttcattctagatacactggagagccattgaaggcttttgaggaagggagttgcaagtacatttttacaagatccgtttacacataggaggggcccaagtgggtgtgagatcagttagggggctcgttcagttctctaggtgaggactgtcctggtggcttgtcctggatggtggctggggaagtggatgcctgaatgccaggctctggagaagagatgactccctgccccatccccctgcctaccctcctcctcaatggcccctctctcagtggatgtgagtgaggattaggaccttccccacagagccaccttttggccaggcctcgtgggggatagtgggggcagtgctgagttctaggagtgttcctggaagttgggggcagtgagtgctcagcctggcccaggtgggagagttcactgctgcccaggccttagcaggggctgctgtgctgtctttctgtcccatgctgagcattgtgataggaagctgccacacagtgccctggaaactgacttcgcatgctttccatggggcttccgagggccagggactgggctgggggtggcctagcagctctagtggagactgtgctgccgcagggctgaaggaagaccaaccaaggggacagccgtttgagcccagcccactcactgcctgctgcacctccagctggagcccagggttgggcagctctcatactcttatctaactgccagacctagagggagggaagcccaaggctgcaggtctgagggacacggctcatgggcaaaagggtatcaagaggattagagtcacttgcataggaaaagagggtcagagaggctgagggctggctgaggccagagaggttccctgaccttggacattctttgtgttgtgtaagacctcggcatctttagagaaaggttcttgtgcccctgtgagcttgctcagctgctatggccacttgaaccccaaaaatggtggcctagaagagaatacaccccttacttcccacttatcctcctctcaacctaggaaagatcagacatattgactcaacagtctaacaggggatgggctggatctgcccgtgaccagaccaatgccccccacccagcaagggagtaaacgctgcctgaagtgggaccagtgatacacagcatctctgtctgccagggctcagcccgcgggggggatttgtgagaggctgagcagctgggtctgcacagacagcaagctgcactttgatttcatttgattcccttacaaaatgacattaaggggaatgtgaggcacaggagactcgcctgtctgggaaggcagcaagctcatctctcctggacctggtgacctacctctgtctaccagacaggtgcagaggacaggagctctggccacaaagaaatggacagtctgaatgcagcacacagccctggggacaggacttttcacccagcctgtcctgacaagctgctgagtcgagcagatgctcacatcagggtcccaggtccggctgttagggaagtggacatcagttcctggtgggccctgggcagtgactgtggtgagccacagcaccattgctgctctgcctctcaaatcgatcgaacaattaatttggctccacaggctcgagaagatgaaacatgacctgatggccactgctgtccagcatcccagtccatcctagctgtccaggatgatgaacaagctatggaaattgcacttgagagctataatcacgggaagcattgccgagcccctccctgctacataaatcatgctaagaagcacacaatggcctctttcctgatgggctaattgtcttggtttggtgtctcaggcccaggagctgggaagatgggagcacaaccatttattgttggaaagaccatctgtgcaacttgaatacaaagtgattcttttagttccccacacacccccgaccctctgatcccattttcatgttttttttttttttttctttttatgtctcaggctctggttcttttaaaactcttcatctatcctgtaagccatcaggcctggatctctgctggcctgggtcttttggctatttgggggttgggacattgcagaccttttggaaataatgacatttatttatatatgtcttatatttttattctttatttttccccataaattctattaccaaagtcctcatttgtcacacatggcaccaaggcaccaagagggtttttgcaaagtgaaaatgcaggcaattttgcaacgtggaagggctccccacagcgaaagtcccacagtgagagcctaaactttggagatggcaactggggtccccaggcatgatctccccccagcctcccagcagccttgttttatggatgaaagacaccaaggctctgagaagttaagtgttttatcctaggtcacacagctggtaagggccaagcttgccctcaagccaaggcctttgaacctaatctaccactcatttctgataaaaaggtttgtcttttagggatagaagtaagagaaatcaataatctccaggaagaggcaagagagggatatccggcatgtcagaagctgtggcccatcaagctgtagagggaatgcttttaggataaataaaatgagatgccttattttccacccagtggagaataaacttccagaatgcattttcctgagggtggcacaggctgaaaagatcaatagcttcccacaagatttgaaaaaagcctaaaatgagagatcagtttgagctccttaagacaggttctcagggagctctggaatggttaggttacaccccttccccttttgaatttggcatcaaaaggatcagcagacagagtcatggagtgcttggcagtgatggaatattagccaaaggcagagaggtatagcttcaggctcaggctggcttgtgcccagcgtaagtactggaaggaggcctttgacctgagaccagctgagggcacagagagggcctgcccatgtggaacctgccaggttttgtgcgcagattttgctaattgactgatttagtatctcagccctgaataaaggggaatcaaatggatctgatttcagccatctcccctaagagatgcagactcttctccctaaaaactgtttccaggcagccaccagctctcctccccattccttgctgctgtcctatcagtggacagactgccttcttcgctgtcttgctcttggtctcagccatcttgctattgttttttttagcccctgaagaagacagtgcaaccttaccctctatcctgtcttcgccttctcttcctcgaagactttctctgaatagggccatccatcctccaaactgttcccagatccttggttttaaaggtagaatgataacataaggtaacctggtgggcacttacaagatgagccaggcacagggtcaagctttttacctaccctgtctcatctaatcctcatgcagacttacaaggtgtgttacccctgttatacatttactctcattatgcccaatttagatatgaagacgctgagtctcagagaagttaagaaacgtgcccaaggtcacacagctagtgggtagctaggattgaaacttggacagcccagctccagggtacctgcttttgattattttgctatatggctttcctgtaactgcagaccatccaagctggaagggccagggagactggactgtcacactcctgcttaaagaccattgtgggaggccactgtcttcagagtaaagcttggctttccaggctctccttggtagcactacactcctgctttgcacctggagcccggccacaccataaattttccccttctctaaactcactgtgcacattcacagttagggtgtttgatctgcctgacgttgactgccctccttggctgtccctgctggatgcaatcctcaaccttcaaggcttagtggctcctctgagaacacctttctcaggcatgcatcaggagtcctgacttcccccttcgtggttcccagagtactttttcccccttagcacaattcatccttagcatctggatgactgtgagcttcttcggagcaagtagatgttatattttatttgtctttgattctattgttgtccggtccgtagtaggtgctcagtagaggttgtaggattgaattaggctgtccagttcaactctcctatattctagaatttagacaaggaaacaggtgcaaaaagagaagtgacctggccagggtcatgggaaaagttagtgtcagagccaggactagagctcaggtctcctgattctttggattcagagctttttctgttgcacctcagctttgtggagaccagagcatggatctgcacttggtttatgaaggtctgaccaggttcacttcagggtcatggataccactgtgttcccatgctgacactggggaattcccagagggaaaggaagcccagctggagctgctgctgtaggttgcggggctcacctctcaccgagccccttgcttacagagaaaaccagcgagtgattctgaaaatcttgcctcgagtcctcattttgctggtattcaccgtgtgaccttgagcaaattgcttcacatctctgatcttctgttcctttaccaagaaaaatgagggagttgaattcagatggtctccaggagtcatctgattccagaatatcaggatataacaataaagatgaggataaagtagctactcccctcagaaaaggtggagatccagatctagggggagaattggctaggttcttcatcacagtcactgtcttgagacacataggtggtccatggaaacatttccatgagggatttcagaggggagaatgggcagactgcaaagcctcggtactctaataccaggcaaaaagaagaaagggaacaggcattttagttttcacattgaaacagagtgtatgtgtatggccctatgcaaatgttgttcctggtgaatattcatcaatgtactcatcacacataggtatatttagacagaaaggggtcctcatcacagacacccaaattatgagcacattactgcctcctctcccctagaggtgcttcttccagcctcccccattggaggccagcacaagacgggctctccaacccaatatcttccccttccctccttcctttctgctcaggtggctgagtatacacattgaactcttttgtttcaacttcacgtgtatataggttggtgcaaaagtaactgtggtgttttccattaaaagcaatgtcaagaaccgcaattactttggcaccaacctaatatgtatgcaagtacattctttaacctttccaactcccagtccaagccatcaggctaatttccgcgtggaatttgtggtcactggtttgcagtcctttcatttctggtgtggtcagaagtctccttcagactcttcccgataagttgccattggctttttcatcacctttagtacctacccacttttgctgggataacactacccaagataaattcaaaaaaattgtcctaagtgttagtgtgtttctgttttggttgaagtctattattgctatatggttttctactgtttctacttgatggaagactattaagggttaagtaggctggcctaggaagctgaccaccatttataacatacttttgagtgggaaaatgcattcagaggcctgtaatcaatacttaggtggactttgggaatatagtatttattttatgagtgactagaatattggtagaaccatagaaactttgaatgtggagctggaaagcctcctccttcccccactgagatcaattgattaacaagctaggttgtagaaaccaagtgaaagaggcaaaaacttggccaagggcatgtagtcggggacttctgaagattctgctgggctgggggcaggaaaggggtcacagacggtcttagggttgtctcactcagcaactcactgtgttggccttgggaaatgtaagtcactgtgttgggctgtaatggaaatattgagaaagcagctcagctagtggcgtggggagaggttgtctagtcctctggcttatctgtaaattcctggcatgtgcttgttggagcagaatgaatggggctgctgtgttttacctgcagctaggagcatggctggagtggtggagacactccctgtggtctgttctaaaaatagcagtgggaacagagctgaggggaagaggagggggctccttcgggagctgggtggggaggcctcacccccttcctcttcctgccaggcccgatgtgaggaagtcccatggagtcacataattccatctgggagagtcctggagccatcagccctcacaccccctcctcatacaggcgaggaggccctggaggcccggagagcagaaagcactggctggtgtcaagcaagcccagagagaagggcccagttggcaggctgtttttccctggctgtttcagcacagtggctgcaggccttgtgctgaggtttgctgtcactgcctttgggcgcacagagactgggaactcctgggaccggatgtggtcaggcttcctgagagtcgcctggcaggcgaggagtccccagctggcccaccctgagccctgacctcagccagccggctgtccagtgccacacctcctcttgctggtgtcccctcccttgctgacttgtcctcctttctttggactgtctgcagggagggaggacaagggccagcctagatctggcctgcaggacagaggcctcagtggctcaggacctttccctgcccctccccaggaacaagcagaggcagctgaggtagtagcagcctcctgcaggtttagagacagacaggccagggttcaaatcctagctcttcctctcactagccatgggattactgatgggtcacagagcatctgtaaaatgagacaagaacgctgatttcactggggtcttgtgaagatcaaaggggatctgttgtaatgcctggcatgcagtaggtacttaatagtagctcttgttgcaaaaccaagcagtgaacatgtatctgactttctataacccccttccttggggcctccactcatgaggcatgggaaggtgttttttttctttgtttgtttgtttgtttgaatgcagttgactttttttttgttgtattgttgcaaaagtaatccatgtgattgatgtttattatgaagaaaacatttaatacagatgaaccaggagaagaaaatgaagttcatccttaatcccagcacccagagataaaccactgttaacattttggaatgtgtcctgtcaggcattcgtttatacacacatatatcttatttgcaaattggggttactggtgcaatttttctaacctgctttttctcccccatttaacagcgtagtgtatccatgtttccatttcaataaatattcttctacaacatcattttcagtgcctgtggagtatttcattgtgtagatgaaacgtgctttatttaagtaatcttcagttgtttatcattcaggttgcttgcaatttttctttgttacaaaaatttcagataaaaatccttgtacaggaggctgagatgggagatggcttgagcctgagtttgaggttacagtgagctatgattgcaccactgcactccagcagtgagaccctgtctctgaatgaaaaaaaaatcctcttaggtgtatcttggcatgcccagcatccagttcaacacctagtacgcattcgactctaaataaatatttgttgggcgcggtggctcatgcctgtaatcccaccactttgggaggccaaggtgggtggatcgctgaggtcaggagttcgagaccagtctagccaacatggtgaaaccctgtctctaccaaaaaatacaaaattagccaggcatggtggcgcatgcctgtagtcccagctactggggaggctgaggtgggagaatcgcttgaacttgggacgtggaggttgcagtgagctgagattgtgtcaactgcattccagcctgggcaacagagtgaaacttcatctcaaaaaggaactaaataaacaaatatttgttgaatgaatgaatgttttgttagaataaatgcctgttagtagagtttctgggtcaaaggttatatatttataaaatggattattgatcctattgccaaattaccctgcagaatggttgtactgatttctaatctcatctgaattgactagctcatcctactttgcctgggacttttccctttttagcattgaaaatcttgcttgccaggaaactcctcaatcaaatcaagtaaaccgagatagtctggataagaaaatgtttattcctcctcatcattaccaacatggtatattgttacatttttaaataggttctttttttcgttattagagatgttgaatatttatttatatgccttctggtcacttgtgttgcctcttttgggaatagcctgttcaagtcttttgctcatttttctattgggatttttatagtttaattattaattcacaaagagctctttatataataaggatatttgtgtgttagccttttatttttattatttctttaaactacagatgtttctgacttattagtcatatctatcatttgttttagagtagttttattgagatttaattcaaatatcatacaattcacccatttaaagtacacaattcagtaatttttagtgtattcacacacttgtgtaaccatcaccacaatcaattttagaatattttcattatctcaaaaagaaatcatactacttagctatcatccattatttcccccatctcctccaaccctaagcgaccactagttcatacttttcatctctgtagatttgcctatattggacatttcatataaagggaattatataatatttggacttttgtgactggcttctttcatttagtctaatgttttcaggatcatccatgttgtagcatgtatcagcaactaattccttttcatggctgaataatattctgttgtatggaatatcacattttgtttaaccgttcatcagttaatggacatttgggttgtttacaccttttggctattctgtgtaatgctgctatacatatatgtgtgcaagttttttgtatggacatatatttttctcttaggtgtacacctaggagtggaatagctgggccaaatggtaactcatgtttaactttttgagaaactaccagactgttgtccaaagtggatgtactgctgggcgtggtggctcatgtctgtaatcccagaactttgggaggctgaggtgggccgattgcttgagtccagagttcaagaccagcctgggcaacatggtgaaaacctgtctctactaacaacaacaacaacaacaaaaattagctgggtgtggtggcaggcacttgtagtaccagttactcaggaggctgaggcaggagaattgcttgaacctgggaggtggaggttgcacggagctaagatcatgccactgcactccagtctgggcaacagagtgagactctgtctcaaaaaataaaataaataaataaacaaagtggctgtagcattctactttcctaccatcagtatatgagggttccaatttctttaaatcctcactaactctattttttcattttaaaaaattatagccattctagtgggagtgaagtagtatctcattatggtttttattgcattttcttaatgactataaatcttgaaaaatattattgcctttggcgtatgatattcactctaggattatataatattcacttttttcccttttaattttatggtttattttttaactcttaatattttaatcaattgggaatttacttttgcatatagtatgaggcagattacttttcatttttcccaaatagttatttgctccaattcttatgcattatattaggacaagtaccctcttattagttttctttaaaaattatttcccccctcttctcatacatttatttatttatttatttttttgagacggagtctcactctgtcgcccaggctggagtgcagtggagtgatctcggctcattgcaagacccgcctcccgggttcacgccattctcctgcctcagcctccagagtagctgggactacaggtgcccaccaccacgcccggctaattttttgtatttttttagtagagacggggtttcaatgtgttagccaggatggtctccatctcctgacctcgtaatccgtccgactcggcctcccaaagtatttattcttttaaatgaaattcagtgtactttttaattgtagctttataattcagtccttatcttctccctgcccctcccaaaaatatcgttgagacttttattgtaattatatttcaaactatacatttaaaaggggagtattaaaatctatacaatacggtcttctcatttgagaacaggatgtgtctcctcatttatgcaaattttaagatttcccaaagttttagaaagaatttcatataggtcttgcacattttttgttaaatttatttgagggaatttaaagttttaatttatattacaaatgaaaatatttatttggcattatatttggttttttaactggtaatatacatgcacaaaacttgtaccaaaaaattctaaacattactaaactgaataaaataaaacccccattccccaagcccatttccaatcaataattactaatatatgtttgatgtggttcctccaaattttcccccatgcacatatgtagacatatgctatgttttgttttactaaataatatcatattatacatacatttttgtaactcatctataaagatataggccaggaatggtggctcacacctgtaatcacagcactttgggaggctgaggtgggatgatcacttgagtccaggagttgaagacaagcctaggcaatatagtgagaccccatcgctacaaaaaataaaaaaaattatccaggcatggtggcatgtgcctggagtcccagctacttgggaagctgaggtgggaggatcgcttgagcctgagaggccaaggctgcagtgagctgtgatcacaccactgcactccagcctgggcaacagagggaaactctgtttaaaaaaaaaaaaaaaaaaatatatatatatatatatatatatatatatatgtatatataatattatatataaatatattatagaaatatatattatataattatagaaatattttcgtggctgggcgctatggctcccacctgtaatcccagcactttgggaggccgaggtgggcagatcacctgaggtcaggagttcgagaccagcctggccaacatggcgaaagcccatctctactaaaaaatacaaaaattagccaggtgtggtgctgggtgcctgtaatcccagctactggggagcctgaggcaggagaatcacttgaaccctggagacggaggttgcaatgagccgagattgtgccgttgcactccagcctgggcgacaagagagaaactccgtctccaaaaaaaagaaagaaatattttccatcagcacctaaacttctccctctattttgaatagccagtggaccataatgtatttaatttattgatgcatgattagattgtttctaatgttttgatattctgaacaatgttgcaataaacatcttgccgcacttttctgttaggagagagtgtggcacacactaccgaagtgctctaaaaaagctttccttctgtttacacatgtcatctccccaacactattgttcttatcctattttatagttgagaaaccaaaggaacagaggttaagtacatgtacaatttgcattcctactcacagtgaatgagagtgcctgcttccctacaccctgcataaaatggaatgttattgcttttaattctttgttggtacaagaagtgaaaaattatatttaatcttaattgacatttatttcattattagtgaggttgagattcattttgttttatttttggagatggagtcttgctctgtcacaaggctggagtgcggtggcgccatcttggctcactgcaacctccaccttctgagttcaagctattctcctgcctcagcctcctgagtaactgggactacaggcacacgccatcatacccagctacatttttgtatttttagtagagatggggtttcaccatgttggccaggctggtcttgaacttctgacctcaagtgatccactcacctcagcctcccaaagtgctgggattacaggcgtgagccactgcgtccagcctcattttatgttgatcagtcacctatatttctgctttggcttgtcagttcattcatgtcatttgcccagttttttactgaggcgttatctcatttgtaagagctctttatgtggttagactattaaccatttgcttattatatgggttataattatttttctagtttgtcatttgccttctaactttatagtatcttttatcatttagaagttaactttttttataatcaagtttttttggggggttgagagcacctatattttctaaggtctttcctacccctagattatgagaaatattcatctaaattttattcagctacttttattcttttattttttgcatttacattttaaattcatctgcaattaatttaatgcctggtgtcagatggaactcttattaattttttcccccaaatggtttgaccagtttttccaacccgatttttttgaattgtctttcctttcttcacttatcatagaccaaatttccacatatggatggtttggtttctaagctctctcatctccctctttgatctgtctattcctacatcaggttagacttaatgactttagcttcagaatatggtttagtagtaaacatcccaaggccaacccctattattctgcaaaatttcctttggagttatacaccctaattctagtctgctagtggctttacccttacctttgtcacaaacatatttcaacatcaggaatgacaccagatccatagtagcctgtcctcgtggcctctaacccataatgatcatgtcggctggaccatacttctctgctttcctccatacctcctaggtattgttataattgtctggaatttcggtttccggttgtgactattttttttttttaaagacagagtctcgctctgtcgcccaggctggagtgtagtggtgcaatctcggctcctgcaacctccatctcccaggttcaagcgattctcctacctcagccttctgagtagttgggattacaggcgcccgccaccacgcccagctaatttttgtatttttagtagagacagagtttcaccctgttggtcagggtggtctcgaactcctgacctcgtggtctgcctgccttggcctcccaaagtgctgggattacaggcgtgagccaccctggccggttgtgactatttttaaacattagcactattctgttttaagaattatttacttaaaattgcacttaactttcagttatcagtagttaaggctctaaatgtttccgttttcatggcttgcctctgtctctcacataccacgtcatctcattcttgacttctcgattttaattcacttttgtctgtagagctttcttgagtaatttttccagaaagggtctgtgggtggtatcctttcttatccttgtaagcctgaaaacatttgccctcatgtttgagtcatagtttgcttgagtagaaaattctaagtgaatcgtccttctctcccagaagcctgagagcagtgttctgtggtttccccagtatttagtgttttaagagcagtttttccttgattctctaaaatttatttatggaaacaaccaggattcctctttccaatctttggaattcagaaatttccccagatgatttctagttgtttgttttcttttggtaatttttcctggtcctaactaggtaagtcctttcagtctgaagacccaagtcttcctttcgttcagggaaattttctattaatttaggaatggtttctattctgtgtgttcaatctcctctttctggacttcctactacaaataataataataataataatggtgcctaacattaaagcgtgctttctttctgtgataatatataatcttcccagcactattgttattatcctcatttcatagatgagaaaacaaaggaaaagagagattgagcagattatacaaggtcgcataattaggaggtgcaggccaggttctaatcccaagcacctggctccagagcccgtgtccttagctgctaaactatactccctgcctgtcgggtcccaaccccagagcccaccctgcccttccccccagcactctgtagtgacaatgttgagtgtcgacaggcagggactctgtaatcagtgggggaaagcttggggatgctaggatgatggatctgaaacagactgggctactgaggccagagaggggcagggattgtcagaggttctccagtgaatttagagttgggactcttccctccctcctcttcccttggtctcagccacctgcttcaggcctcctctttgtccctgggactgctgcattgcttcttgtgggtctccctcttcctactcctgtccatgtagtcacctctgtcaacagcagctgcgatgactcttcttatagaacacacgcagtcaccttcacactgctgagtgtttgttgaatgactgtatgagtgagcaaagaagtttacagtgcctaatgtgtgtcaaacactgtgctaagtactgttgatgcagtatgcattagtcagcaatctaccaattgcaagtgacaaatacccagcttccaggagtaaatggaatttactgggttagggagggtagccttcaggcctagttggattcagagccttgagcaatgtcactgagaaggcctcagcctcttcatttcttggttctatttacttaggtgttggctcactcccttagtggtagcagtgctgctgccagaagggccagggttatggccatggccttggagttggactccctcaatcatttcatcaatagtccctgggcctgatcctcattggcccaagtaggatcacgtgcccattccagccactgaggacagtgggatgggttaaactaatggactgaggcctgggccatatgcctctccctggagtgggagatgggttggttccttgtgaatcacctggcttgagaatgagagagggaaggctagttcctcaagtgaatggggtctggtcaggcagatctcagatgtcgtctacttctcggctcatcaaccagcatggtcctcaccccacagagctgacagtctaatgtggggtccagtgtggggcaaggacaccaatcatgaacagcatatgaaaaatcgatgacagttgtgccaaagggcctaatgagagcgcctactgggaggacctggggaaagtttctgaggcaggggaggcttgggatgtaaggattgttctaggtggggaccctaacgcaggccagcataggtgggaagacgaggaaggggaacagagcatgagatgaggctgaggtgtgttcaggatcagacagtgctggtcttgagaagctgtgggaagaagtgtgactttatcctgagtgcaggggttgatgggtgttgtagaaagctgatgctggcctcatagagaatggtgaggaggaaggcaagtcgagaggcagggagcagtgtggagctattggcctcggccagggagagccgatggttgcttggactagggctgaggcaccagggattgagagaggtgagagatccacaggatgtatagcaggaggggtctgcaaaattctgtgattaattgcacggggagtgtttgggagaagaatggtgctcaaaagtctagctcaggccaggcacagtggctcacgcctgtaatcccagcactttgggaggcctaggcggtggatcacttgaggtcaggagttcgagaccagcctggccaacatggtgaagccttgtctctactaaaaatacaaaaaattagccggacgtggtggtgggcgcctgtaatcccagctacttgggaggttgaggcaggagaattgcttgaacctgggaggcggaggttgcaatgagctgagattgtgccattgcactccagcctgggcaacaagagtgaaactccttcctaaagaaaaaaaaaagtctaggtcagggaaacagatggtgccattctctgagctgggagcagtggaggggagtggtttgggtggcaggatcgagtcccactgtatgtgtaagtatcatgatagggtccaagttagtgagttctcatgaaacaaagccatttaaatcagggctccttaagctacctgtggtgaggggctttgacattttgtagcatcacactgcatgtgatttattatgcaggcttgagaacacctgagctagcccatgccctattcagtgagaccagtccactcatctcatgcttagaggtggcaatgtcaagttgaagttctttaaacacaatcaatcttgctacctatctcactgcagactggtaacaagcagcctgtgaacccatatgattttgcagaccacattttgagtggactgatctagttcaaccccagtgcattttagagacagggaaactgaggcttggaggtggtgggggggattggccttgccccagggttcgcagaaggcagcagcaaagttagcatttcagtctttcccccactgaccctttgttttgatggcttgggctcaagcccaacagtccaaacagtgggtggacccaggggagtgtgtggagaactgtttccagcaaccaaggtcacaggcctggcctccccgtagctgagtcagtggctctgtgctgaacacttcccaggaacatgggctgacaggacacagcctggccctggagctggcacaagcacagtgggtcgaggattgctcccaaaagcccgaagtctccggccagcatgtggctggttggaccggagccaggaagggagacagtcatggctcccagccatcctgagctgctacagctgcccaaggtcagactgatactgctgaggtgactgcaaggcgtgccccaggatggaggcagaagccagccagcagcaggcctctgggctagctctgtagggggacatttggtctcctggcttttgctgcgtgtgggcttctccttgctgggttgggagccaccgtttccattagcaggttgggaatcatccattgcggtctcaagttgctgagaaagaggcagatagcaagggggagacatttggggaataagagattaagggcagaatatacagttaagagcatgggcctgggagccatgctgcctgctgggcttccgccttgtaaccttttctgtacccttcagtttcctgatctgtaagctgggcatgatgagaatagcctattcatcaacaaatggtaatgattctcagctattagtacacgccaggccctcatctgttagcccctcaacaggtgttatcacatttaattttaccatttacattaaccttctcaaggtgaattctgtcttttcacagatgatagcaacaatgacatcatagcaataacaatgatggctcttatttattgagcacttactgtgtaccaggcattccacatacaccacgtcgtctagtcctcctcagggtccgttgaggcccattttacagatgaggaaactgagactcagagatagtaaagggacttgcccaggataatttacactcagattttttagacttcaaagactgtgctctctctaaattccactgactgagctgattcctttagtgagagggcctgaaggggcatgggactgtccatgggaggggaggagtagggctggggccactggacaaccacttcctggtctcattttagagatggaggactgagatcaggaaggggaacgggcttaccctgggttctgcaggccacaaaccacagctccctgtgaacttgaacctgaggatacctgctctgtcttaccccaccccaccatttgtgtcaggtgccccagaacaaggcccgtgccaccaggaagagcaagacctacaccaagcaagcaataggagaatgtgtcccctgcccaggtgctagggtcctagaggccaaaacacagcatggcagcccccgtttgcagcatcagcggcttcatctgccatgacccctccaagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaaaaaaaaaaaaaaaaaaagagtggtcgattttatgttacatacattttaccacctgaaaagcccagtgttgaggatttctatgattattctttctattattaggtaattgcacattaattgggggctttctttttttttttttttgagatggagttttgctcttgttacccagggtggagtgcagtgatgtgatctcggctcactgcaatcttcacctcccagattcaagcaattcttgtgcctcagcctcccaagtagctgggattagaggcacatgccaccatgcccagctacttttttgtatttttagtagagacgaggtttcaccatgttggccaggctggtctcaaactcctgacctcaagttatccccctgcctccacctcccaaagtgctgggattacaggtgtgagccactgtgcctggcctcttctcttcccttctcttcttttctttttctttctttcctttccttttcttttctttcttctccccctctttctgtctctctctctctctctgtctctctctttcacggggtcttgctctgtcacccagctgggagtgcagtggcacaattatcacggctcattgcagcctcaacctcctgggctcaagcgatcctcccacttcagcctcttgagtagctgggatcacaggcacacagcaccatgcccagctaatttttaattttttttttttttttgtagagatggagtcttcctatgttgcccaggctggtcttgacctcctgggctcaaatgatcctcccacctcagcctcccaaagtgctgaattacatgctcgtgatggggtcttgggagcataaacccatgaggtgcattggtcttcacgcaatggaagcagtaaaggaagacagcggaaatctcactgtggtgtgggctgtaggggagcagcctgtctctggcacctggctgcatcccaggctgttgctgcatcccccctggggcctgtctaaagacttgggctctgcttgggggtactgtattccaaaaataggaggtgggtccctgctgaacctcgctggtcctagccctgggagctgctgccaacctgtctgaacagtgtggagtttgcctgtgtggttgggctgtacagttctctgtgtaactgatgggctcatctgttccatgggctgccctgcgccatggtgcaggacacagtggaaagtgaagtgggcttcatctgtagccctgaacttactagagtgtgaccttagtctctctatgcctctgcttacacatccataaaatggggatattagaaatcatatctgaggctgggcacgtggctcttgcccgtaatcccagcactttgggaggctgagacgggcagattgcttgaggccaggagttcaagatcagcctggccaacatggtgaaaccccacctctactaaaaatgcaaaaaatcagctgggtgtggtggcgcacgcctgtagtcccagctactagggaggctgtggcatgagaattgcctgaatccaggaggcagaggttgcagtgagccaagatcgtgccactgcactccagcctgggtgacagagcaagactctgtctcaaaaaaaaaaaaaaaaaaagaaatcatatctgatagggctatgaggattcaatcaatcagtccatcaatcagtaatcagaaagtgcttagagcagtgctgtcatgtgtcagataagtgtttgttatgtatgaaatatgtggatcagtgattggggcccagttcctgagtacccgggtgctgacccctgggcctgtgggccacctagatcttaccactctctagatcccagtttctcctgtactgaacagcaccatcatttatgtacctctgagaagcactgggatgtggtgaacagagcactggactgggagttagcaatcccagccctgccactcagttgctgtgtttccttgggaaagttactttccctctctgggcctcagtttcactgactgtaaatgggaaacaacagtgaaagatctccaagggccctctggcttagaaagcctggctgccagtgactcccctatcctgccctaggctatacactgggaggccccccagccctgttgatttgtgtctggagctatgggaggcagagggcagtggctgccccagggctcctccagccatgggatgctctcctatcctggcctggcaggctctgggccttggggcactgagctgctctaccctttcctcaccatgctatggtccagagcattgatgaatgtattctggactcgttctggactcagcacactgggttggcagagctgctttgcccatcacagcatagggcgtaattttggagtcattagtctcactccatggctaatgtctgcctccctcactggactgtcagctttgtgaatgcagggccctgcctattggttctctgccaatccccagggcctaacacagagcctggcacagagtctatgctctgtaactgtttgttgattgaaagaaggtgacaactcagctgaagctcgagggcacctctgacgtgaaggaatcctatattcaggctccccaccctaagaaatcttatcccacacaccagaaattccatcctagaaaccagccagcctcattggtgattgtttagctccatcagaattggccatctcttgagactcacctccttagcttcccaggccaagggtgaatcctgcttttcaggagccagcaggatgacagccttccagtctagaaggttcctaggccctgcaaggactgccttggttctgcccccagggacaagatgaaacactggttggagtttgtaagtgaccaactcagaggagggctattctgagtcgacccgataaagaatgttttcttgtagcagtgtgcatgtatatgcttgtgtatgtgagagagtcaggaatacagagtcagagatagacaggggcagggatacaggcagaaacatcccgagaccctggggggtctctaccatagggagagaaagagacagagacaccgtgcttcagcctaggtggccaaggtgggtggggtgggcatgggaaaatagaggctccttctgtccattttttctgtgccatcatcccaggatgcctgctgctctggtgggagccagccacaagttgggcattcccaacttgggcctcagggacagcccagggtgcatttgtcaacatcatgacaaactgcagcaccagagaacagctctgtgctggcacagcagcatcttgcagttgtctggctgtatggtggttaagagcgggcatggtgagtaggagcaactagttttcagtcctggctatacagacaactggctatgtgactgtgggcaacttcctttgccattctgtactttggactcttcatctgtaactggggtaatcatagtcctcccctcctcacaagctgctggtgaggattcagtgaattaatgcaggcagagctctgggaacagggcctggcacggagttcatgctcaagaaagggtagccaagagccagctcagagaatcctctattcatcccacaggtgggcaggttaaggttagcagcctccttttacagatgaagaaaccgaggctcagagaggggaaggaacttgctcagtgacacccaattaaccagtgctggagctggaactggagctggggaccctctcctcccagtccagggcttgttccactgcccccgcagttcctccttggggatgtctctgtcattcagggctgtaactctcattatagccaatattactgtaacaggatgttacagtccaaactgccctcccagctggctgtctccgggggaggaagccccaggttctctttccacataggattctgcagagtttagcattcaaagattcagctgtgtgctgggaagggactgaagctgccaccccccaccctgggggcagtcgcattctggaagtcagcgtgtgctggctgcaggagcctgggttcagttgcagcctcccactgggacaggaacagcgtcggggtgggggtgtgacagggaagcctcggtgcctcggtgattggcttggtcttgcagggagcggctgccagcaggccggctggaggcggctttgcgctgccccagcctgggagccctcaggatgtgtgtggggtggagcctgctagggatcccagtgccagggggtgccgttgtgagggatggacgcctctcccccggagcagcactttggggccagcttgggccctggggatgagccacaggggacccacagcctatgcgtgtgagcatgtaacccgggagccagctgggcccctcgcggggtgggcagaaggacgggctggcccaggaccctcttctttgagacatcccggactccatctcggatgaaagtgctttgagaaaccacagagttttctgtttaatggaagaaagaaatccagcctctctccagagtggcggtggccggctagacagggtgtgtgtttgggaaaggcgctggaggaggaggaagaggaggaggacaagtaggaggaggaggaagaggaggagggacgggtgatgcaagggttttgaaagcgctacctagatgtgggaggtggaacctggtcatttggttctgcttttcctagcaggtatcgctcccctggggaacttgggtaagtccataaatagctctgctgacacaaaggagctctgtctggggaaggcagccgcttgacacggccgccaggagctgccacagccacggccgcccgcctgcgggaggagccgggtggaaacctgggcgggcgagctggcaggagcggcagccaggagtcgcctgggtccctgctggagtatgctgggtaggtaccttggtgacaggactgtgtgtgtggtgggcgggcatccaagccaccctgtgcccctgtttctattgtttcttccccagggcagccattgataggcatgttgcaaccaaaccatttgtgctctgttctgagatagctctgtgtgtgtgtgtgtgtgtgtgtgtgtgtgtgtgtgtgtgtgtgtgtctgtctgtctgtctcaggggctgggagccctgcaagttttgggggatgcttcctctgttggctgctccccacttctaggctggacagccagcttttctttctcagagaaacaagaaatgtttggtggccaaaaagtcgggacactgcatgggaggggagcgctcagccagcagggttggctattgtatcaggggtgctggccgcacaccaggcaccagggatggaagctcgtgtctagtttcactggcaggggaagaggtggtctctggaactagtctcagcgggttgcctttggtccctgagacggcctctgctgaaacgtccactggaagcacaagcaaagatgctttgcctctgacctccaaccccatgggagagggcctgcacctgctcccttggctccagctgagacccatcaggcagggggtggtggtagagacaggctcacaccacagagctggccactgtgagcagacagaggctaattcttttcccagcctggagggtccacatctctattcttgttcccaggtgtccaggaagaacccttgaaccctaggactcagggcaggaggataaatctggacccagaaaggggaggagccttgtccaagtttgagcagcaggtctgtggctgagcagggaccaggatagagaacttctgcctcctagaacagcaagaacaggacatgtgggaaaccatttccctgacctgaactaagtattataattcagcttcaaatctgaccttcctgacctgagaggcttggtacaccaggccccacagcgatgcttgaaaactttccacatcctgctgccctcaggccttctggctgggtggctatctggcgtcctctcccagtgctagagtgggtacatctcctcaagggaaggagccgcagaggctgccctgctggtgcctgtgggatcccagccagggcactgcaggcatagtcaaagtttccaccaaggccccttgagtcctctgtgcccagccaaggggcacctcccctcttccccagccctagcacatggtgtggcttagcctagggcaggcccttcagggagccgagttccacaacagggctcactgcaagcccagactggcttctgagaagcaggcagattgtgaggatgaggcagttgaggcaagtgaccactcctcgtgagaagtctccagggctttgagccagaaattgttgatgggacttctgattataagtatgtggtatcagtgaaatcattgcacttccaggcttccttgcctttgcaaatgctgttccagctgcctggaaacccctcccctcccctcccctcccctccccctccatgtcttatttatccaaacttccacaactagagcaaatactccagccagaatgagtctgtccattggtggtggcacccatggatattgctttgtgtcctatgtatgcagaatctgggccttattcattccttagtcgcaaggacctggccaggggcctggggcatggttggagaggggcgttgcattgtcctggctagggcaggttttctttgaggacaaacagtgacatgcaagtcagctgtgtccgcccatctcctagctctgtgcctggcatagagggcctgtcggggagcccctttaggagaggcctaggctctgaatgtcaaagttgcatccatagggccaagggatggggctgggtttgataggaggtgaggcggggagaattttggcttcatcctggcggagaccatagggagaatccactcaggggtcatgctgggctaggtggaattcacagcatagcctgggccatggagggtggaggggatagccctggcttgttgaaatgcaatgctgaaggacctttgcacagactacaggggattggagctcagctccctggaccctcttgggatggtgccaaccagagtaggtctggggttattgatcctcaagccagtggtctgtgtggctccctcagaagaggcacagctgaagagagagtgcctatccccagctgggtccctgggggccttgagagctgcttcccattggcctcttaaggccctggagatggcagtctctttgccttctattaggttggtgtaaaagcaactgcggtttttgccattaagagtaatgtaaaaccgcaattacttttgcaccaaactatagatagatagatagagaactgaggcaggagaggaaggacacttgcctgaggtgacatgcgactcagcaggaaatcagggacaagaactcaggttcccctgcccaggcctctctgtactgcaccaactggatgtctcagagtatccaggtttcatcttggggctctctttctggactcaccagtgacatgtcccttttggaccttcgggctcactgactagagccctgctatcctctgggaaaagcagcatgtgcaatagacaaagccccttggtcggtgggctggagactgcggcaccttctcgtcccttcttactgatgatttcaggcaaatatgccttgtttctcacctcagtttctcctttgtagcaactagggactggaccaagtactgccaggtgccttccaaatatccagttctctgattctttgcaggccgtctcctcttcctggcttccaaaagtcaatggtcagggccagggcttggtgcagcagagaagcagcccccagcctgttccccaggcgcctctgggcaggagccttcgcatgcaagctgcagcccaagccgaagctgggaggtttgttgttgtttgtggagccaggcagtttccaagatgtcattgcttagggaaaaccatcattcctcccaggaataaacaaggctgcttatggctcagccccctaagcctggagaagctggagccactcacagcagaccagccaggctcagcctcagggagtgctgcctgcccctgcacaaccagctgtaccctggcttccaggattggagtggggatgggggcaggatggtgggaggtgtgctagagccataagcctcttgggagatcagagcttccgggcacagatgagagggaagagggtcccaggacatgctcttccttctggcagtgggcctaagtcatcactcgagatgtgtggatagctgccaggtatgctccagatggcccagggcttctcccctctccctgccctccatgggccagcccgcttgcacctggtaccgtggctcaggctgctgccggagaactgtcagcggctcccaacttagaaaggggggtgtgtatttggaactgggcatgcttttcgccacatagccagggctctctgtggtgtcctcagttacctcttactggggttagccttgggcaaatagcagagctcggggactcagggaagggtggcagagggtaagggaacaaggagagaggcagagaaaggtcttggcagtgcctctggggaccacatggctggcaggaaccttgacagcaggccgaaggcagccaggagaaggactgtggaatgggaggtggcatggctatgccacccctcaagtcaagggttggaagcaatgttcagccaggccatgaaatcttcacttctcagacctcacttcctgcagttcccagttgattcaaatagcagcagctctgtactgtcctctctgcctgtctcccttccgtgtctttccttctttccttccttccttccttccttccttccttccttccttccttccttccttccttccttccttccttccttccttccttccatgtgtgttaagcacctactgtgtgccatgtacttacaaattactagtggcatagatctaaaaggcccaatctttaatctagtgccaggatgttcaggtaatggacagtaacaacacagctttaatggagaggcatggggtggggaggggggtgctgtgggactccccagggaagcactcagttcagcctgggagcctcagcaaagcttcctacaagaggtgaagctgcatgtgattgtacagatgcttgcccattgaagagcaggtctccatcccagtctatccacccctcagaggtgtagacatgattcccgcctatccatggaaattgcttttgtgtgtccagccacatgctcctccttgtctagggaggttgtataggaatatgggctctggacttgagggaaggatctctcctaccttacagtcttgtgctcttggacaagaatggagcttctcctgccttcatgtcctcaagcagtggtctagcctcctcgagttaaatgagataatagctgtaaagcacttagacatgtttcatgtgaatggattctgtgtcctgatagcagtgggagtgccactagcgcccatctcataggtggctgttattaaatgcagcgatgtaggtgaggtgcttggcgtggatctgacactgagcaggcattcaggaggcagcgcggcagcgttttgctggagggaaacagttggaatgcgcaatcagagatgtgtacaaagcaaggagctcaccgagaagcagtgagcctcagcccagggagcagaagaggagacactgggatgaggggttttatttgtttttaaaataaaccttttaaattgaagtgcagcatacttccagaaaaattagaagaatacagccaatgaattttccacaaagcgtacccccatccaggtcaagaaatagaacattctggtaccctaggaatccccacaaataaccctcttttagttactatgacctcaaaggtaaccccgtcctgacttctttttttttttgaggcagagtctcgctctgttgcccaggctggggtgcagtgcactgcaacctccatctcccaggttcaagtgattctcctgcctcagcctcctgagtagctgggattaccggcgcgtgccaccatgcccggctaatttttgtatttttagtagagacaggtttcactatgttggcctggctggtctcgaactcctgacctcaggtgatccgccctcctcagcctcccaaagtgctgggattacaggcatgagtcactgcacccggcccttgtcctgacttctctcatcgatgagcgtagcctatccttgaattttgtgtaaatggaatcattgggtacatattatttcatgctgacttcttttgatcagcattttgatggcaagattcatcaataatattgtatcaagctttattttgtttattcttgttgctctgtggtatttccttgtatgaatataccgccacagtttatctaatctactgctgatgaacatttgtgttgtttacagtttgaggctataatgaatggtgctgctatgaatattcttgtacttatcttttgatatactatgtttgcttctgttaggtgaatacctaagttttgcaattgctgagtcatagagttgtagagagttagctttagtaaataccatgatattattttccaaagtgtgacaggaatatactccctttaagctgtacatgaaagagcctattattccatgtctgtaccaacattattggtattagatattgtgatatctaattgtggctttaatttgaatttccttgatgtctggtgaggtcgagtccctttttcatgtgttgattagccatttggatgacctcttttgaaaagtgcctgttcaagtctttcccccattttcctattggatttttttttctgattaacttgtaggagcttaaacgatattgtagatatgtgtttattgttggatgtgcacattccaaatatctcttcccactctgggatttgccttttcactctcttaagggtatatttgaagaacacaagttcttaattttaatgcagtccaatttgttaatcttttttcttttatggagagtgtttgttgagtcctgtttctctgcttattacaaggttatggacatatacttttatgtattcttttagatgttttatgtttcatatttagatctaaaatccacttgaaatagatttttatccatgtatgaagtagaggtcaagactcattttctctggataaatattcaatgtattcaaaatccatcctgtctcactatagggcaatgtcacctttgtcagaaattgaggggcaatacgtgggtgggtcacttgaattttgaagaatgagtagagcttcagcaggtggacaggggaggggaaggtgctctaggcaggacgtacagtgtgagcataggtttagaggggcctgagggtagagtgtagcagactggctggagggaaaagaggagaaacggtgtggtggagaggttggcgggggcagaacacacagggttagaggatgggactttatcctagagggatgaaggcattttgagcaggagaccaatataggcaagttggtgcagggccaagggagataagagaaagtctcatgacagagggaggcaggagggtgggtttggagaagactgtaaattcagccaaacctagccctgacatcacccccaagcagagatagggtgtgcctgcctcaggaggcagcggtgaggctgagtgtgcctgaggctcgggagggtgaccttcggccacagggttgtggcttagtctcatgtccacatgtccactccagtgtcctcgagtgaaaaagcctcttttttttactggatgggcaccccaccaccacccagtgcccccagcgctgcaggccctgaaggaggagggcagtggggcagactggggcagacagataaggcaagggtgtgtatctggaaagggggacctttctgttcctcctgcccttgatgcccccacaaggagacctggctatgccttgggccctgaactctgatctttctaggctagctgagattcagaactggacagacatgctgggaagagcaagacccagtgaggggagtgatttggcccaggccatgcagtgagccagactgacccagcctaggggcaggctgagcacagactcatctgccttctcagcttccaagtttccccccctgaaacctgcaactaacaggactcctgtcctaggctgctgtaagggtcagaatacgtcaagtgccctgtcccggaattggatgcaggagagggagctgatgatgtcgatgatcgtcatgagagtaacaattatgattacagaaattgcagatgcttattgagcacttactaggtgccaggccctatgctaagccctccccacagagctgtgatgtgggtactcagtattcacattgccattttacagatgaggaaatcgagcctgaataggttaagcagcctgtgcaggtaccttgacgtaggaggtggcagagccagggtttgaagcttgatttgcctatctccaagccccagttgttcatcagcaataggcttccctccttccacctctggctttcagtcctccctattctcagagctgttgcttggagtaaaaccttagtttttgggttggtccctggtgcccactcatgagagagtcaagctgtggagaggaaggcaaggagcagaggggcaccaccatgggctactgtgtgccaggcactgcctccatatgccccgtagcagccgtgaggaagcggcacactggctgtgagggaggcggcacatggataggaattgggattcacccccaggccctcctgcttccaaaggctgacctcatgactgcagtgctatttgtgtccttccctgaggtcatcctggcatggcagagcttctttgattaacctagcagaaaacatcacagagaagccacacgcttctagctctccccacctggaaggggaccctgggagggagaggatttgggagggtcactgggtgtacagaattctgcactgcccctcccaacaccaggtgtcagtctcctgcccctcagtctccaaccatgtggagtccgagcggggcccctgcgtctggtattgctctccactgcctagcacagagccaggcccaggtttgtcctcaggaagcatcctttgaaggaagggaaggaggaagtgaagacggcaggaaaggagatcacagaggagtagaaagagcagggctttggagtcaggcagaccatggtttcaattctgactcttccactgacttgctttttgatcttgtgtaagttacttaatgtctctaactcctagttttcttattaaaaatgatactgatctcataggattgttggaagtagagcctaaagtataaaacaactgtcacagtgtgtggcatgcagtagatgctcagttaatgatctctctctctcccctatctttgtcatcattatctgttttgaacacctctagcttcaccttccttacctctgcagcgctaagtaaacattgctttcagggtaacgttggaattccttaaaatatccatgctcctgcctcatccaaccacctccacttccttgaatgttccctgctggctctggctcagcctggaatatcctgtcccatcttttcccccctattacctcctcccagagccatcctagttgtccctgctgcctctacttccacagcctcctagcatggtagcaggtgggtgagagatggacctggcatctccaaggcagagaacatggcttgttgctgtttggcagcaatagccaacacaggccctggcgcatggctgcagctctgtaggtatttgctgagtaagtcttgggggaaatggtgtgaataagccagacatgatcctgatgagccaaacaggacctgcccggggccatgacagcagggcaggctgggtcttggcaggggagcagagagccttctagccagggcatccgaggcagattgaaccagtgctcacagggatgggcaggaagtagacttgagggatagagagcttagggaaatgagaggtcccagtacacacacacggagcaggcagaaaagcagggtgccgggtgggaaggggagtgaggatggatcccacaggcagactggttcctcagcagagccccagggggcctggagttccccttctcacaaggcatcagtcaccactagctcaggaagaagctaggaacccccctgctctcaactctcaactccctgcttttcagagaagagagctggaggagtagaaggggtgtttggggtggtgggtggggacaaagactacgagtccacccatgttgaagcagtggtgtcagaaatggaggcgagaggagaagggacctggtgagggggtgacagggcagcaccgtgctgaaacccagaccccgggagccgcctccccgccctgggagaagctgggcatccaggcaggtggtggtgggtctccagcaggctgcaagcggcatgtccttctggcttggtcaggcgatagccaagagtaggaaggttttctgagggggccctcgtgtctcctctttcctcagggattccctttctgtgagtgttggctttgtcctgagagtccctgcgcgggggtgagctaaccttctgtgcctcagtattgctttctgtagagtgggtgcactccctgctgtggtgtgccgccctcctgagcctctgacagaggagcttcagtctgtggtcgaattcttcctttgcccctctctcctcctgcagtggggcctctgtttagggaacgtgaatgggcagctgcctccagggaacttgccacctcccccgtcctgctccaaggtcatgcctcttctgcacaggctccccactatagagagggttctatgtgttggaactggtcctgggcgaggttctgggctggattttagtgctgattctgttgtatgaccttggccttatcacttcccttctctgggcctcacgtaacagacagtcaccttgcctgttacctgacgccactctccagaattgtctcgtcagtcagaaagaagtaaaaaggcctgggccttactcctagggactgtgatgcagtaggtcttagattgggtccagacaggcatttttaagatactcctcaggtgattctaaagtgtacttctccgttaagaaccaatagtctaggtcggtgtttttcaaactttaatgtgcaaatgaatctcctgggatcctattaaagtgcaggttccgatccagtgggtgtgaattgaggtttacgaatgtgtattttatgaggtcaggagatcgagaccatcctggctaacatggtgaaaccccgtctctactaaaaatacaaaaaattagccgggcgtggtggcaggtgcctgtagtcccagctactggggggctgaggcaggagaatggcgtgaacccgggaggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccacttaatagatgtgttaagttgaacaaatcctttaacttttcagagcctcaattttcctctttgtaaaatacagataataacatggacactataagggttttgttgttgttgttgttgttttgagacggagtcttgctctgttgcccaggctggagtgcagtgcctcgatcttggctcactgcaacctctgcctcctgggttcaagcgattctcctgcctcagctttcagagtagctgggactacaggcgcgcgccaccatgcctggctaatttttgcatttttggtagagacggggtttcaccatattggccaggctggtctcaaactcctgatctcagatgatctgcccttcttggcctcccaaagtgctgggattacaggcgtgagccaccgcacccagcgattgttctttcattcatttattcattcaaacacttcaggtggggagtggtcagacgtgaggctacagggagacagagcccagggtcttccagggctacagaatttggactttatctgagaggtattggggagccagccacagcaacgttttaagcagaggagtgacaagttgaggtttgcatggaggcagctcccctgacatagcacagagaatggccagtggggtctgcaccgccactgtgagccccacatcatcctggtgggggatgacagtggtctagagggaagtggcagcagtggacatggagagagtagaaacattctttttaaaaaagattaatcaactttttaattttttgattttttacttttgagacagagtctcactctattgcccaggctggagtgcagtggtgcaatctcggctcactgcaacctccgcttcctggattcaagcaattctcctgcctcagactcccaagtagctgggattacaggtgcgcgccatgttgcctggctaattctcgtatttttagtagagacagggttttaccatattggccaggctggtctcgaactcctgacctgaggtgatccacccgtcttgacctcccaaagtgctgggattacaggcttgagccaccgtgcctggcctcaacttttattttttagaaattagctttagaaattagtgcaaagtacagagagttccaatatactttgtcctacttattgccaacctccctagtaaaaagatccttgaagttgtataagtgatgatcaggatttgaggattgaccatgggggtggtcacgaaggaaaaggagaaaatgatggccaattccctggtttgggcaactggtggtggcttcattgatacagggaccattagaggaggaatgatggacttgcggggagatcacacattcagtgtagggcttgtagagttgggggtactgatgggatatgcagaaggaggtctccatccatgtccctgggatgcagccacacagctgtcctctgtgtcagcagcatgctaaggctcttcctggcccggggctttggcctatgctgcttcctcccctagtgagccccgccctgccccttgagcagatttcggtctccagccattccacagggcggccttcccaacactcccctggactctctcacagcacccgagggttttccttcacactgcagatcttggtttctgtttatcctgtgtttatggcagtgatgacttggtcaatatccctccttcctctctagttcgtaggctccacaaggacaaggatcatgtctttcttattccttcctttatgcacagagcctagaacagtgtctggatgcagaactattccatgaggatttgttgaatacttgcctgtggcatctcaactcaggaaagcggtcagggctggcagagtggactgcgagtcatcagtggccagatggtgcagatagcgattgtggcctggggagtgggtgggttcccaagggagtggacaggactgtgatgagaggggccctgcagcaggtcctgatggacaggcagacaggcccatgagagggtggagaaggggtgaaattcagggagggagatgttaaggccacgctgtgctggagtgaccatggctatcgtttattgagtgctcatgggtgccctcatggtgctgagctctggatactcattagctcatttattcctctaacaacattgtgaggagattctagaaatcctatgttatggctaaggaaactgaggcacagaaaggttaagccaaaggtcacccagcaagtaagtgtgaagttagtatctggagctccccctaatgtaagtaccgcctccatcctcctgaattttgccaaacctgctgtgttggagacagtggaggtagaggggagaggagtatggcctggagggtctctgagctggtggcggaggaaggactgggggtgtcagcctctgggtggtcaagaggccagacctggaggagctgggctgacgctgagccaggagagctaagtgttagctgagccatcaaggttcctggaagctagcattgagtcagggacctgaggctagggatccagagcatgccaagcttgaaggaacagcccatcttgaaagcctgggggtccaaggcagggcaggaattctaacagcctctccctttctcaaaggactttacagttcacagagtgccttcctgccctttctcacttggtccccttaggtctctggcacaggaagcagcaggcatcctcacccactttcatggcagagaaaaccaagcttggagtggggtagcttgggatcacacagctagcaaatgatggagtgaagattccagtccaggtcttctggctgcatgtccagtgctctgtcagtaaaatcctggctgttaagggccaccctgagacagaggcaaaccccagtttacacccccccagtgcaggaagtggttttcgagggcagatgcagagcccggcatccgtggtggctgtgatgaatcatcggagtgagagctgcaggttgtccctgggtcagcaaacctggctgctcagtgagtagctgtgtgatgttggacaagtcactttcagcagcccaccactaccctcaacccaacatccggtgggcatctggggcccaggagccaaagctggtatgagtgtgaactctgggtgtcatagctgccatccctccttagcctattctgagctctggattggatttgggagaggatttgattaggtcctaaacagtgactccatttagagggcctggttcatttcctgtgtgcttacagcagatgagacatgggcagaattaacctggtccagccaagccaaagaagtgatggatgggaaagacacagacccccaccttgggagggtggggcagtggcttccagcactctagacccaaggccctgggtgagcaagctggtcttcctggggcgccctggctggattcttgttacttcagctgttgcaacagctgtctcactgggtccccagctgcctgtacttcctctatcagagcagtccccatgctccttcaaactagttgtctaacctctgttttttctacttaactgagggcagagattgtgtctgacttgttccctgccgtcctcctagtacctacctcagtgcttggagaatgcatgaatgtatgcgtgccccagtcctccctgccatccacacatcctgcccacattccccagagcagctttgacacagcacagctctgcctgtggcatttcgttgctcacagggcaaatcccatgcccaccatgtgttctgcaacctccccctcatctttgcctcccctcctgccctaattttctcctacacttgccaccctcccacccctgggtttctcgggtttcctataattgctccggagctcccgtcaaaccacttcccaccccagctctcccaagaacaggggccttaccaaacctgcacgcagtccctgttcatacagacctgcctgggagcacagaaagaaccatgagctctgggccctgttcgccagcatctgctgatgtgggatgcacccaggtgcggggcctcaggcagcactccaggctgttcctcctccttctacagccctctgaggtccccaaacacttgtgtgtaaggctccaaggaaacagggagagaccctgggcaggagatatgagttctaatcctgcatcagcctctcattcttaggtaattcctttaccctctgggaccccaggtttcttatctctaaaataagaccactgatagctcccattgtatcaaaagcttttccagggccaggcactgtgaggagactcaaatagtcctgtgagtccagtatgatatcactgggctcaattccagatgaggaaacggaggctctgaggtgttgagaggcttggccagagttgcacagctaaaaagtggccccattgggatcaaaatcagcctggctcgggtatctgagcacataaccactgggccctctgagaacccttccatcttggttagtttctcggctgatctctctgggtaggtgccctctgggggcagtacccctgcctgagtggcacttcccctcctggctttgtttggtttggcctcgatttagaacagggttggcagaggcaggctgacttgcatttctggttttgggtttgttgctgcactttccccaaggggtgggcgggctctgactgacagtcaccactgggacaggcctgggccccaccctcaccacccaggaaaggggaaatgcggcccgctccccactcagtgccactctgtgccactccgtgccaggccctgagggcacccggttgctgcttccttccgtctttccccaaggactatcagaggcaggtggctgggccagggggtgggtcggggggaggtctggccatgtggtagggtgataggactgaggggccccagggagctggctgcagggcagtttgtttctcctgatggagaatgctccctggtgggtggggcgatgggctggggactggtttgttcatggggacagagatcagaagtgggcttgagaagaacagggccagaaggcctggactctggccccagcctagcccctaatttgtgcagggtggctttgggcaagtcactaagtcactgtctagactgggccctcagccttcctgtctacccaatggagggtctttctgtccacctgggaacagcctgataggactgaagcacagcccttagtttccagatgagaattctggactggaggccctgacattacaattgccaacactgactctggtgtttggcaaaatttggtgtatgtgggaaacacgtgcctctggttgaggtccttaacttcagaatttccctctagatcaatgctttttaaagcactaactccaacaccaccatcttctgtaggagctttcgagctttccagcttttccagcatacgctcctgatctgttactcaggcatgctggttatcccatttcatacgtggacaccttgaggcctaaaggttggtgactggctctacctgacacctctgtgtgattctaggttgccccttgctcctctctgggcctcagcctttctgtctatgcagtggggatttcggatcgctgttgtttcagagtctgaggctatgaggtctgagagggcccttgtgtggagtcacctctgagctgcaggcaggatttccagggcaagaaggccacagcatcagcaggcacctgtctttggcctgtgagccatagcctaaggcgtgcccttcccgaccttggccagatcacgctagagtcctccaaggcctcccctcccttgcccagccaccttctctgctctgcagggctccactttcactttcacactcccaggctgtggctcttacccgtgccgagctttcacatccgctcacatctgtgctcccagatgccagcgtgacccctgacacgtgtgtgcagcagcctgcagctgccccaagccatggctgaacactgactcccagctgtggggcttcaccattacagactccccagggcttcaaagacttctcagcttcgagcatggcttttggctgtcagggcagctgtacaatagtgggtaagtcaccggcctttgggctcagttttctcatccatcaaatggacattaatgatttctacaatgagagctcttaacccatgttctgggggtacttacccctgaagttttctgccagtgtgcgcgtgtgcccgcaggtgcacacattcccaagcatctgttcagttcccgagtatgggtgaggtctttccctttcattagttctcagcagctatggcttcttgaagacagaacctgggctctaaataaatagttccagctccggcattcctggtccttgactgggaggggcccaccccagacttgagaactgcctccctgtgtggttgtggcaccatggacactcctgactttctcggggccccaatcttctggtgacatagctgctattcagactttcattaagagaaatgtttttctctttgcacatgaaatctactgtcgaaactcagcaaaaccccctaggatcccgagggttgtgtgtgaggcaggagatgctgtgttttttgaggaatccctgagcttcctccaagcagtttaaaaatccctgggtgggtgattcttcagggaggttccgtgtgtctgcgacatctggtgagtccaggtgtggacaatattttaaagttccggtttcattccagtttaatagtttcaaaaagatacttaagcgttcagagcacattcttgtttgaatgactcattaggattttttaaacttgagttcaggtagaagacaccctgggctgggttcagtgactgccctggcttggttctggtccataagcagagactgcctggttctcctttatccccagaggcaactttgaccctgtttccttttctgtaaaatggggacagtgatgcttcttttatagggttgtcgggaaggccacataagagagtggggtcaagctggcctggcacctgccaaagcaggagctagatagatagtggttatctctccctcttctcctataaatgaccagctgtgtttttgatggagcagaaagttcaagcaagaagacagggtgagaattgttacccagctaagtcaaaggggctttgggggttccatctggcacctcagctttcagactgggggcccggggttcaggccactgcctgatttcatgtcagctcatgcatggtgtctggcatcttggagcctcctcttctgaactgttcttgttttctttttgtttcccagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaaggtgagaaagctaaagggggagggagaaggatacatgcaatgtggggagggctggcccaggggctgcagggaatgagaagtcaccatgttccacccccactatcctggcagcctcccagcgaactttccacctgttggacagaagataaaactgaggcccaatgggaccaagaaggcagagcatggacttaaacacatgactttaggattccagatgctgtgttcttatagctccactggtccccacagaaagcagagcaggtgtagcttagcccaggccattgtgtatttggatttaaaagatctgagatagtagctggagaaatagagttacagcctagccagactagaaatccatcagccagtcacaatgacaacacacatttattccgtgtccacattatcctaagcagtttacattaactcattaactctcacaacagccctttgaagtagatagtatttttgtgcccattttacagcagaggaaaccgaggcaaagagaggttatctaacttgctccaggttacacagtgtatcagtgtctgaactagaattagaatctggttccagggccagtgctcttaaccaaccaccacaccgtttgcctctcgtgaatatttatatgtagatgaataagtatttatggatttcctgctgtgtaccaggccctgcgctctgcaacatggcaggagccacagaagtgtgtgaggctggtctcaacctgagagaaataagttaactgtgtgagccttgaaagtggcctaacagtgaacagattgcgccatgatcttgaagcctaccagctagtttgggtctgggctctgtttcttactatgtggctttggttgagtcactcaactcctctgagccatagttttcttctctgaaaagtaggggttaatagcactcacatcccagaatggttgaggatgaatggaagaggctggtgcctgataacactagccgcttgagaggcggccctcagggaatgctgggccccactccttctcttgaaatgcaacagccagtgcaaggtgttggtgtgaggctaggtgagtaggggtgctcagtgcccatggagcacaactgactcagagatctagaacttcaggaggacagaccccagggcctaaagccatcagggaaagcttctggaggaagatacctctcagcttggccttgaaggatgaacaggattagaataaacagagaggtagaggcaagcattctttggctagagcagagcattcctaaagggcagatgcctggcacaggtgctgctattcctccctccaacccatggcagacatcattaatggattccagcatacttcctcaccaagttgggacatgtcctcagaagcctgcttagcttcttagccactagcaagaaggcagacttaccttctggggagatgccttctgctgaaagctagtcattctgacagggcaggctggggccctccagaaaagggtcttgaactttggccttggaactaaatctccgtttcctcatctgtaagcgtgtgtggttctcacactgtggtgtgctccggaatcaccaaggggaggtaattaatatgtgattcctagtccccatacccagaactctggaatcagaatctctaggggtggtgcccagaccctatattttaaacatgccccgagggatcatgatcttgccaaagtttgaatatcaccatcttaggccatttcttgatggtttctacaggagagagtccggaacgctgtccttccaaggcaaggcctcaggctcattcagatcaggcctggccactcctctttggagggcggttgaggcccacctgccttgggcttcccaatcctgattcccccactacacccttcccagttctattcccctcaccacacttgctccaataaaactatttatatacagataaattcacacacattcatatgtatgcatttatctaattccccagctcagttgacctcggctcctattttgggacacatactcctgcctgggagtctagcaggcctggaccagctctctcttgtctcagcttcctcctttgggtgcccaaggttcccactggcaccctcccctgtcccaccaacttttagccggtcacttcctttcttgggtttgagtggctgagctggcagagacatcagaggctgcccccagcctggtggtggccacccttccatgtggcttccacacaccagttcctgagccctttgccattcacatcctgccctcttccaccagtagcttcagtaggaaacttgtcaagaggagatgaagccccggatgggacaaacaccgtggtctagctccatctcttactggtactgggccttgggcaagtccctgcccctctgtgagccacagtttcctccttggtgaaatgggtatggtaataatgcctccttcctagggttgctgggaaaattaaatagcttaacacaggtaaaacatttagggcagtacctggcgctcagcacctggtgggtgctgcataaatggtaatcatgttatgtggagggggagggggagaagagcagtaaccagggtagtactggctgtgccgccattcgaagtaccaccagaccccatttctcaccttcctgacactgctgcaaagtggacaggcacttggcttacagtgggaggctgaggctagtgagagatattttgtccccagccacacagcagcaagtgatgatggcactggacgaggcctcaccattgtctagtcagtcctctgtggctctgccctagactctgagacctcatgctgatgaggggccgggggtgggggactggcagagggacagtggcaggttcccccatgacttctatcttcctggctttggcctggctcttctgggagggtcccctgatgctgatgggccactattcctaggcaatgccaggcaagaggtgaagaggggaggggtgaagtgttcaggctgtggagtcagacagacccaggttcaagtctcagctctgcctcctcctccctggctctgagaccttggccaagttgcttctttctctgagcttcggttttctcttattaatggaacacggagtcccccgggagttgtcccaagggttccagggcgcagtacgtagaaagcttgggctggtcatttgtgctgctgtgcggataagctgaggctgcccagagtacatgctgcctgccacagggtgacattcagtctcgacgttgtctccggtccacacccctgttatcctgccctcttatgtgctgagcaatttctactgtgagtaggaatgtcagaacaggcagacctcagagatagtctgctcgaccatggtgatctcacagatgggctgactgagtccagagagggagagccccctgcccccactccccgccatggttctccagctggccatcccctgggtgtggcgccctgtgctgagttgagtggtctcatggtgccccctgccgccagacccctgccttcctggctgctccctggaggccctgcagagcagatcacaggccttcttcctggggagtcaaggaagccccggagaataattgtgtttgggtccaggatgctgccattgaattctagtccagcctatctggctcagcacagagggtcatgggctattctttgacagtgaggagaccacaggctgcagcccttccctggccctgcttccttcctcccctgcaggggactggcctgggcagaggtggtccacagagggtgccagccctgtttcactaagctcccacgtaggtcagagatcagacgagaggaccccaaaaatgccttccagctccaagacgataataccttcaagcctcctatttttaaaaagcctaaagaattatttcggatgtgtaaacaagtaagtatagagtttaaatccactgtttccacgtggttccatggggcctgccaggctgggctggatcggagagggcagccatggatggccagggagccccagaagtccgaccaggaccaatagggaaaccagctgagccctgctcacagacgagcgctcagtcactagtgggctctggacccagaccacagttctctgctacttgttagttcagagagcccaggccagttatcaaactgccctgggcatctgtttcctcagctgcacactgaggggaaatatcagtaactagctcttagaatcgttgccaagattaaatgagataaagtatgttaaaacactttggcccggcacctgacatgtagtgaacgctcaataaataatggcaaaacccatgctagctgagagtacttgctcactgctgtgtgttgggcgctgtgctgagcacgtccccgtgttaacttacataatcctcaccacagccctttgagggaagtccggttattacccgcattttacaaataaggaaactgaggcacagagagggatgtaactgagctaaggtcaatgagctaataaatgattgagctaagcttcaaatccaggcaattaaaaatctacactcttaatcattactataattacagttataattacagtaagaattataattattgttccaagaggtggtgagctcctagtccctggaggtggctggatgaggctgggcagggcccagggattctgcctggagtgaaggaagggctgtatggtcctggactcacctccatctgcttttcagctggacaaggtcacatagtgagacagtggggagaagatggaaaggagaatccctttggagggcctttgcagactaggccctgggcaggcattgatgcagctgtgggaggggagggaagagtctgaggagccactctggccccctccaaggtcagaggccaaagcctccctgcagctatggtgagtccctagggctgggaatcagaacccgattttttcacctcaatttctccttggctcacaggctctttttggtgctggggtttccccagcagcccagggggctgactcctagggccagagctgcccagcccctctgtcaggctgctaggcttgggtcagtccctgctgaagacactctcctccccacagtggaaggaagagcccatttcccagcagcgcagaggctgaggatggcggctgggtgggagtggtccccaggcccattgtgtggagccgataaagtacggaagctgaggttagaatgggaggaagcccagggcccgagggctctttcccacgggtgggggccttgggcatggccttgccaggccagcatgagtgcagcctgtatgtgcactgaagggtgccctgaatggtgacagtggtaacactcactgggcaatgaccactggttactgaggttagcgtgggtgccaggactgggccttggggtccagagtttatcctggtgaaccttccatcagccctgtgaagtggctgtcactatgcctaagccatagctaaaaaaatggaagccgagaggctaggaaacttacccaaagttggtgaaagcaggatttatatccaggtctggttccaaacacttgctctgaaatcacacaccatacggtgtgtgcctctgtgtgcacgtacacacatgtatgtttacaactctggtggggcagcattctcaggaaggaggcagcacttcccgagtctttcacaggaaacattaaaatgtgttctgaccttgcatttttgagtagcagcatcctctggtggagaaacacaggccttgaattgaggcagattccagctctgtcacttacatgctgggtctccttggggaagtgacttaaattctctgagcctctatttactttataggtttattgtgaggtttaatgagatagtatctgaattatgccccatccagggtctggcctatagtatgagctaaatgaaggtgtaattcatccatccatccactcatccactccttcatccatccacccacccacccacccatccatctattcacccatgcattcatctaccatccacccacccacccacccatccatctattcacccatgcattcatatatccatccactcatccatccatccacccatccatccatctatccacccacccacccatatattcatccatccatccatccatccactcatctatccatccacctatccacatatccatccatccatccatccatccatccatccatccatccatccatgcaggtgggagactcacaaaagcatcccccgaggaaggaattgcacatggagatgaagaccttctgttggttggaaggcagagttgaggaggttgctgaagtaggggccaggctggagagataactgaaggaataactgaatggaactttctgccctgatcctaagatggtagatccagtcgtgttacggagtttgaatgttatcccgagggcactagggagccatggaaagctataaggcaagagaggtgcactcaggcctgtgtaatgatttattttatacactgctgaccatctcaggtctcctttgaacttcagaatcctgacttaatcattatgatcctgattttagaaattaaggaatagaggcttagagaggggcagggattggcctagtgacacagcagaagccctgccctctcacctgctcactgcctgcaatgaagcctctgtcctgagtgccagccgtctggcttctccccagtgagctggggacctgactgtcccaggaggagatccctgtggccggagagtctgccaggccgattccacttcatggccaggctgttcccagcagtggggtttccctccctcacctgtgtgccgcgggtgggggctttggggatggaaggggctggtggcagggaatgttgggtctctgagcctctgtttacttaggcaggagttcctgggtgcccagactgcatcgtgtctgtcttctctccgcagatgagcggggctgacaccgttggggatgatgacgaagcctcccggaagagaaagagcaaaaacctgtacgttgggaagatccctggcttctgcgctcctcttcctcccttgccccagggcttgtctctcctctaggggtccaggtggggagaagaggttgtgcctggtcccgcccacaaccccagacagacaccaaggaaaaactggatcttggaactttgcagtgaccccaaagtggggtcacctgggtcctgagcattctctccaagtgaggcaaagtgctgattcagtacccggaagccacagtgaaccagaagcaaccagcccgtttgccctggctttagcccagcttctgagccaagcagggaccaagtgacttcaacaactcctttgctccctctgggcccaagagtgacctgagaaggggtggaactgacagtcattggctcctctttctcttcctgagctcctgaatgctaatagtctcaggcattgccaggagggggcgctgctggcccagctgccgaatcccgcactcgccaagcctttctggccacactcaggccttcttatactatagggtgtttgttagaggtgtcaatgaaaaagatgtgtgtgtgggttctcaggtcttcttctacccccaggcctaagaccctggagactcgggggaggtatagggaggaggcagtggggtgcatgcacagtgacacctccagaggaagcccctccccaccaggtcctgtagcacccaccactaggcaggaattgggctatagggaggagcctcctgcaaccctcttctctggccttgaccgtgggtggggtccactaccctagaaagccttcctcaccccagctgccttgacctctccagctttctgcagcaactgttggcttctcttactccacagccaattgcattttcttagcaaggtgaaatgcataaaccaaaacagtcccttgcaccaaccatcttcacttaaccttttgtaggatgagagaggatccagggggtgccaggactgttgaatgtggtgctggaagtgggaggtgtagggaagcagtgtgtggcgcagagggcaggcatcccgggtgctggagcagccctgtctagcctcctttcaatgtaggtgctgccttttgaattgcctgaagcccacactttttttttttggagacagagtctccttctgtcacccaggctggagtgcgatcttggcttgctgcaacctccgcctcccaagttcaagcagttcttgtccctcagcctcccaagtagctgcgattacaggtgtgtgccatcacacccagcaaattttttttgtacttttagtagagatgggggttttgccatgttggccaggctgttctcaaactcctggcctcaagtgatcttcccgcctcggcctcccaaagtgctgggattacagacatgagccaccatgcctggcctctgaaggtcatactcttaaaagcttagacgaagagtcttagaacatctacggtaataataagaataaccattaatgtttattatgccccgcactgttctgtgtgtatttcatatgtaatctaatttaatctttaccactacttttattttccgttctgttctttcttattgaccttacccttattttacacgtgaataaactactgtgcaaagaggctaagttacatggcaagaaagtggtggggttgggacctggagacctggcctgctggcttctgtttgaggaaacagcttgacagagaaaaaaccttgataggaaacttgagagatcaggaaacgtgtcaaagggcacacagctggtaactgctggagctgggatttgaacccaagactagctccagagcctgggatcagcctcccctgcaggactctccttcattagacagggtgtctaggtcttagtgccattttaagcttgaatagcatcagaagtataaatgcttcaaacttaccaaacccccttgaaagtttaattattaaatttcttttgcacgtctttagttatgtgatttttgaataatcaatttttcattttcatttttggtttgagtcagcattttccatctttgggaggatggagaccaaaacttaaagtgaaacatttattattcgaaaatcacaaaaccatgcacacaacattaaataattaaactttaaaatggtgtttttgtaagtttataggacttgtacttctgaagttattcaggcttaaaactactaagatgttggggtcctgctgtatattcatgactggatgtcgccaatgcaggtgactgaggctgagaggccggctggcaggagccattctctgggaggtgccctgtacagggggtctagggaaaagaggggcgaacatgagcaagaggcatttaactcctttcttgccagcagtttcacccagtgctgaattctgctgcctccttggggaccggcaaggctaaaaatggttcttggctaaaaatagccagtcctgccaccccggtggtgggcagtgcctcccctggctccctccttccctttcagcaatttgctgacttgtcccccaccccccaccactgtctccctgctgccatggtaacgaggaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgtctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctacagaccaatctgcggccccaaggtggggggccctacagagatgctccgaggcatgtacctcactcgcaacgggaacctgcagaggcgacacacgatgaaggagtaggtgccctcgacccagctctcccgactctggatttgcaggggcgagtgggccaggctgagcaaccctcttttctgcttctgtccccagagccaaggacatgaagaacaagctggggatcttcagacggcggaatgagtcccctggagcccctcccgcgggcaaggcagacaaaatgatgaagtcattcaagtaggtcctccctggcaccctgggaccctttggggaactcactggctccccggggagtaggactgagtggtagggttgaggggaaggggcttgccggcttgatccagctctgggggagacaggctttcacagagggagctgggtacctggcaagcagctaccctcacagggagcagctgccctagggggaaggctaggtggggtggagatgggggctggaagggaccctggccccgggaaagagggtgggcctccttcctgggcgccccagctgggctcagctgcagactgggcccagggcagtaaacaaaggccgcctggcccagcttcccccaaggttcccaagcctctcagtgccctcactgtgtttcctccctcacccctcaggcccacctcagaggaagccctcaagtggggcgagtccttggagaagctgctggttcacaaatgtaagttgggcctgcctgcccactccctgtgccctctctccctctccccttcgcccccatccagaccctgtgtagctggtgctagagaggccgccttccctctcctcggccgtcagggtgtccttgctgttgcggaggggctgagcctaagctgaggcccttggtctggccttggagccagcttctgccagcccctccccgtccatgtgagctggcactgcctgccggaggcccgtgggacctgtgtgctcagatccatattcccagaataagaataaacatttctacgtactgagggctttcacggcgccaaatgtgcctgccatctcatgggcagggtcccatcggctcctcccagggctccgggagacagaatcgatagtccccatttcacagatgaagacactgaggcatagagagggggagaccccactgagaccctgaaagaggcagtggcagggctggggccacatcccagggctcctggctgtcggggacgggcattgtactcagctcccagcacgcccatctttaaagtcctgtaggggtaagctgaggcatcttaagggcaggagaggctgagtttgcctcttaccccaggatccgttctcctcacagacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtaggacctcagggcagaccctccgctcctccaatccccagggcccagtggcccttcagctgcaaggtggcagccagcagcacaggaaggggagaggccagaatgactccatgagcccaggtacccagcagggaagatgcaagctaggatcaggggaagaacagaatcccagttagtaataaaaatggccaccaccaaggcactgccgcatgccaggcatgtgctgagccctttatgtatgcgttctcatgtttaatccacacaacaacctgtgaaacgaagagacaggctgggcacagtggctcatgcctgtaatcccagcactttgggaagccgagccaggcggatcacttgaggtcaggagttcgagaccagcctggccaacagggcgaaaccccatctctactaaaattacaaaattagccaggtgtggtgatgggcgcctgtggtcccagctactcgggaggctgaggcaggataatcgcttgaacccgggaggcggaggttgcagtgagccgagatcgcaccactgcactccagcctgagtgacagagacaaatcataattgctcccatctattgagtgcctactgtgtgccaggcactatgcgcaaagcacattatatggatgatcttgcttggttttcacgctttgaggaatgtactattattcctagctggtagataagacaactgaagctcaccgcacttaagtaatttgcttcaagtcacacacccaggtgtggcactgctaggatttgaacccaggaagcctaaccctcagggtggtattttcagccttataaatgctgccagccctacaggaaatgactgagccaggacttgaatcctctggtctgagggtctctacttcagatgaaccttaagatgtggggcaaaggggcttggaggtgagaggctggatgggtcccttccaggcacatgggccctagggtcagtccccagcaggcagccctgaccatgtccccctctgcctccccaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttgaccctttttgtgtgttcctggtcttgagccttcccagggtggctggggctgggagggttggtcgttgggctgttgattcagccactgctctcttgccatcacctgcccccatcctggagcccgatacactgatacactggtgagggctgctctcccatgccttcctctgtgccaggcactgtgccactcatcctagtggtcactgcatctcctccccaagcctgggaggtagggcttatccccattttacagatgaggagatggaagcacagacagggaaggtcacgtagccagcaggtggcaggggttcagcccaagtctgactgtctgcaaagcctgggctctgccggctacaggatggagtccttgcttatcgccagctggccacatgtctttcagcaagttccttcaattctctgcctcgccacaccctgaggtttgaatagaactttcacgtggtgcagggatggctggtgaaggtagacggggccagaatctcaggaagggtggtggtgggcttatggaggcctctgggcagaaggaacagctgtggagacaggagataggactcacagagtctttctgtggccctgggtaaggctttccccactgtgcctttgtttcccctcctacctaacagaagatgcgagtttaggaaaggcccagggcatccttcaagggaggacctgggccacttgcctagaagtgggcagaagaggcccagagtccaggccaagctgaaggcaaagctgaccccacatatataacctcccaggggccagggcatggcccagggtggggtctggctcagcagggctgtcttagattaagctagatggagttgatgcaggaggagctgggccccgtctccttggatcttgttccctgcctggggtcctgcagacttggagctgcagacgacatggggctgtacagctccctcctccctgcctgcccttactcatctccctgggcaaggccagccctgttggcccctctgcacagtgagaggatcagaattgttggtctctggaggccttcagggagttggactgagccctcttcagggttacaggggactagagccagggcctgggtgtggagcagaagctgagcagggcttcatcaggaggaagaggtgggctgtctgactgccgctctgaccacacctgacttttcctgccccgcttgcaaatgggacccctaatgcttgctcacccttgaaacccatttggaagaatcttctgtgcaacaacagtagcctaggtcagcagagaacccccttccctctgctccccggcagccgtggcctctccttgactagcccgtactgagtcaggcatgggtttttctgtctccaaaggctttggaatcaggcaatcctgggtttgagtcttgtctttgctactgacttgctctgtaaccttggcaagtcactgcccatccctgagcctgcaaaaatggggatgattctattgtcttctcagtgctgggatgaacagccagtgagccagttctgcagaaaggtcctaacctggggccaggtataccgtaggtgcttgatacatgttggcaccagagggtgagcccctccaggagtggtgctgggtctttctccaggacctggcaatgagtgtcattgggctttataaactgtgaagagctttcccactgtagagattcagtgtctcacagaggctggaagggcctgggaagagtcgtgcttctaattctgaacaagggcaccttccaggttttttccaggcctgagatttggggacctgacagctgggaaaactggggcccagggaagactataatactactccctactcccccaaaatggtagaggcagtactgggtctgagcccaggacttccctgcctgacctggcctctctcgcatcttctgctgggaggagccactgggtccacaaggagacccacctttccagttctttatattctagggattcagtttagggccaggccttccctcttccaccttcccaacctcctggttcccagagttgccatggaaaccaaagtccgggagaacaaagtcaggcagatggaattcccatttcggaaggccccactgcctggtttccattactcacaccctggttcccttggcctccgagcggctttggctgtgcagagcagctggagggcagactagaaaggcgtctgggtccccctgccctgggccctgcctgggctccctggaggaccttgggtacattctctgcccgcttaggcctcagttgcctcatctgtacagtgtcatttgggctggttcccattttctttcacaggagaggaaggagcagtgctctctagtctctggcaattccaggcggtcaacgtgggatcacagagctgtgatgtcatttcaaccagctcctccccatcccacagatgggaagactgaggggagggaagggaagcagcactcttcactgtagagctgaagggccttggagtcaggctctggggctcagtctctggctccaccatttactaatggctgcaaacctttgaagaagtcatgtaccctctccttccctccgctttctcatctataaattgtgcgcattggcacttaccccagagttgcaatgactaagcgaggtcgtgcatgcaacaagtttagttcagtgcatggcgtggggtaggtgcttcataaccgtgagctgctgttagcgatctcattattcaaggtcacaggtcacattctccacttgcccaggcctgagaagatggggggggcctttggtctcagaccccagatccttgtccttccaggaacagttttgctggaggacaaagccagccaattccagggagtaagtgagaaacagcctgttcccgtactgctgcccagtcttggccctgctgggagcagttggggtcagctggcaaataggttgtggtgggtggagaggcaagagggcacagcagtgccactcagttggatgccagcaggagggggtgccactcagttggatgatagctgccgaggtgccaactgcagccaggctcctggtgggagagtcaagtccctcatgctctcggcctctgccatgtgagtgacgtgctctcttgacctgtcttgggccagctatggcctcccagactctccagcttggaagagaccattgagtctaaactgctgcccagcacttaggaccccagagtttctgcttgattccttccatgatggagctcaggagggcctgggagccccttgggggttccaaagttctctccatctgaagtcgggtcctggggcagggtggggaaggagggataggttagtcctacccctgcaggtctcctgcccaggcagccacctctggacccaccagattctccagcttcactcctccctgctcctctcgcttgcaccaaactctcagctccccaccctacctccctgcctctgcacccccttgtcccttaacctactgtcccctccccaaactcttcccactgacatcccacccctgaaggcctctctgcttcacctcccttcctgcccaaacctcaggctcctggcgactcctccacagccccaccgctccctcagagctctcaggccctcaagcaatggacctgacaggggtctcaaagaagccacctgttggttgttgttttgctaacaactggcaacatttgtggaacatctggctttgcctgtcctctccctagccagggaagggaggaggaaagtggtgcccccttccttgggtgggaggaggcagtgggggattgaggaacagctgtgggactgatcccatctgccgggtacagaagagagtggaggcatggctgggggtggggagggcagtgccaggcggcaggtagatataggagccaggaccacgcagaggcacacaccacgcattccatgcctcattgccatcgatcctcacaaagccctgggaggaagggctgagtattattttcagtttacaaatgagaaaattagggttcagagaaagtggacagcccatcatggctgaacagggatggggacctctatccctgacttccaggcagcctcagccagggctttccaaaagaatccacacctgcagccagtctgtgagacttagtggttcagctggagttgcagatgggggcttttgatgctggttctctttggcttgtgggcagaatttttctaaggaagtccgaggaataggtgagtttatgaatgtgcggatgtccggtcctgcaaggaatctcagttctcagaactgtgtgacaagttgctttacctctccgagcctctgttgttttaactatgaaatgggaataataattccacctcctgggactcgcgtggacttggcaggtttacgaatatgtgtgaaccctcagcacaaggccaggcacagagggagtgtgccctgcggggcagagggagggaggctggtccaggaggcactgtcgggccaagccccaaccagctgtgcaggaggaagctgcccccgcatctgctccaaggcagtgactcaatgacacgacatgggcagggccccaagggggcggggtttgggccctaggttccacatgggctcagcggggtcctgcctgcctgctgtttcaaaggcaaccaaatagcatctgcctcatcaggtagctggcctggcagtcaggagttctgggctttgagctcagatctgtcccaaacctctgtgtgaccctggatgaggcccctctctgctctggtccttggcttcttctcttgacacacaaggagaatccagcttttcctcctgcgtgaggaccttcggaaggggcagatggtgctctgtgggggtgtggggggctgggatccaggccaagctgcctctgtacgcggcggggtgtgtgtgcacgtgcgtgcgtatgcacaagtgtatgtgagctgtgtattcgagttgctagggctctttttagctgcttcccaggggactggaaggcctacttggatggagcagtctgtttatcaaggagctccacagtctacagggttcatgcccctggggacactgccctctgtgtcctccagccaggctggggacctgatctgctggtttttcacaagctcctgccctttaggcaaagtccatccccactttttacccccagcacacacaaacacagcacctgctggagccacccctctcaggggattcagctcagtttgctatccccagggagatataaaaaagaagggcctgaacaaggcacagccgatgcccgcccccagactggaggggaatacagcctccagtctgggaatataagtccagttccactgccgatctgtctgtggcaagtccctttcctcgctgggcctcactttccccatcttaaaaatgggtggggcgtgttcaaagtgctctctaggagccatccgactctgatgcctcaggctgtatagcttttccttctgaggtgctattgcagcaggaactggcttgctctcgagttctgtccattccaaggaaggggagggtggtaactgggggcttgggctttggaggctgacagacctgggcttgagtccaggttcagatgattctttattgcgtgaccttcggcaagtcgcttaacctctctgggccactgtttccacatttataaagagttaaagagattataaccagttaataataggtgttacctagtacagttgttgtgatcaaataaaagcaggggtgaactatttgcattcagccctgctggtctgccttctggtcctcgaatgcaccacgcttccttccatttggggcctttcacgtgcagtcctccctccctggaacactctttcccctgctcccttagttaatgacgatgaggaggaggaggatgaggatgatagctaacatttaatattttccaggcactgtgctaagtacttgactgacattttctttttttatgctccccaaaatcctgggagttaagagctattattattaatcactacagcctagtgccccgaggccaggcctgaggacagattgctcaggggaactcccagctcttccacttagttgtgtaaactcgggcaacttacttcactttctgggtctcagtttacccagtactcagtatcaggctgggcttgctctgaagcctgtgctcttgagtagtaggctgtattcctcccccccttctccagagcttggtttagatgtcactgcctcagggaagccttccctgataaccctgactataagagggcccctgctgactgctcccaaagcctcctgctcctcctctttcatggctcttgtcacaggttgtaattacacacacgcatatgttcattcatcgctgtctcttcctttcaagcttaagccccttggggcaggaaccctgtccgtcttctcactgtatccccaggcttatcaatcacagtgcctggcgcatggtaggtgcttaataaatacttatttattggataaaaggccatatattgcttagcatggtgggttgcacaggacaagcccatgaacaaaaagtctggataagaagccactgcatgagtaaagattgagttctgttgtaagtgacaaaaacacaaggtagaagtttctctctctcccataaaggaaactcagatagaagcagcctagtgctggcatggccttttcgtgatcatcaggaaccctgattttgtctgttactttgccgtcctcaaaatgtagcttccacttcctgtccaagatggctgcttgagctccagccatcacgcaaggctggaggccaagaaagagggggtaaaaggtaaattgcagttatgtcttagagaaggtgctcagaaactgtcacatgacactttcccttacaccccattggccagaactgagcacatggccacacttgtttagaaggaggctgggagcagtggctcacacctgtaatcccaacactttgggaggccgaggtgggaggatcacctgaggccaggagtttgaggccagcctcactaggagcctcactatggataacatagtgagaccctgtctctacaaaaaataaaaaactcagccaggcatggtagtgaactcaggaggttgagacgggagaaacccttgagcccaggagttcaagactgcagtgagctatgatggtgccactgcactcaagcctgggtgacatagtgagaccctgtctctgaaaataaataagtaaataaatgagaagagggaaagctgagaaatgtagtgttaatctagacagccatgtgaccagataaaaatcagaggttctgttactctggggtaatacaaaggctgagcagatgttggggacgactagctgtctccgccactgtcatcaatgacagacatccattctcgtaaggctatggagaggaagtggggcaagtgggcatgtgtcagttaactattgatacaacagtgctgcaaaacaaaccaccccaggccgggcgcagtggctcacgcctgtaatcccaacactttgggaggccgaggagggggcggatcactagaagtcaggagttaaacaccagcctggccaacatggtgaaaccctgtctctactaaaatataaaaattagccaggtgtggtggcacacgcctgtaatcccagctacttgggaggctgaggcttgaacccaggaggtggaggttgcagtgagccaagattgcgccactgcactccagcctgggcgacaaagcaagatttcatctcaaaaataagtaaataagataaataaataaataaataaaacccaccccaaaatacactggcctcaaataacaataacttattctctcttacgcttctgtagtcaaccgacctaggaagagctgggtgggacatgacccctccctgtgggctgggctcagaactactcactgtaacttttcctggaggcagaagggtcagggtctacctggggaaagttctcactgcagtgaaagcacgtgtgtgttttttaaacttttaaagtttaaaataattatatattcacaggaaattgcaaagatagtatagcgaggtctcatgtacccttcacctagtgtgccccaatgaacacatcttacataattatagtacaatatcaaaaattgaaattgacattgggacaatacgtatgtacagttctatgtcattttatcacctgcagatttgtataaacaccaccgcaatcaagacatggaactattccatcaccacaaagacctccctcgatacccttttataggtacacccattccccacccctaacccctcgcaaccactaatctgttctccatctatgtaattttgtcatttcaagaatgtgatataaatggaattgtacagtatgtgaccttttaagattgtcttttttcactcagtataacgtccttgagcttcatccaagatgttgtgggtatcctatttatgttgcgttcaatcctatttattgctgagtaacattctgtggtatggatgtacaaccgttcgtttagccatttgcctcttgagggacattttggtcatttccagtttggggctgttacatataaagctgctgtgaactgttgtggagagagttttgtgtggatgtaacttctcatttcactgggataaatgaccaggagtgcaattgctgggttgtacagtaagtataggtttagtttttaagaaactgccaactatcttccagagtagctgtaccatgagagatccaatgtttctgcattcttgccagcatttaatgttgccccagtgttttattttagctgttctaacagataacgtggtgattttcatccgggtcttaatttgcattttcctaatggctggtgatactgaacatcttttcatgtgctatttgccatctgtatatcctcattggtgaaatgtctttccatgtcttctgcccattttctaattagattgtttgctttttttactgttgagttttgagagcgcatacagtctatgtatgaatgctttgtcagatatacgatttgcgaataatgtgctcagtctgtagcttgtcttttcatccttctaacggtgtcttttgcagagcaaaagttttgactgttgatgaagtacaatttgtcctttttaaaaaatggatcatgctttccttgttgtctaagagctttccactaagccctaggagctgtacaggtagtggggctgttacatataaagctgctatgaagtattgtagagagagttttgtggggacataacttttcatttctctgggataaatgacccaggagcgcaattgctgggttgtacaggaaaatcctgaagattttctcctatgttttcttctgaacgttgtattgtttcacatttaaatctttgatctagtttgagctaattctcatacgatgtgaggtttaggttgaggttctttttttttttttttttgcctaaggatagccaatggcagccgggcgcagtggcacatgtctgtgatcccagcactttgggaggccgaggcaagtggatcacctgacgtcaggagtttgagaccagcctggccaaaatggtgacactctgtctctactaaaaatacaaaaattagccaggcatggtggtgggtgcctgtaatcccagatactcaggaggctgaggcaggagaacagcttgaacctggaaggcggaggttgcagtgagccgagatcacgccattgcactccaacctgggcagcgagagtgaaactctgtctcaaaaaaataaaaaataaaaaaggatagccaatggcttcagcaccatctgctgaaaagactatcattcttttgctgaattgcttttgttaaaaaacagctttaggccgggcgcggtggctcacgcctgtaatcccagcactttgggaggccgaggcgatcgagaccatcctggctaacaaggtgaaaccccgtctctactaaaaatacaaaaaaattagccgggcgcggtggcgggcgcctgtagtcccagctactcgggaggctgaggcaggagaatggcgtgaacccgggaagcgga

SEQ ID NO: 1727 - DNA, 3594 bp, Homo sapiens
ttccagacccgctgctgagaatgccaggaggtggggacactgagaatgggaagaaactaaagcagtgctcaagttgtctgggctgagatagggacactgaggggctggctagctcctttgtgcctccagttcccttggagaggagggtggctcttggcaggggtgggctgtgggcttcctgaccttggggtagaggcaagagcctccagcttctggcagtgaccgggcagggctgtgtcctagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctaccaatctgcggccccaaggtggggggccctacagagatgctccgaggcatgtacctcactcgcaacgggaacctgcagaggcgacacacgatgaaggaagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttgaccctttttgt

SEQ ID NO: 1728 - protein, 776 aa, Homo sapiens
MVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQESPTRDLPPCQDLPPSQVSLPAKALTEDTMSSGDLLAATGDPPAAPRPAFVIPENSLRRRTHSEGSLLQEPRGPCFASDTTLHCSDGEGAASTWGMPSPSTLKKELGRNGGSMHHLSLFFTGHRKMSGADTVGDDDEASRKRKSKNLPICGPKVGGPTEMLRGMYLTRNGNLQRRHTMKEAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 1729 - DNA, 51198 bp, Mus musculus
  misc_feature (1)...(51198): n = A,T,C or G
ccctgtcaatcagcccagcctctctgccatttatgtgcagtggctcctccagaggcccctcatctctctactctgaggttccaagagacctcagcgtccatagcccccgtcacactcaccgagggagtgggaaggccaggagaaagcaccatgacctttctgaacacccctttgtcatggcaagcacgtggaggggtgtgacctcatagctggtatcgtcagacatagactggtctgagaaacagaccttgcagatcctgagggctctgaataaaggcattctaaagcagcagacaggacaagaagcctgaaggtcaggcatttcaggaggctctgttgcttggccgcgcagcaggtccccaaccccctctccttcctcagccagtgtcagtctacgttttataacctcacactggaagcctcgtggacacaaaacagctgctgcagccctcagacatcagaagcacagacatgcaggaagcgtcaaaatcaaaggtccctcgttttcagtattttattttttaaaatgccccagaaaatttcctcttataccgcattagctagtttagtgagatgtcagtctgggctgcctgggaagctaggaaaaccagcagttggcaaagaggaaggacacttggcttagtccggtcatgactcatgcactcggccggggtactttgctacctgaagcaaactccggcctgttagcaaaaggtgtgcttgtcagcagtggggagggaacgctgttgggtagccagctggcagctcgactcatttcctcaattaaacatgacactccgcggagtgcctgtcattactcccattttacagatgataaaacagagacatttaggaactttcctgaggtaacacaggtgcctgggggttcaccccaggtctgtctctatcaagcatgctcctaatgctcactgggggacctgctatacaggtgccccttacaaccgtgaacattatgaggaagagcttcattgtttcatctttgtatcaagccagtgtcttggaatggatagtgatctacagagttactctaagcaaccattcggttttgatacttgctgccttgcaacttatttgaaagcacttgaaccaggcctgccactgttagtaatccacccgtcagctctgtattgttttccactggttcctgcaggttcctgaagtcctgggcacacttccaatgtaaatatcagcaaatgatggaaatttgggggaaggagaagagggtgaaagaccagtcgaggcccaagagtgtcagttcctcattaactttggagccatggaaagttctttgttcctgcttgctggcttcttgcctccaggatctgggtgggtattaccctgggccagcttcctgctcagaacacagacagtctggctaacagaagccagagccaagctgggttcttgagaatagacttggagccagggggtcaccgctcaggagcaatagcctggtcccctctgtgggtgtccccaccatcagttccaaggtgactatgacagggaactcccacatttctcacttcacatagagaaaagtggggttcagggacacagcgcatctgttcacggccacacagtagcgcttcagcgatggcctttgcaggtggagctcctccccgtagtcaagggtgactggtaggattcgtggccacctcagcactttcccaggctgtaactcagggctcaagagaagagtcagggtgtgttaacagcccagccacacagggccaagtgctctggtacaaatatctggcggtttccatccacagtgccacagctaagagctgaggctcaaggtccagaaggctgggtgaacttcctgctctactgtccaccagggtgtagctttgcctcatctggtgtagagaagttgtcctttgaaggataacagtgaagaggccagctcttctgagacaggaggatggcaagtttcaggccagcctggctgaggagacccagtctcacaacaaggtatttagctacctaactaagcaatgcagcagcagcttagatcaggccccctgagttactagctgttgttcttccccaccctgagaccctgcctagagacacactccccaccccacctccagcagctgctctggtgaataatccaccaagagggcctgggttgatttggatatgcaactgaggggcgtggccccagggaatttaaggcaaatagaactcaacttgcaaattctgatattttcatggagtgtggttgttggaggccagaaaacacagccccacgggaggtccctttcacccagatccaatgacatccgctgtgggctaaccactccgggagtcaccacactgagtagtaatagattcccctactctcctgagccataagttgtaccatcagggaaagtcccctagagaggtagaggacattcctaggtcacacagagccagctctgggtcaggtcagagagttctccatgtatctgctctgagctggcccagggcccaggcatcaagtgtcttggacaaagagcctggccctgctacgctgaggacctgcccaccttggtcaactttgcccacatctctgagctcccaagctctacctgggaacctagaaaggacccagggcactgggggtggggggtgacctggcagaaacagagcccaggcactgagccacaatgacaggatatccccagggagctgggctggctgcccacacagggaacaccagggtggagacctggcatagctagaccagaaggccccaaagggcacagagagggaaagtcaggacagctggtccctccaggcagtgaatggcccagcattgtcatggaaagtgtgaccacaagcaagagtgaagcagaggaagtggggtgcccacaaatagagatgtgaattttttccactgccccattctgagagccaaagacactactttttcctggggggccacataaccacagttcactagcgatcttagagttagacctgggtctttcccacctgctatctggctgtaggtacagagtagaaggggcttccccagactctatagccagcactgtgtccaggagaacccagactggcctaaggacttgaccaaccaccatctccagccctagcctggtagaatccagagaaaggcctaccctgagcccctctccaactctgcactcagggcctgactcttaggttccccagaggcctcctctctgttccacatgacaagttccagtttttaagccacggctcaaggactataagtttggccagtacgacaatttccaaggcaaatcagggttctgtgttaactcacctcctgtggaggcagactcagactggtcaggtgtgcccccttcctgccaggaagccccaccattctcattgccaccatgctggtagttggagtccataactcgccaagagacagtgccttcgtgacaggcactagggtgggtaaagtgtatggagccaggagagaacctcgagagctgagtagacgtgggcacgttccagctcctctctgggccttaagctcccgacgtcatgatgtgattgtgatgtttgatgtagcccacgatatgaaccctgacagacttgatgctcgttcacacccctcccaccatctcatctactccacccccaccccaccccccaccccaccccaccccattgcattggcaagaatagaatttaattaacatcactgagaatccaataggtggtggctcaggtgtggagatgtgagatgcactcctccttgcccttcagagctctaacagcaccaccccacccgtggcctccaccttagccagtgctctgtgcatcgtgtttgcctgaactctcactggtggcttccagttggtgtgtccctccatgacaggtaccatctaaaccacacaggttgtctcagggacaagccgaactaaaggccattacaaaaatcaccctccaggaatgagggaatgtcctaagagggttaaatggcagagaagactggtcttccagagaaggtaacagtgtagacaaggagaaggagaaagcagatcttggagaagaaatagagactggttggttgggctggaatctgaggtagcagaagggcaggggtgtgagctaagcctgacaagctatcctggaggacaagcaggggagccgaccttactgggaagaccacaggagtcagggaaggctcagcaaaggaaaagccgccacacagctgctttaggaagagccgtggttgcagcaggaaagggagatgaggactttagaagtaggcccaccctctcatgacatgctacgcactcttcctgaggtccaggggtacctctggagagagaggacaacttcctgtcctcggtctggctggggagataagagggtaaggacaggaagttgccttaaggagttagcagcatggccactgcagggtcagtctagatacaaggggaagaggcacaaaatgccaaaaagtccagatggcacaaaatgcatgtgtcctgggctggcctcgggacctccagtgcttctctctctgtccaagcccattccttcggcccagtaggtgacatgtgtttccctctaggacaagtaacatgtgtctccacagtggacagctgctattctatgcatgccttctggataagacctagcagcctctaaccccagcagaggctggtagagctctgtgtttgaggccaacctgggctacagagtaagttccaggacagcctgggccacacagtgaaaccttgtctcaacaaaacaaaacaaaacaaaacaaaacaaaacaaaacaaaacaaaacaaaacaaaacgacaatagactcagatcagtgctcagcagtgagaatgaggacacatgaggtgtgagtattttgctttgtttgggttttagaagacatagctgggctggccttgaactcaagaaccccctgccccagcctcttgagttcagggactaaaggaatgcactacccgccaggatgaaacgcagcaactgtaaaaagaatttagtgcagtgcccttagtgcaggtcctccccagtgattttgatggcagacacatccctgcctcatatgcaggctccttcccatctcaggtcaaaagtctgggtctctgcggggaaggcagggctattctatgcatctaagaaaaattagggtgctggactgtggccccagtgccagacacaggattatgtggaaggcctttctcctcaggaagcatattttctatccccctccctccatgggagttatgcagcaatgggcaccacaggtccctctgcatttcccattaacctcagactctaccgaacacaccctggctcccaacccaatgttttgcctccgatgttaccgaagcctgtctcctacttcccgatagcagaaacctcaaagacccctagttgggattttattgactggtttgagtgaaaagacagagtgagctgaggcagatcacggtgttcttatggctctatcagaaacccatctcttcgttaatcaactctttgtagcaccgggaaccaaagctgggctttagctgggcaggagtggctcacaaactcaggaggtagaggcaggtggatctctttgagttcgaggccagcctggtctacaacaatacacagagaaatcctgtcttgaaaaacaaactaagcaggccttagcacatgccaggcaagtgcttctcagtcgagaaataagccatctcctttcgctgtggccccctctccctctttctcttcttctgcctcctcttcatctcaattcatataactctgctaacctcaaactcccaatcctgttgcctcagatttcctgaaccgtgagctatgagcctgtctgcactgccattcccctctgatatccaaatgttatccttgaggtgacaagatggctaccagcaatcggtagataatagaataaaaatatttccccaatgttttaacaaaaatcgaagtcaatagatctggttggctgtgttctggtcaatgctacttctgagacaaccagtctttgtgggcagagaactacaggctgtctcattttctgagatagtcacacactggccttgtagatctcagaaacaggatcgtctctagagaagccagagagtggggcgggaaagctccgaggatgacagctgaggaagacagaatgctgcaaggtaatgttctcagccacccgtggacacaatggcccactcccaggatgcaggaaatggaatcccattaccttgcctcctcctcctcctcttcttcctccttctttctaagcttagatacactacattgcccagctcctcttgcagtcaggtggggccatgtgactgaatgacagcctgcagaacgtaaggggaaatgacatcatcactccccaggacaggctcacagaaacctcctatggctggagccatgttcttcctccctccctggctccatggagctcatgtggtgaccttgctgccacagtgaagaaagcagagccacaaaaggaaagagtttgggtctcagtatcaccaccctgccaagtgttcagtcagctgcatgctctacaccattagaagtaaacctttgtagactgtagccctgacctgacttatcttgggctgactctgttgtggcagttgccttaccctgacaattacccttgagcaaagtgaggttcagagaaacacctaacccaaggccacacagctgagacgacctggagctggacttctttctagtcatacacagcttgcccccaaaaccaaactaggctgggagcattgggggaggagataggggcccatgcctttaatcccagcccttaggaggcagaggcagatggatctctgagtttgaggtgagcctggtctgcagagtgagttccagaacagcctgggctacacagagaaaccttgtctccaaagagcaaaccaatcaacaaaacaaacaaacaaaaaaagaaaaaaaaactacaaatctccagaaatttgttcaaatacaggcacatctatagagggacatcatcccagaccctgtgacagggtggaaactccctcccaacttttcaccccccccccactatccctccttctcccactctctccctcccccactatccctccctcccccannnnnnnnnnnnnnnnnnnncttagctcactctttctcctgctcttgaacttatctttgctaccctgctcttccaccagtacacagcactgagtttgaaaccctaatgaactctggtcccctcctggttggagctttggcctaaggcttatactgtcaggagagactctgcttggctgagttcaccctgttctgaatggttgagcctgtcctacttctcttcccctttgtgtgtgtgtgtgtgtgtgtgtgtgtgtgtgtgtgtgtgtgtgtgtgtgttgggatgtatacaggtggcttaacacccctggagcacctcaggctcctaatccccacagtgactcctttttctacctcaccctgttgcccttctccttagcctgacccttaccccttactgagcaagctgaaaccagaaactcttcctccccccccccccatccagccccccattccatcacttccccagattagctccatggaagattttttttagaaggcaaatctgaccctatttctcattgcctaaaagccttgagggtaaggaccagtctaatcaaggattgatgtctaaatctgtacccaccaccaccaccccatctatcttccaggctgccatttcctgcttccatgatgcagctgtgctgggactgggtctccatccagacacgaggctgaagttttccacatttaattcaaacatcttgtgacagcttgcgacacccaaaccttcccaaggaacacctgcctcctcctgactgtcctcacttgaggtagccaggcaagattctgctggcgaatggccaccatctaccctgtgagagagttcagaagctctggggctaggtaggcctggagctgtgaggaagtagggagaagagacatgccctttggacagcctgctcgtgacctagccttgagctgtcatctaggcggaggcaggtacataattaagaacacagaagtgatggacagggaacgtgaattgactgtgtgggacttgggcaagtttggaggggtactcagaagtcctgatgaggacagccaggcaggtgggcatgctgacaggtatattcacctgccaggtaggagccaccatcttgctctgctcatagagtttgaagagagggtggagtggtctggagaaaggggtggggctgccaaagcaaacagtcaggcctggggctgtcttctagcaaagccaactcacagctgtgggatgggaaaagtgggagaggctagggctgatgtcccctgaggttggcagaggaggtataagcccccaggatgtgtgtgcttgggagggtgcagggtgactgctgcttgaatgtctatatctccatgtgtcggggagggaggtctccagtggggaagtatccctgggtggctctgtctccagcagagtcctaccaagtttcctagcaacttacaaatgaagagaggctgtctgtgtcctgtcctggtcagagggaaagggaaggaggaagatacctggagatgttggagttgaagcttaaaatgtcagagtatggtagcataacttgtaatcctagcactctggaagctgaggcaggaggatggccaagaatttgaagaaagcctggactacataacaagacctcgtcttagaaaaatcccaagtaaacaactaaaatgtcagctggaaggagacacagccataaaagtaacattcctttatccctacagcagctgagacccagctgatgtcatagagtctggacagcctttccaaagccactgaaaggcccaatctgtccctgtcctcaccagtcaatatttggaaagcatagaggggtggaaacaggataaaaatactcgactctggggtgcccatgctcaggcaggccggaagcttcagagtgcacgggtgctttgggacccaggtgcaaaaaggtaggaactaccctggcagccttggtgattccgcggctgcacttaaccaagagccaaggagtggggatgagatcagctgttctcttggctcccccttttggaaggtgagtggtctctgccttccacctccgcaggcctgcaaccctttggcactccctgacagtgctgatataggggagtttcccctgtccctccctcggtcagggtcagtccccgccaggcaccctaagcaaggaacccctctgcctcgctcgagttcccggggatctctctgaatccccaccgcaccattcacctgttggggacgctggactggtaggtaacagcctggtactttttaccttccttccccactgggccatttttggggtcttagagatgcgagtgtatgaagaatgacactcgtcgcaggacctttgggaacgtgtaaggcgcacacattcagcactagaggaaagaaagcatcaggttgtttcttccgcaagagacccccagtgcactgcatcggcttcccgccagactctgtgcagaggtggagctgggaagtggggtgccactaaacggacaactgcaatttgcaacacccccggacacaaccacaaacaccctcgagctcctaggacacagagaggcggcgacatgaaagcagtaggtcccccagctttgcagaccgagttcgaggctccctggctctagcttcagtatgtggacaggagggtagcatactcggtcccccgccaccctcggcggggcggggcggcggctgctattgcggccggaaggggtgtgggtgcagggcgggtcccgcgccgccccgcccagaggacggagccccgggcacagcatcctggcgcgggcccgggctgccatagccactgccgtcggggaaggtcccagcgtggtcatggcctcccgaggggcccgccccgccccaagctcgcagcactccacacagtagccttgaggagaagcgacctggacgtcgcggacggccgggcaggcagcatggaggaggcgcacctgctctccgctgccgacgtgctgcgtcgcttctcggtgacagccgagggcggcttgagcctggagcaggtgaccgacgcgcgggagcgttacggccccaacggtgagcgtgggttcctgccctgcagtggggaccggttgtcccctcctgactcggcaggaagccgggctcagtaagcctctgcaaatgcgcgtggggcacctggtggggcctcccggtctccttcgggggaagaggaggcaggatttggctctccactccccatctcgatgcacccctgcaatccttagcccattttatcccagagccttactggatgcccgcacctgctgtgcgatctgcggacaccctgcaagtgcagacgcttgaggccctctagccagcgactccgaggcccaacctatcagggggttccgatgtctccccggaaggttcactaaggcgcccaagacggtgcagcctgtcagctgtcagctttggtgctcttaaccccagtcccaggtcttcctctttctgcaaccccaagcggatgtggctgccgggagttgatgtgggtttgaactgctgaggcaaagacccaccttcttggaggggcaggtcggaggtctggaggagtcttttccccagctggtgatctggaatggtgcctgccccatctctggggaccgaggtagcccacgtactctttcagtttactagaggcatggcttcctcccctctgtcaaggagcatgggattctccttcctgtccaaagtcttgcctggccagtgccagtagaccccgtctagatgagccccacacattgttaggagcgtgtagtgtggacatcagaggttccctgcaatgtcctcctgtcactcctggctcagggccacagcacctgtaagtcttgaaggaaaggggggagggggagagagggagggagggagggaggaatctaaaccttaatgagactcaagatcaagtccctcatccacctcttggcccaactggagccttgtcacctcccttgaaagccctcactacttccttctgttctttgaagggtagaggcatcccttcagctttgccattttagacatctgcatgcatgggtttgtttttcttttgtaaggatttcagttttcacaacgacagtgaccaggacagccaccaccactgcacaggaagaaccagtcccagccagtaccatggggctccacactctgaggtttcctccccagaaggaggaacaggaatcatacctgcccatcttgcattagccttgtgctcagtcatggaagacattgtctccctccctacctccaattctgaacccaggaactgtggtccagaagggctctctagacagcaagaatgagaaacgcacaaagaaagaaaagccaaggtagagggtaaaggctgtttgaggaactcaaaaagagaccaagggcctttaaacagacatctagcaatgtctggagacacactggacannnnnnnnnnnnnnnnnnnnggagagagagagagagagagagagagagagagagagagagagagagagagagagagagagagagagagcccaaccactccaaacttctatctttttggagagcccctcacccttgagagttgccaggtaccagaggaaccatgctctggcctgggtgtccctctgctccaggcagtctgggaagtaggaagagctgtcagaagggatgctttgggtttgtattggtttatgaaaaccacctcttatgtaaatattatctttctggagcagaaatcctttttcaaaaaaaattagttgctatatttagttgagctgtgggaggaactaggagataaatattatttaatatcccccattaatgacttggcagtaagggtgccctttttctgaagaaagacaggggtagcagggtccgtttcaaccctgagggaggggaaggcgggtctggggtctgcagcctacttgatgttactgtggtccttggttcccatatgatgttggaggctcagcctttagttctgtcccaggtcacactgagcttgtccctggagggctctggcctagttcactcttttttctggctcatgccttcattggttcagaagagataactgggagagagggagcccccagctcccttgtgccgtggtgaggggatctcaggtgtgtaggtatgtgtttgatgatgggagaggatactggcttggcatgtgacagagcaggcagaaaacactggcaggggtgtttcaggtgcctctgcattgatgctgttactagtaaaagctctgacttcattgagtaactgcttcgtgtcagaagcagctctcagaacttctcatcaattagctcatttcttcttccaaacagctctgaagtaaggactttgtctccccgtctcaccaaggaggtgaatgagacactagaagcttaagtatcttgccaaggtcacagttggtggtgggcttggtcctggggcctctctttagtttttcctgtctgtatcaggcagccacagtttctgtcctccagggctggcacctgtgctagatgttagggttgtgtgggcagcaactattgctgcttcttttgggcctccgaccttcgggcccctcccatcactggcttgtttctcaggaagctgtccagggctctggaagttgtcaggtgagcagaggggaaccagctgtctctccctgactcctgctctccgcttgtgtgttggggttggggagtgggggtggaggggcttgggtgtcttccagtctctgctcagcctctggagtggagcagataggagtgaaagctctaactctgctctgtcctaaacaagccacttggacaccctgcggtggcttccttgttatgaggcgacagtagagcccatgtcagggttgtttgtggccacttacatacagtcatcctgccttgtagccaggaggtggggctgagctctgggccagaagctgggtgataggatgggcagggtatgcaggcaaaggggacaccctagggactagtgttcccccctaccctgggcagctacacacctgcaaggtcgttaatgctggaaaccacaaggaagtcatttgcttaagtcctccaagtttgcaaattctgcttggggtggagaaatggtgggggcactggggagtctctccctcccaactccccccttccttccctgagaaaaacctcaaagctaggtagaagcctcaaacacctatgaaacagaccagccaggaggtccgacacacatggaaacacgccagccttagtagctctgcaaccctgaaacttgtggtcttgcttcagtctcctgagtcttgtgccaccagtctcagcttgattgatgttgtttttactggtgctcaggattgacccagggccttgcacacaccaggcaaaccttctaaccactgagctatacccctaatcctaaatttattttattttatttttaataaaagagatcaaaaagtatacagtaaggcctccccatggatacacatggggggggggctgaggaggggcactaggatccagggtttttgtttgtttgggtttttttgttttgttttgttttgtttgttgttgttttacagaaaaggaggtggcctgggtgtgctggtcctcatgccaagagcccctctgagcttcttgtagcttcacagggtctcagtgcggctggctgcagtttcttcaccctacttcctgggctgctgggtggttgcggcctttgtggcattgccaggagccttctgtccccatatcatgtctccaccatgagtgacattccaggacaagctcctaatggaagggtcgagcaaaacaggagtgtttatgcttttaggggctctggctaagctgctgtccacggggttgtagcattcaacctgcccacttctgacgcctagcaagtggtgtccaggcctgcatttgacctgggctgagttgatgggaaagttcctcttatttctcaccttgtttgtttgtttgtttgtttgttttttacctattttcaagtcaagttcggcatcgttggatgcttagaagccgtctgacgtctgtatgatctcagcctaggccaaggctggagactagatagtgctaggctcatcctgacacaaacatccacccttggggaccctggagagctgagaatgttgggttgggcaaaatcccagaactcaacagtgcctcagctatgaccttgttttctgccttcagcccaggccctagttatcaccagaacgggaaacctatatgcatgacccccagaaacaagataataaggacagggcaggtgtggcctcacactctggctaacttctggcatacttgccctttctgggtcccagtgtcttcagaatagcagagatatgaccgccccccacccccaaccaacccatctcctaagcgcctctcagtgttgaaactgcctctgctgggtgctatgttgcctgcagccattgtgggcttcaccctagttgtcatatctcctggctccttactgagggctgccaagctactgtgtcagtccggccccatcagaacctctcactcctgtttaccctgagcagggtggggtctgcccagtgatacgacaagacacacgggttgacaagcccgtcgccaccagctccgggtaggctggggtgccctctgcagcacaggagccatctcacccttggtccctcacaggtcccctcagagccaggccaggctatccactctaggtggaccctggagacaggacagagccaggtgggttgggcgggccctgcagagctagaacctctccctgcctctgcaagtgacgatttaattgctctgtaaatttgccttggaggaagaccttggtgagtgcccgcctctcccagctggaactgacatttagaagccgaaattccagttttcagtgttgagagaaggaaggagtcggagggggaaattagaggagcaggtggtgtgtggagcgtgggggggggtgctggtagtggggggcagcacagtggtgtacctggcgctgcaccctcctgggtatgggcagtaggcccacgccctggcctaagcaactaaataaacaatggccctgggggcgggtggggatggggtggtggcagtgtggctctaggggtggctcagcctgccttggtggctagaagcccagtactactcctggccagagagtggtgtactaacaagggtagggtgagagggcccctgccttcttagagtcttgatgaggtgatgagaaagtgtatggagggaaacagaaggtggtagccctcatggggcctcttgcttggttgtagagaaacaagcacctcagataggggcgacactgggacaggtggggaagatcagcgggagactcagagcctgatcttaggttcttaagttccaaacagaacagaggaagggctccacgctgtgtgccaggcgctgttctgggtgctggagactgctgtggcgctgacctttggataactgtcagtatgttgatgtctggtgactgtgctacgtccattcaggagtttttggccaatcaccaagacttcagtcagactcaagagccattcctatcatgacagcctttgtgcagatggggaaacagacacggcccatggggcttgccagggatttcggcacaacacgaattagagcaagatttgaactcgtgcccttgggaccaaattccatgttctgagtctctttgtgtgagagtgtgagactcagggatagagtggggataggatcctaccgagttactgcctttgttctgtgtagctgtcagcactgtgcgggacagggcaggcatccctctatttgcaaataggatgtctgtaccaaggcaggcctggcagtgcatcagtcttcaggatcagttggggacaggtaggagagccagcatctttctcctcgatggggactcttccagacctgggcttcctctgtgaccctggaacttactcctgtgaaatagagaatcaggtccaccagggtcttagtggaatttagagtttgaagcagaccagacttgaatgggcaggatgttgtggcccccaaaaccctacctgtaaagacagcagaccctctgggagcaggtgatttggacagatggatctgagctcgctacaaaggaaaggggcatcgaagtaaatatgcaagatcccaaggtctttcaggtggccttgactgagaagttaagggaccagggaaaagaaggccggactgcctaggagttaccacaggaggcccagagcagatgctgagggtcagatggcctgggtgaagaaatatcccctgatactacccagctctgatcatgaagttgcatcgcagcctgtctgtgctcaggagctgtgacaggaatgacattagtgtctcctcaagctgaataagaatcctagagaatgacacagggaaaagggtagcaaggcagctggtatgctcagtgctggctactggaccggatatgcaggataccttgcaggctgcacatcggtctttctgtttatcctctggacaaagtgtggtaaggctacctgcttggtcatagtaaatggggagtctgtcattgatagtaattgtcccggtagcccttcctggtagctgtggagactccatctttccagtgggactcagttgctcgccggttaaaattctttgtgccctgggcagggaatggcatggccttccccctgaccactgagctagccgagccttcctgggagtggttggagaatgcctagttataacagtagagaccaggcattgcattaacaacgcccaaatctcagtagctagccaggtacagtggtccacatctggaatcctagcacttgggagactgatgcaggtaggtcatgagctcccaggaccctgggctatacagagtgagaccctatctcataagcaaacttaacaagaaagcaactccaaacacaaccccctcagtggcctgagaggacagaggctcactccctgctgtgtagggtggcaggttgggtatctataatacaggatgacaaaccacaccctgacttgtgggttaccccactatagtgaagggtcagtatcccacccccatgacagcattgggtaggatgctgaccctcagtttaaatgagttaagtcaataaaattagaaatgtcaccctcagccacattatccacattcccagagctcaatgttcacacctggccagggactgttgttccagaatggacagagactccattcatcttcacagaacagtctacgggacagtgatcccccctagagagtcttgcactgaaaacttagtctgtcaactgggaactaacacacatcctttttttagaagctcttctgggctgaggagtgcagttaccttgagggtgtgtgtgtatgtgtgcatgtgtgtatgtgtgcatgtgtgtatgtgtgcatgtgtgtatgtgtgcatgtgtgtatgtgtgcatgggggtggggtgggggaacagaagtatatggagaaatgtggtgactttaaagagtgtgggtcgccgggcagtggtggcgcacgcctttactcccagcacttgggaggcagaggcaggctgatttctgagttcgaggccagcctggtctacagagtgagttccaggacagccagggctacacagagaaaccctgtctccaaaaaccaaaacaaaccaaacaaaccaaccaaccaaccaaacaaaaagagtgtgggtcactgtgcttcagggaaccagaggaggggggatccagtggacaaggagaaaagggaatctggagagatgccctagggcgggcagaaagcaacctgaagactagaattggtgtgtgtaccatgtaccccaggactgatcctgaccaatgtatgtcacaaggagcatggcatcctggggcagcggtgggggttgaggggaggggtttgcctcacagcaaaagactaaagaaacagcatgagaaagttagatcagactgacagcccttctcttggccatgagccttagtaaggcgagagactcctgggtagagcccagtagaagctgctgatatgtgctgtgaggtgggcactgctttgtttgatgcaggggcatggataaaatgacctctaagggactctgctccattgaaggactggcccagaaactgggcctggattcccccctgcctttcctgttcacttcagctaaatagatcagaagggaaagtctgtttgattttaatctcaatgcaggacactggagattacattttccgtggaaaatgtcagccattgcctaaaataggactttagagaaaatgctagaaagtgtatttttaggttatatgtttccctcttggatccctgagggccactggctgcttgctgctgtccctggttcagctgacaggtgcagaccctaaacctcccctgtgcacggtctgggaagagttcccacaggaaaaagaagtctgtgggccaagaacatgtggacagatgtgaggaactgggccatggtcaggaaacagaacggagaggatgggagtctcagagtctgcagtacggatgggtcctgggtgctgcggaggaggctgctaacctttgatttgtcaaggactgaaggagtcaagttcagaaagattgatcacatgggggcttcagacagcttcatctggagaaggactctgccaaagaggggagtccctcagagccctagctctggggtctagcctctgccacctgtacgcagacacagacacagtcacagacacagacttggtgtggaactttgttccagctgcttgtcccactccaatccctggcccttatatatgtgaaaaagccctggcacctccacatggctctgtcagaggctgttgggaaaagcttaggttcccaggtacccaaagcagccagccagtcattttacagctggcataaaattaatttaagaattgtaggtggtgaagaagttcggcaggggtgctggaaagatggctcagcagttaaaaaacactggctgctcttgcaggggatccaggttcagttctcagcacacaactgtctgtacttctagttccagggaatctgacgccctcttctggcctccttgggcaccagtcatggatgtggtacacttgcaacattcttacacatagcaaataaaataaaaattaaaaattaacttttaaaagaagtttggccagtaagctgaggcaggtgctactggtgcttagagacagggttcttcacagtgctgtgtgggactggacacgtgagggccatcttccttgagtttgtcaggtatttagaaaagctaggggtgtccagggaggatgggtgggttgggttttaagatggcctttttctgggcattatgagggacagagtcagatgagctccaagaacctgttaaggcagggcagttccggccaggtctggcaaccatacaaggaagatccactcgatgatgtctcaagaactgtggactcggtgaccttggactctttctcttctccaggcctcagtttctcttctgtgaaagggggcgggctggaagtcccctccccttctgggctcatcctaaggtgagccaggccacattggaccacttaacagagctgggtgggataaaggatagcccttgagtttgaacgtcgattctgtaacctcagagctgagaggacacatgagacactgtggtgggcccagtgggctcaacgggaggggcttccagacgctggaagatcctactagtaaccagtcttctcctgtctcttcctgttctcatggctgcctggatcctgcagagctcccgaccgaggaaggtgaggcatgggtcggggaggctgcaggctatgaaacccttgagctagacaccttcaggctgtgacaccccatcccagagagatgtcttgaaccctcagctgagcccttcaggacttcggacttttcctctaacagggagagggtccctaaaagttcctaggtgtgagtggagagggtgatgggggtagaggggagatggccagggacctgggcctcactctctcctattccagggaaatccctgtgggagctggtggtggagcagtttgaggacctcttggtgcgcatcctgctgctggcagctctggtttcctttgtaagtaacccctccctgccatcctgtgaggtgaggcaggtcctgacagttctcagggccataggctactctcctctcagtcatggacactcctgctcccctggctcccacctaaattcctctaatccatttatagatcatttataggtcagcctcagcacccttgacatttgaaccaggtggttctaggtgggggtggggatggtctgatacactgagcatcctggcctccctatcaggtaccagcattacctcccagtgatgtgtccagtgtgtctccagacattgctagatgtctgtttaaaggcccttggtctctttttgagttcctcaaacagcctttaccctctaccttggcttttctttctttgtgcgtttctcattcttgctgtctagagagcccttctggaccacagttcctgggttcagaattggaggtagggagggagacaatgtcttccatgactgagcacaaggctaatgcaagatgggcaggtatgattcctgttcctccttctggggaggaaacctcagagtgtgaagccccatggtactggctgggactggttcttcctgtgcagtggtggtggctgtcctggtcactgtccttgtgaaaactgaaatccttacaaaagaaaaacaaacccatgcatgcagatgtctaaaatggcaaagctgaagggatgcctctacccttcaaagaacagaaggaagtactgagggctttcaagggaggtgacaaggccccagttgggccaagaggtggatgagggacttgacctgagtctcattaaggcttagattctgtagtgggaataatgttcctctgaatggaggaccctgaacctgaacactcaccaaaatcatgaaggcttgttagtgatttctgttcagtctatctgggctgggctgagaactttggttctaacatgttcccaggagtatctggggttgccaattgagtaccatagtgaaaatcagagaagacagggaggggtctccagctgcctctgccccctcagaggctggtttggttgggatgagggctgtgtccatcacatctgtaaggtgggcattcttcttccaccaaggttatctctctaaggccccaggggaatagacagaattcagagactaaaagtcaaggggctcactcgggggggtggggggggagagctcctaacacagttggactaacagctctgaccctgcaggtcctggcctggttcgaggagggtgaggagaccacaacggccttcgtggagcccctggtcatcatgctaattctcgtggccaatgcgatcgtgggagtgtggcaggtgggaggagtcagggtgggctggctctggggtctcccatcagcaggtgggcttcttactttcaaatcgatcttaggctacaagagttttactctcaaggggaggtctcctgaggcagcaaagggggaccacctgctcgcttctatcccacaggaacgcaacgcagagagtgcgattgaggccttgaaggagtatgagcctgagatgggtaaggtgatccgatctgaccgcaagggtgtacagaggatccgagccagggacatcgtccctggggacattgtggaagtggcaggtgggtatgtccaagtccttctcttttcactacgtgactccagggagccttgtttctctctttgcttccatcttgaacttcagaggagtgactgttagaacctccctaaaccctgttggacagatcgagagaatgtggccagagtggctggggtctgcctgaaggatcatacatagctcaggactccacctctggtggagccttgtctctgaaagccttcttggctttgctggggctagggctcctgaccactctcagccctgctgttctccctgtacagtgggagacaaggtacccgctgacctccgtctcatcgagatcaagtccaccacacttcgagtggaccagtccatcctgacaggtgagccccaagggctcaggtaaagtggtggcggggccaggtgatgggcttgtctccagggggagcttctcatatctcatcctgcaatcaggggaatccgtgtctgtgacgaagcacacagatgccattccagacccccgagccgtgaaccaggacaagaagaacatgctattttctgtaagttttggggatgcttggagctcagcctggaaagtaaaactagtcccataggagccgtggtgcgatggctcagctgataaaggtgcttaccaccaagcctgatcccagggctcacaggttgaaaggggataactgactcccacaggttgtccccaacctccccactcacatggtggcatatgcatgctcacctgccacacatataaaccaaaaacaaatgtaatgcattttttttgtttgtcactttttaaaaaaagattaatttattcattgtatatgagtgcacactgtagctgtacagatggttgtgagccttcacgtgaattttggaaattgaatttaggacctctacttgctctggtcaaccccactcgctcagtctctgctcactccagctcaaagatttattattataaataagtacactgtagctgtcttcagacgcaccagaagagggtgtcagatctcattacaggtggttgtgagccatcatgtgatgtggttgctgggatttgaactcaggaccttcggaagagcagtctgctcttacccactgagccagctcaccagcccttgtttgtcactttttaaaatgtatttttatttagttttttttttgtgacaggatcttactatacagctctgtgtatatgtgtatatgtatgtgtgtgtgtgtatatatatatatatatatatacatatatatatatatatatacatatacatacacacatacacgtacacatacatacacatactgttgcctagaactccctatgtagaccagttagcctctaactcagagatccatctgcctctgaatgctggaattagaggcatgcaccaccatgcctggtatgtatatatatatatatatatatattacattttcaaagtcctgtagcaatggacctcttggttattggtaacaagtgcaaatttatagtaatcataatgtttgtgttttctgagccctgcctgcttggcattcatctaagccctttaaacttgatagcttatttaagctatacaacaagcttgaaatcaggctgtctgtatcttgttatctatatttcccagcaaggaaacaggctgggagaggttaaggcagttgcccaaggtcacagtgaatgagcaacagagttgaggtgtgagctcagacatccaggccttagggatttctctttcctgctaggacactgtgcctccaactggagagggtcagtgccttaagtcatttagttgaaatattcccgggcggagagggtaacagaagtgacagagggagctacaattcagctagaccgtgttccagcacaccaaggcatagggggctgaggagcacccttggaagtgaacaccatgggtcctcagagctcctcccaagagccctgcctgagttcagggcagatgagctgctatgaatggggagggaggtgtgacacacataggggtgtctgtggcttgctgtgggtctttgctttagttgtggttagctagcagggtaaggatgcgttgctctgcgtgaaggaaaggcagggttacctgccactaacacctgagctcttaccatctccacatccatccaaaggagcaccaggcagccactaaggagactccatcttgggcctccatacgggcattttgaagaacagggcactgcagtacaaggctacctgtcctctatactaggggttgagttttttgcccagggccttggaaatgtgagtggcaagcctcaggttttgtagactcttgagtaaatatttgtaaactacttgcctgagatcattgtcagccacactctttcctgtgtggccatagtgactttttatgagtcctattttgatgggttgcatgggttgggcttgagacacatggctgatatcagacctggagcctcctttgtgctgggcactatgctaagcccaggacatgtggagaccctttaaattcttgtcttcattgaccaacgtccaataaataccacactgcataagtctagaaagactgaccacacagaagagcctgctctggtttgaagtcagggattccaggccctggccagaggccaagcaaacgactttgtccttctctggtcagggcaccaatattgcatcaggcaaagccctgggtgtggctgtggctacaggcctgcagacagagctgggcaagattcggagccagatggcggctgtggagcctgagcggacgccattgcagcgcaagctggatgaatttgggaggcagctgtcccatgccatctctgtgatctgtgtggctgtgtgggtcatcaacatcggccactttgctgacccggcccacggtggatcctggctccgtggtgcagtctactacttcaagatcgctgtggccctggctgtggctgctatccccgagggtctcccagcagtcatcactacatgcctggccctgggcacaagacgaatggcacgtaagaatgccattgtgcggagcctgccttctgtggagacgctgggctgcacctcggtcatctgctctgacaagacggggacgctcaccaccaatcagatgtctgtctgcagggtgagtggcagctggggtgggtggggcctgctggccatcaggtaatgttgggctgcctgacctttttgaggggtaaaggatggagaacctgtgcaccgtctcccagttggcagtggggagcagcagatgaggtcttccatgtgtataaacactgcatcagtgcttgccttgctatatccctgagtctctgtgtcactgcgggtatccagggcaggtcatttccagtcttggaccttagtctcctcatctgaaacctacatctgagccctgccaggtgactaccttaaggatccaagagcaagtcaagtgcagccctcatgtcattggacccagattctatcctgctctggcttgtctgtacacctgatgcctgtcaccagataggctggctccagtgacctaggaaggactatagggcagcaattatttattcctgggcacttgatcccacatcccgggtccactgtccatgtgttcagggattctggctggaattccaggggacagaggtccattctagctcagcctggagagctgggaaaatggtgactgttgtgggtttcacacctccccaggtgctcatcctgccccaggcttctcctgcctctgctctcacagtctgcctagtaggccctaggaactggctcaggactcgagacattacagccccatggaattccaccagagcctggcataggagagaggcatgagcaaggtctgctggcctgcgtcctctgactaaatcctagcaggattttaccggttctgtgttccttgactcaaataaagatccgagcatggtatggggaagtgccagtggctgagcatgctgggtaatggatcctgcttgttagaagactgtcccagaacagagaggacaagaaggaagggatggcacggagtacctcagggtgctagactggtcactggcttgagaatgagctgcaataaatcggtctcagctggctgatggaccaggaaatggactgtcctgatgggggaaagggcaggtagggactggctctgagcagagagtcattctctggggtcatctctggatgggaggaaactatctcagagcaagatgcgtgtttcttccttgaaggtagagaagtttttgttcagccaggttctgggcccactttctccctatgtcactggtggagaaatgaaccttaaacaattaaaaagggctgcacaaagaggtgaacaagtgctcaggtatcctgctcaaccagggacctctcgtgttggcagcggtctcaggcactgaaaaatgggccacaaaaccctcaggagtcccgagcaaatggacactgagagcctggtgcctctgggcagagccgcatctcaggtgcctagtctggaccctacactcactctttcagcctagtggagaagaaagacccttcggtgattcccctcaactgcctcagatatcctcctgggtcagacttccattaacctgagcccacttttgtgctcgcagatgttcgtggtggctgaagcagaggcaggcacctgtcgtttgcatgaattcaccatttcgggtaccacgtacaccccagagggcgaagtgtgagtgcgggagcgaggccaaggtgggatcaagtgggcggagctaccaaaggggccctaaggagcggtttccttgggggcggggctaggccctgtgctgatctttcactctctgcaggaggcaaggggagcagcctgtgcgctgtgggcagtttgatgggctagtggagctcgccaccatctgtgccctctgcaatgattctgcgctggactacaatgaggtttgcgtccactctttacataacctccccaggttccatttctcaggacacgtcacctttttcctttgcccagagtctcattatttctggttggtggtcttagctgcttcagtgggccatgttccaagaacatgatcacccctggacacccttacttccaaccctcttcattctgctcagattgtttctgtatccttgacccccgggtctcttcaggtaggagtgagaggctgccttgtaagcggctggaaggccagggatgctttggggagacattgggtggtggacagggcatgagtggactttaaagtagaaagcgtagcatggggaaggctctgcaaaatctagctgtgacacacattgaatatcatttgtgtgtctggagcaggggaatggaacatatgggaggatgctcctgccttccgggaacactaagccaggccaggtcagcttccatgctcagccaagggcaagcaggcagccactgaagggtttgtgcagaggactggtgtagccgcgttagctctcccaaagatgttctctgtagacagcagcacagaaggttacaacgcaggagccggtggggagtggggggagcggaggggtagatgtactcatataattccagcacttgggaggctgaggctggagagacagttatgaatctgaggccatcctgagtatatagcaagctcccatctcaaaataagtagagacagcaggaagccttcatatcctgtgcactgtgatcctccaggccaagggtgtgtatgagaaggtaggagaggccacagagaccgccctgacttgcctggtagagaagatgaatgtgtttgacacagacctgaaaggactgtcgcgggtggagcgtgctggcgcctgcaactcagtgagtagaacgggccttagccatggctgcatagccaggggttctggggtgtctggagatgtgaaagagaaaggcataggtttggggaggcttcaaggaaggatagaggacctggggcaccttgcaggatgagtctgtggagcagagagaggaaaaggctggctgtgcatacaggcttccagatgggaagtgcacacattttggtgggagccttgaatgccagagtcagagaagtatggagtgtaggtcaccgggaagaagagtcttattgagcgtctagtgaggagcaggcaagagttgtcagctctgtcctttatgcctggaccctgcaggtcatcaagcaactcatgcggaaagagttcaccctggagttctcccgggaccggaagtctatgtccgtgtactgcacacctactcgtgctgaccccaaggtccagggcagcaagatgtttgtgaaggtgaggtctgcctgtgtgacctggggtaactcttgggatttggggagtggagtggggtaggtgggaggcaatctggccttcagtctctaaaatacccaagggagcttagctcagttggttgattatttgcctagagtacaagaggccatgagtttgttccccagaacaatgtaaaccaagtgatgtatgcttataatctcagcacttgaggaagtagagataagagaattggtgagtttgagttcataaacttgggctgcgtgagagaccccgtgtaaaaaagaatagaaaggaaaaacagataaacaaaaaaacaaccaaagcccccagagtgcagccccagggaagatcagggagccgtgaggcccattggtaatgtgatgctgtggagtgagagtggccagcatgccatggggacctgagaacagcatccagtggtgaagggaccacactgccttatcacaggactctggggccactggtgctcctctccacagagaggtgccctatgggaatgacaaagttgcactagaatgtctcagaagcccttttgcctcagatggttggtggtgatctggttgctactcttgggaagccgagacctaagcaggggaaggagcaggtctcaacccagccttccagagccactttcaaacctgacagaaggatcccatccctagcttggtcctaaagtgaaggtgttagtccctgtaaaaggacagaacttctatcctgggaaccctggccattccgagaaggtagcccctgggtttttaggctacaggataggaagatgtcactggtggtttagccagaaagcaatcctagacccaggtgaggtccaaggtgagcccctgatgaaactgaggaatcagtcacccctccaccaaagctaccttgccagggtcacacctgccacactgcatgtcctctttcaagtggcacttagcatgcctccctgctgcacagaatgagaatcccattgctaccaggcaagcagggaggagacacaggttcccatgagagatgctgatcccacccagacatgcaaatgttgtagcaagccttctcatttgtgggctggtagagacgggagaccactggtggtcggctgtgaccttgccagcccggctgcttttctcacagtgaggtgcaccaggttccccctttgaacttacaaagaatggttggttcttcccttccgtgtgctctctttgtcggccttcatctgtccgtagtggcttgcagttttctctatggagtggcaaggaaggccagggacctggctgtgtagagttgactcctttccttccctctgcagggagctcctgagagtgtaattgagcgctgtagctcagtccgagtgggcagccgaacagcacccctgagcaccacttccagagagcatatcctggccaagatccgggactggggctcaggctctgacacactgcgctgcttagccttggccaccagggacacacccccaaggaaggaggacatgcatctagatgactgcagccggtttgtacagtacgaggtgggtgctgagagccgggttcctgcagtggctgggcacacaagagggcaaggatagactcaggttgtgcttgcctctgcctcctccccacagacagacctgaccttcgtgggctgcgtgggcatgttagacccaccgagaccagaggtggctgcttgtatcacacgctgttcccgggctggcattcgagtggtcatgatcacaggggacaacaaagggacagctgtggccatctgccgccgacttggcatctttggggacacggaggatgtgttgggcaaggcctacacgggccgtgagtttgatgacctcagcccagagcagcagcgccaggcttgtcgcactgcccggtgctttgcccgagtggaacccgcacataagtctcgaatcgtggagaacctacagtcctttaatgagatcactgccatggtgaggctacgggggcagagcctgggagatgcttaatttgattacagctgtaacctagtcttgctgtcaaccttgactctacactgaccttgatcttcaaatgtttttgttaatcacgtgctttaccattgaggtgaccccccagccctttgagcctcttattgtttacattaagcttaatcctgacatgtgtttgaatgttgacctggtccagaactgatcacagacactgactctgattcccctgtactgttcagttctttatgctgacgtcaatcttgacctggtctccaatctggcttccaaacttgatgatgatgtcactgatcataaggacaacgaccttgactccaacctctattttaatttgtaattttaccttcagcctgagttctgtctagaacttgtccttcaccttgactcccatatgtatctgagaaagctagcccttagtttgggccataaccattacctcgtctctggattgacttcagctttccccacaatctcagtctcatgatcgactccatatcgaacctgagtctcacacctgtcctcagagttggtccacctcatccctacccctgcctcatcatcatctgtagacctaggattgatcttgtccattcaccctagcctacattaatctcattgtcaaaccaatttataagatcatcctctctctcttctctctctctctctctctctctctctctctctctccattttcatttcaatacaggcttcaagctgatcttgaacttgtgattgtcctgcccctgttttatgagtggctgggactacaggcttactctcaaagctcattcttgatcccaccacatttcctctgtccctgtgtctgagaccttggggacatcccctaacactaggattgcttggggtaagaggacgtaggcaagtctctcaggtgtgtcctacctggcccggcccacagactggcgatggggtgaatgatgcaccagccctgaagaaggcagagatcggcatcgccatgggctcaggcactgctgtggccaagtcagcagcagagatggtgctgtccgatgacaactttgcctccattgtggctgcagtagaagagggcagggccatctacaacaacatgaagcagttcatccgctacctcatctcctccaatgttggcgaggttgtctggtgaggctccgtgctccctcctcccaagcccctgtaccaaccagctctgtccctgagggggccacccctgtggtacaatccagcatcctctacaaccccccccccccaagccatggtcttcctcttcatagcttcttccgttgagacccataagactggagaagcaacttcaccacagggcaacagggtgtctacatgtatgcatgcactgatatgtgtgtgtatgtatagtgtgttcaggtgagaggtctatgcttaggaatgtgtgtgtgctctcatgcactgttgaatataaacacaaacaggatgtataacagagtgtgcttatgttcacatttctgtttgcatgggagagatgcctgttggatgtgtgaattcacatgtactcaatgcatgtggattctgcatcttcgcacttttgggccagcacatgggtgattgcttgtgtttatgtgtgacaggtgttgggtgtttgcacatctctgatacttgggcatgtggtatgtgtgcatacacccacctgtccttggtagtcctgttatcctcatgtccctcactcttgggctgcagaggaagctgaggagggcccctccttcagcctcgggtaagacctggagctggaccctctagtggtagctggcctgcctgggctagagcccgtgactctggttttagcatcttcctcacagcaattctgggcctgcccgaagctctgatccctgtgcagctgctctgggtgaacctggtaacagatggcttaccggccacagcccttggcttcaacccaccagatctggatatcatggagaagccgcctcggaatccccgtgaggccctcatcagtggctggctttttttccgctatttggctattggaggtgagcggggctccagccttcaggggcatacctaggtttgcaggctgcagataatgcaactcagccaacatctgctaatagactctgtgggctcacgtgactgaaaagactaggcacagcctatggctggatctgggccgtggtctggtctatcagcttctaccttttctccttcagataaggtctctcactaacctggagcttgccctttttggagggtgggggctgggggagggttaggctgactggccaacaagctccagtgatcctcctgttggtatccctacaaacccacagtcctggggttacagcacacatagtcacatctagccttttacatgtgtgatgggaacccaagcttggatcttcagttgtgtccactgagtcatctcctgagccctgggagacggtgggttaatttttataacagtcacagacctgtttttattagtacatattggatcagtcactatgcctaagagtatggcctgccaggttactactgagggcctaccattggcacaggatagatgttagcataccatggcttagggaggggatgattgggaaaggggcatgcatagctaagaacctcacctgcctactacagcgtcccctcttcccctgcccacagtgtatgtaggcctggctacagtggctgccgccacctggtggttcctgtatgacaccgagggacctcaagtcaccttctatcagctggtgagcaagtagagaccagacaggtggggctctggattatgaggtcgagggagttccagagagagactcagcctccgaaactggcctgcagctctcctttcccatctccaggtgtgaacaccatcctccaagtagcttgcttggccctggaaggccacagggccagcacagcccccagctcaaggaaatattattctctgacaatcatttaaggggtactaggtatcttacctttacctcagaaccctgaaacattgagggcccagaggtgtgagccctgaaatggtgggacttcgggctgagggtcaaactgaagagattgaaggaagagagttgaatcacccacatagtatttctcagatgggacccactgacctctagaatctcgtgactggcaggaacctacaaccacacagcacagtgtggagcagccttagctcagttcaactctggaaaccagctagacccctctcagctactgtctgtccttctggccctttgcttgattgaagcagacattacagaacaatgtacaggggattgctaagggagtgttgctttccttagagcatgctacctacattattggagaggatgcagccccagtagccatgttctggctctggcacccagcagccctcaagcccatgagtccatccaccatggtacagagcatagccctgcctccttcaaaggctattttctctcttacctcagccagggatcactccatccttgatcattccagcatctctggctcccacggtagctttgggctgtgcctccacacatcattgtcttcacctttctttagatcaggagtgctcaaccttcctaaatgctatggctgccgcccccctacccacgttttacagaattatttacttattttatgtatgtgagtacactgtagctgttttctgacacaccagaagagggcatcagatctcattacagatggctgtgagccaccatgtggttgctgggatttgaactcagaacttctggaagaacagtcagtgctcttaaccactgagccatctctccagcccactgtgaccctttaatacagctccttacattgtggtaacccccaatcataaaactactttcatttctacttcataactgtaacttcactacggttatgaattggaatataaatatctgatgtacagatggtcttaggtgacccttataaaagggtcattggatgcctcccaggggcgtcacagcagcccatgggttgagaacaaggatctgtgtagatctttgctgctttagaacgtggatcccaaatctctagggatcgcctttctctcttctgagatccaaccctataaatgccgtttccttcctctgagattctcacaggcctgtgaaaacccagtctccccacaatgatctctcttccatctcctctcagatccactgtctgcctggtcattgaagctgacacctaagagtcacattagacatctccttaagtccccagttagcctgatgggatattttcttctcagcagtccttagggtcttccttttctcattcagccacttggttgggaaatgtccatcaaacaccactcactgtggcttggccacaaataactgagtgtggaagtgctagtcagagggtctctacaaaaaactggcagtctgaggaagtctgatggcctgaggaagttgagactcctattcagggtggcaagtttttcagtggggagtttaggcacaccgtgttttatttgtctatgtgggtacatgacattaggtgtcttccttgattactctcaacctaattttcttgagacagagtctgtcactgaacctggaactcatagattcatagatatacctaagcaggcggtcagtgtgccccagaggcctgcctgtctctgccatctttccagccttaagttgtcagatttcaagaaagggatctttggggttactcccaaaagggaacactctgattcatgactttttaaaaagattttgtttgtttgtttttaagttcgtgtgtggagagtgttttacttgtttgtatgtctgtatatcatgtgtccctggtgcctgcaaaggccagaagagggtgtcagattcctggaattgtagttaaagttataagcttccatgtgggtgctaggaatcaaatctagggcctctggaagagcagccagtgctcctaacgaccagggtattcctccagcctcctggttcatgacttcttaaactttttttacttgaaaccccttcttacccaagaaatttgtatatggctgggcgtggtggagctcgcctttaatcccagtacttgggaggcagaggcaggtggatttctgagttcgaggccagcctggtctacaaagtgaattccaggacagccaggactacacagagaaaccctgtctcaaaaagcaaaaaaaaaaaaggaaagaaatttgtatatgttcccaagcgtatagctataaaaatacatatacaaatcaattacttgttaatagtaaatcacaaggaaatttattttaaaataattatgccaactaggaccttaatcccagcacctaggaggtagaggcaggtggatttctgtgagtttgagactagtctggtctacttagcaagttccaggccagccagagatatatagtgagaccttgtctcaaacaaatcaaaagcgggctggagagatagctcagcagttaaaaacactggctgctcttatagaggacctggcctagatcctcagcaaatgtgtaacagctcacaacagcctgcaactccaggtccagggggatctgataacctctgagggtaccagacaaagacactcacgtggtacacagacatacatgcaagcaaaacacctacacatataaaagtgtgtgtgtgtgtgtgtgtgtgtgtgtgtgtgtccaaaccagagctatagagataactcagtggttaagagcactggctgctcttacagagaacccaggttcaattcccagcagctcatcactgcctgtaattccagttccaggagatctgacaccttcatacagacatgcatatatcagtgcacataaaataaaaataaatcatttaaaaatcaaaaccaacaacagtacccagatctctggtatagatctaatttcaccattaaagagaaaagtgaggtgcacgctactgagctggaggtgtttgctctctgtttttatatggcctagtacccaggtccaggaaatgctattgcctggtatcaggctgggggtcccacactgatcagcataatcaagacggttgtactcacaggccaacctggtctacagattccctcactgggactctaaattgcgtcaagtcaacaattaaaaggaaccaccacacccatcctcagtcatatgaccccttaaaggattcaacccagtttcagaagctgggctggggctgagggtgtggctcagttgatacagtgtttgcctaacccgcaggacagtctgggtttggttcatgctactcagtaaactgggtacggggctgtaagctcagcttgtaggagggatgtagccaagccatagttgtcgatagggtttctcctgtgcagcagcagggctcatgcacagagccaagggtgcccatctgtctctggacagatctctctcagaggatttgtctctacagcactatgcgtgttgctaataagccctggccttaaagatcttcagatatatacttgtaaaaatgaagttctgtgcaggagacccaagtagactaatagttatgagtgttcacactcatcccgatagtgtgagagagaacgaggcggaagttctcccagacatcctcaaacatcttactgcaggagactctgagcgaggctagtgagcaacaagaaaggtccctggagatgtagggtgggaggagcacttccttttcggcagtgagagcttgttaactacagaggatgcatgcattaaggctgagccctggccaccattctctatgtcataagcagaaagcaaggagcaaaaagccaggtaggaatggaaccttgcatgatgtcagtgtcagttaaagagggttttgtctgctccagaggtcagttctatttaggcataattgtattgattgaaacgcacaattgcttcatgtgtttatgaggtctcttttggtcacctccctaacttctgcatttcagagtcccatgagtcccagcccagacccctcttcaaccccatggcctcctagtgccttccccagcctaacaccagctgctcccattctccacaaattgccacccaggatagtcaccctatgacccaatcccttgcagtactgagctcactactcatcctcggggggcgggggtggggagtggggggagaggcttccctctcctctgtccagcacctcagtaacagctgttcaccggggaccctatcaccttatcttcagaggaacttcctgaagtgctctgaagacaatccactgtttgctggcattgactgcaaggtttttgagtcacgcttccccacaaccatggccttatctgtgcttgtgaccattgaaatgtgcaacgccctcaacaggtaggctgggcagaggagtccaagacagactggggtctaaggccaaaagagaccagaattggattgagatccaagcagaatgaagattgaggtctctggaccagagagctgataataagttctgagagttggtggggctgggattcaggagagaaaggtctggggtatgatgaaatgtagattcaggacagagaaagtgggcccaagccctgagctgggcctctggggtgaatggggtgtgcagcagaaatatccaccctggttctacaaccaaggtagtgaggtgattgctgaggtgagtgggcccaccatagcctgacatcctgtcctgagtgggttgctgtgcccttcgtagcgtctctgagaaccagtcactgctgcgcatgccaccctggctgaacccttggctgctgggggctgtggtcatgtccatggctctgcattttcttatcctcctggtgccacctctgcctgtgagttaccgccatgcctcctccctccgaagttcctggggttacagtcatcaagtagtcctcagatactagaggtcccaactgagtgccaggccttcctaggccttgggcaggcgtgacagtagggacagatgtgtctagccatcattccacagatattcccaccttcaggggacagaaaaggtggagcccttttgctgaggggttggcctgggcctgagtggaagtcagggaaggattgggtgggcagggggatagcacaacctctgggaagcccagtaggcaaaggtgtgaaggaagggtttccaaggacatgcccatgaagagcccactggagtccaggtgagtgacaccggcagcctgtaaccgggcctccctgcccctaccagctcatttttcaggtgaccccactgagtggtcggcagtggggggtggtgcttcagatgtctctgcctgtcatcctgctcgatgaggccctcaagtatctgtccaggaatcacatggatggtaagtgggagacctggccccttctgcttcctccccagctacttcctgcctgcctctgctcccaaatccgaattgcactggatgcaaggtgcacggtaggagagttgtttttcaatcaggaagtggaggacataaagagtcctagtggctatgatgcaatgacttgcctggagaggtgtcttgcactgtaggagccttgactgggcctattgggaacactgctcagggccacgctgcctcagcttcctcacttggccataccctgtccccgcacaagccctcactgccccctcctcaccctgcctcacacacccatatgtggataagatgcggtggtagtcctggccttggcctctgaccctcctgtactggcctgtctttatccaggtgttctcgggacatttatgcaggctcggagtaggcagctgccgactacttccaggaccccataccacaccgggttggcttcttgggtatcattttcatgggtggaaacaaaggggaggatttgtcttcattcaggaggaatgaacactgacagggttaggtccagagaagaaagctagcgagctacagagagacctgggttgggctcagcaactagctaagacctgctttgggcatctgggactttgggggccacttctagttggaatgtgacccctgatccaggaaatagtggaggctataaataaacctcatgcctgccattccataaaggcccccacaccctcatgctaactgaatactttttttaaaagcctcaatgagcctctccctcttctctggagaggtttgaacagagaatggctggactcacagagcccatgagtggggctgatggcagctggactaggccattcaggtccctccatagacggctctttcaggctcaccattgaccctgggagaagcctggaagaagtgggtatgacccttgagcttctgagtttctggccagccagcacaggagggtcccccaggaagcccctccctccacactcagcccacagccaaactctcttgcgaagtgtggctttgagaaacagctagaggacatttttgtcttccttgagagacagcgttcatccctggtgaccacagcaacccaggagctcagcacattttcttgaagaaatttaaaaatgaaaaatttgtccccgtggctaaaatgtctcattcccttgggggagccctgtgtctgggatacaaatccatgctgaattcctgggctcaacaggagggggggtgatgactagatgtggggattagagggctgcccagtgggtgctaagggaaattactagaagattctggactaatgcaaattacatgggtaaggtagaacctggcaggatggaggctgaggtgtctataatagagatggtacctgtgaggggaagcccagggacactgaaagcccaaaacaccaagacgaggccctggttattctcagggagtagggaccacaaaaggtgtgtaagcatggggtggggcaggggagtgttgcaactgtaaagatactgacatgacactggaatagaagctgaaaagattgtgaggcctgaggaagaaaccaaatcccagcccagggtgaattggccccaggccacacctttaccaaccttcttgacccgaaatggcgagcaccatggtcctggagaagtttgatctgaaagggagtgagcacaggtcttcaggagggaacccgagctgggcacctgtggctgcccctggggagtggtgtgcttgctggaagtccagacagctcagccttgggccggcaggcggccgaaatcccttgggcctcctaaagctggacagggcgggggtgagagaggggaccctttacgttcccaagccagctcagtggccttttagggaagttttgctgaggcccaatgcctgtggcttctctgtaatttacgaggatgtgtcctggggagagttgtggatgcagggtcagctctgggaataggggtcctctctctccacacttggcactcttcaggtgtgactgagtggctgtcaggactgtaggctgggatggagaagccgagagggatggctctgggagagtccaaggtacagggcggacccagaattcctttaaggacatatgggccatggaaaggatgggggggggcagattgagggggtttgtatgatgccaacatcagaagggaggtaggtaggtgagatggaccgaggtgggtccttaatccctatatgggctgcaaaggtgaaggtcagcttgagtatattcagttgaaatcagaccacatgtgggatggagaagaggcaaggaggacttcctgcttgtggacctaacagtgatggagggcacccaccaaatagaaatataagagttttctttgggaatattgaagggacatagagagagcagctggattcctgggggctcaggggtgcccttgaggctagagatagaccatgtgtagaaggttctagaccctgaaaagtaagggagggtaagagactgaaacagaagctgaagggagcaatctaaaatacccactccttgtcttaatatgatttctcattttttgtgtatgtgtgtgtgttttcccccctccagaaaaaaaggacctgaagtaaatcctgggagcagaggggagtctccagtgtggccctcagactgagagcatccaggcatttgtcctgttcccacccctgcccccacactcagccacccgtctcctggaccctgctgaacataacaggccttaaacaggaatggccacctctccgtctggtcccaggttcccgtctcccatttctgtccctccctactgctctggcccagaagctgagtccaggaggggaagctaagaagccagagctgattgcagagccaccgcgcattccccaccccagctctgcaacctttcccccgcttggagatgggcgaactagtgcctctgccctgatggaggactcatgggggccttcttactgactctgacctattgcttagtttgggtctggagcctggtccgctatgggtaggaggagtctgagggaaccatctgggtccagctgtgaacacaaggagaggcagctccttccacttggctcagcttccaccaagtccactcctgtgtctgtttatatatgtgccggccggccccagggggttgaaggatcacaggcagataggaacataagaagcagggggcgggcctggacaatgactccctttcccaggagtgagcctgcgctggctggctgacctcagccctattcccacctttgaggctcacttcctcagctcaggttggctcagggtgtcctaattttaccgtctatgcccctggtgtctgagactccaggcatccctgggtccatgtcagcttctcctgccacccagcctggtgtgatactttgtcacttgctgcctggtcccctggcattactctttgctctgctcctcctagcatacattttttgagtcagagagatgtcactagggaagtgactccataagggacttcctcccctacctccccactgaaagaaagcatctcgtggggaatctatcagatgaacgtacattgctcttctttttttttttttctcttaactctgctgttgcccctttgacaaaagctagctaactgtcacaggaaacggagtaagtgtgacttagctcttcttgggtgtgtacaatatgattattttatatgtaaatcaagattcacatcactgtcctgacccccagtaacaaaagccccctcagcctaccttgcagacagatgaactccgtgtttggctgcccactctcctgcatctcctccccccgccccccgcaggctctggaggggcctcagagagaaatagagtttggagggatggcttggcaggagcagagcgctgtgcccacttgctgattgtttctgatggagaaataaaggtgtgtgtctgagggattggagctggtagtcttttctgagccctgtggggcccctagttctgtggctatggtgggggagtggggtgaagggggagggcatccacctggaattagcagagttaaaagtctggggtcccatcccaaagccaagtccatctcttactcaaagatggggctttgaaaaacactaagttggaatctcaagactggacccacaccccaatggcagaagtggggtgagcctgcccttcattggaacagcctgcttattgctccactgttagcagtttaaaagcagcgctcaactgtttaatcacatattttatgattaacatgtcacctcaaaggaaaaggagctgggggtggaatggaacccccttgtcccttggaatcccgggcatccagaacctgaccccagcaggctgttgcctgttaaaggagtgtagtcaccttcagatggatgagccacccatgatatctttgtccaacagaaaatctttagcaacatagaagcataaattatcaacacacacagctacatagatagcttaaaaccattgtgataagtcaaccatggcagtgcacgtctgaaacctcagcactaaagaggctggggcaggagagttgcagcaaaggtctgggccatcctgggatttgtagataggcaaatacctgctggcaattctgtagtgcccatgattctcgatagggtttctctcttgctatgtttccatcccgttggcttcagcaattaatcccatttccagtcctatgccctctcaaaggtttctacccattccctatgattctccccagctcctgcctcccaggcacatctctgtgatggtgcttaggatgagccagcctcctcaggtggtcctgggagacagctgtgagaagggactagccgtgtctctggagagaaggctcaccgtgaaggtttagcatctaatcctctacctagctgtcctgggatggagatctggatacccaggccctgaaacgcagggaaagaggtaggactagctatatcatctgcagagcccattgcaaagtgaaaacctagagcccccaaacttagccactgagctgggctgggttctagttagtaagataaaacagacaaaactgcccaaggtgttacaaagcagtggtagagcacattaaggcgggaaggaagaaaaccagaattccatggccaagtgtggggattttctatgtttgggcgggcatgttatctaaatcacgcatccatgaagctaattgtgacagagagatagcttacaccccgaggaactcccaaggatttatttttccagtcaaatggttagaagtattcttggtcacaagatgtctctaagttctctcaaatataagccctgcactcttaaggtcttaaatgagccccatgacatgggcatggacagcaaagactcacaaatggggaacctatgggctttcatcataatgataggttgccgagatgagatggtctaagcctaagggaacttgcagaacatctgtgtggccccagcttccccagctattccctatttctagggtgtggtggcctgatccattttgcctccacccccaccagggcttgcccaaatccatctctctccagcacacagcatggcatccacagcccaaggcaaggcggccaaggtaaacagagaggtttcctcacctcacccaggagggaattcccaggcaatcccggcatactcctttctggctccaaggtggcagctgccaagatgcccctaggtccccttgcttttctgggaaccaggatgttgtgctctctggggcccctctgccaggggacagggtagattgtagctgtattatgagacatataagaccagaatggaagacagaaccaaggaaggaacccgggcatcctgagacctgatcccaaagcacggaacaccggcatccagaacctgaccccagcaggctgttgcctgttaaaggagtgtagtcatcttcagatagatgaaccacccattggttcatttcaaccaaaaccattgtgataagtcagccatggcagtgcacgtctgaaatctcagcactaaagaggctggggcaggaaagttgcagcaaagttctgggccatcctgggctgccaaatgcaattctgtctcaaaaaaaaaaaaaaaaaaaaagaaaagaaaagaaaagaaaagaaaagaaataatcattgtgttggttgaaagaggccagatactaatagagctgtatgcttgcacctccctggagtttcacacaaggcaggataaatataaattatagcagatcagtggctgctggggcctaggtactgggagaagagtgactgcaaagaggtgggaggagccaggtgtgatggaacagacctttaatcctagcagaggctggcagatctctgagtttgaggctagccaggtctataggatgagttccagaaccgagagaccctatctacaaaaaccaaagtgtgaggggtcaggaagaacccttctaggatagtgggccagagagcggcacatgtatttgtcagaacttaccgaaatgtcacaagtagaagcttaaaaaggtgaattccacgtggacttagtttgatttaaaagaaggagctagcagtgcaacttgcctgccacatgcaacagctggggcttgatctccgtctccacataaactggactcgatggcacatgtcctaatcccagcacttgagaaatggaagcagaaggatccgaagttcaaggtcactccctagtgcagggtcaaccgaagatgcatgagactgtatcttaaataaataagaaagagtcatagaaatggttaagtgaacctgtgttgcccatggctgtagaggggtggcaaccttgagaactgaccaagaaacaagcctcttcagcgagcgtaatggaattgggaacagggacctatgtcagccagagccccttactattggacagaaaaggtctgtggagaaagacacagcaagaatggaggtggaccagcagaccacgatgccttgggcactaaggataggcgccagcctagttatgacccacagtgggagggaagaggtctggaaaattcagacaatggggagaagccaggcctggggccatggctggtacccagccttctccatagacctccccttgactattaggtcaagagctttgttccaacagcatcagagggccagttgggagttggggtaactccctgaggacaccagggcagacccatacagtgtgggagtcgaactgccagagaccctgagtgactaagaagataagtaggaatcaatgccactcaccctgttgaggactcaggctgccctccaggcctgggcactggctccaggatgggcactgaccccctccatacccacacagccgctaaatttagccaagcaggggaggctgtcctggggccgagtcgttggcagcagggccatgtctccctacaaggcccggcccagaactggagctggccacccggcctttgggcttataaggcaggcttggcagatctccagtgttggagtcttcgggtgggacctgagccaagcccttagactttggggagcctctcttccatgcacaagcaaactcaagaacttcttgttccatgacctttgaccaggtgttcaacttccagagccttggtttctgcatctgtataatgggcattctagcatccactttatagggccatagtaaagaaaaggtcagtgaactccattgtgaagaattctgacatgtgttctctccacctgtactaacaaagcctagggccaaaagatgtctgtccttaagagtgaaccagtgcaagagatgtgtgtgtgtgtgtgtgtgtgtgtgtgtgtgtgtgtgtgtgtgtgtgtgtgtgttactcgaatatctggaagtgtgtgcatatggaggggtgtgtgtgtatgtgtgtgtggaggctgcaggtcaacatgagatgtcttcctctccccatcttttttttttttttttttttttttttttgcaacaggtgttttcattgaccttagagcaccacatttgagcttggctggcccatgacctccagggatctgctgatctctaccagtccagcattgggttacagatgtatgctgctgagcccccatgaatgttgggaagccaaactcagttccttgtgcttgcaccggctgagccacccctatagtctcatgtggttggctcgattctgcagggttattatcaagaaaagaaagttgtgcctttggtggcaccttgggtctttcagtaccttcaggtggccctctctgccatgctgactgagaacagggctgatgcccagacacaggcctgagggtgtatctaacaagctataaacctggcttcttggggatggagtgagtgggggaagaagaggaaagagcaggaggaggaagaggaaacataaaaggaaagaggatagggagaaagaagaaaaggagaaagaaagagaaaggaagggaggaggtgaagtgggggaagaagaagaggagtatgggagagggcggctgtggcatgaagcaacatactggacaatgactgccttccttttcctttcttctctccatcctttctcttctccctcaattggagcaggtccctctctagaatatggcgtaagcatcgtcggggcgggcacagagatggctcagtcttagcacccacccattcctatcacacacaattcatttctgggcctactgctgtaacagctgcacgtgaagtcagctgggagagggacatgcccttttgtttggggtcagggtaaggtcacagagcctgctgaagctctgactccttaggaaaaaaaaagcgaaggatgtggttcccaccaccctggctcagtggcgtcagacagttgagagagttcctactggaatgtcagtgtgtgtgtgtgtgtgtgtgtgtgtgtgtgtgtgtgttttctattcaagaggttggggctggtcctgggtgctgggaggggacatgcagaaagcagcccagtttgcataagggttcggtgccaggcccaggggccattcgctccctgttagtagctcatgaggaagaagattccttatcagcactcagcgtgggtcggcttggccgggggtgcagagcagtgaaggttaccaaggagacctgtgcttcaggctggttcttctagtaggccagggtgagaatgcttccctctgaccctaggtgcacagtgtgagccagcctgatcaggttcttgggaccctatgctcagggtctgctttactattgaggaaggcaagggttgtattggacctgaaccctaattcaacagtgtattttagttctctgtcctggaggtttctgggaccgtcccccaagggcttcttcactctggggaaagtgttatgttgtcccactttacaagaagcagacttagaaaagccagacaatgcccccaagccctcaacaagtgacacaactgcctaatatcaggctttccaagctgggtctcagaactccctagggataggtgaccctagtctcgtctagatgtctacctccctgtctgttctggtggtaaggatgggatgggagtggtgtcaggagtacagtcaagcaggtcagacagagggagagcaaggttgcagatagagatgccagcctgaggctgaagttaatgggtatagaccaagcttggacttgaagggactgacgaagagggagtgtccaagggtagctctaggctacaggacttgacatcagttctgttcatcttcctgcaggtccccaggactgaactgtctactctgagactgtgggggtggggatggaggtagagtgttgagggattgtcctggcgagacccttcagttctgtcctgtcaggttcctggagtgggggtagccagtagctttatctctggccctgtggctggtggccatggtggtttccggagagcagctcctgtttccggaggcccagcagggcccaggcggagccttgaggggtagtggggctgggcctgggtggcctcactggctccgcctctgtctatctttgggaatttatttcacggggcaccactggccggtactccactgcctgccagcagtcaaaagctgctctgatcaccctgggtttttccctcctaacccagatcccaccaacgaacctccaactctggccccacttggcctgctctgttcttaaggggctgggaagcctccagccactccactgctctctctgtagacacagatgctagcctgcccttgaccacagaggccgtgcggggggcttgtctctgagccccttctggcccaccatggctcggcggctgcaggatgagctgtcagccttcttctttgagtatgacactccccggatggtgctggtacgaaacaagaaggtgggagtcattttccgtctgatccagttggtggttctggtctacgtcattgggtgagtctaagtccccctcccaacacctttgggcaccagtcttctacatgtgccaatcctcagagctctggggtacccttcatctctccaagcactggaaagctctcctggtgagcctccatgccttaagaaggaataggccctgttaacctactgtcaagatggagacaccaatgcaggataggacacgctactctgggtgcatggtgaccaaggggcaacaccattgtgggtcctgaggacattgtaaaaggccccttctagtgagtgagtggcacgccctgcaagagcccttttcacctccaactttcctcatgcaactgaaacaaagcaatgcctcattttactcgccagaacataggctctgttcccgtctctccagtcagaacaaaggacaacctgggaaatccaggtccctgggggactaaaagacaattggattctgaacacttagcatcttgatggagacacagagcaggaagtagtctccattcccaagtgtgacatctccttccctggcacagggtcagagcagcacaggtctccttcagctatctggctagcctgggaaccatgcaaaggctagcaggccaggcaggatcttgtgtttgcatgtgtgttgtgtgggctaacatggtattctatgactgcccatgtcctatatatttagccatgtaccggtggttttatatacctggttggctacgcaagcttacagctgtgtctctgtctgccctgggtctgaggtagctgggtaccagaagtgtcacatgtcaggagcatcatgcttacttacagtcacactaaaaagagcctctagaggctatgagatcagtaaaagggttgggtcctaatgggagcctgagaacgcccagtacccctgcctgcctgtgttgtgtggttctgagggctctgcaaatccccatttggggggactgggactaagagcccaaagagttactcatgtggtactagcctcttgggagtatctagttcctagagtagcctttcttctgctcactgatgccctaagattcagagctagtcaggtgcagccaaagccaggatccttcagctgcatttcaggctatgtcttggtcacaaatcaagttggtcaagcttaagaggaagactaaggcccatagaggagccctggaatttctaggtcactaggcaaatcaaccctgaacctttgctctgtctcctcatttcccactccctacaaagtttccaggaaactttctgatgggtaccagtagcctcctgctgagcacaagaggggcgtaaacgtccaccattaattatttgctagttcctcaggaaggagaagtcactactcaagcccagcctgtttctcacttggggagatcaaaatggttgtccctactcaggccccaggggctctctactttattttcagaactgtggctaggagcagtgtctgactgtcacagggacagaacaaaagggatagtctactgtccctactgccccttagccctgatctatacctcctgtgacaggaaccttaccccatccctctttcctttcttctggcctgaaatggtctatcattttcaaatgtttcaaatgtttcttgttggtgtgagggtgggggtatcagaggtgagggatgcaactagtcttgctaaaattcccagttcacacagcagagccaaaggcaaggtcttcaggtccccaaacccaggcttctctgcccactaactagggcgcttactagctccagcaatggcacctactgtctctgtcgccctcatctggccactgccagatgctacaatgactcctgcaggttaaactcctgagccttgctccactgttacataggacagcggttggagaggacctttccttgtgaagggaaagggcttcgctataaggatcctcctctttcctagatgtttgtctggtcctgtgggggctgcagggaagtcgggggtgggggggacgagagagtcagtctctgggcaccagacaaggtgaagcccacattggggacgggcagcatggaggtggagagggacacaaagtcaagcattggaacacagttctgatgaaagtggccttagacttaggcaggcaggcaggcaggcaggcaggcaggcaggcaggcaggcaggcaggcagacaacagacaagaggctgagatgccaagatctggaacaggctcagaggaggaaagttaaggctttggactctattggtcatgttcttcctgtacattcaaggcaagtggggaagaagccctggaagatggagactctgctggcctgggttaaggtgatgtcacaggtgaaatgctccagttggagggattgggctatgagacagactggtctagccgttcctgctggaaagcagaggggacacagggtaaaaacttcgttaggtgggtttaagtgggctagactggccaggtatggaagtacgag

SEQ ID NO: 1730 - DNA, 3354 bp, Mus musculus
ccttgaggagaagcgacctggacgtcgcggacggccgggcaggcagcatggaggaggcgcacctgctctccgctgccgacgtgctgcgtcgcttctcggtgacagccgagggcggcttgagcctggagcaggtgaccgacgcgcgggagcgttacggccccaacgggcctcactctctcctattccagggaaatccctgtgggagctggtggtggagcagtttgaggacctcttggtgcgcatcctgctgctggcagctctggtttcctttgtcctggcctggttcgaggagggtgaggagaccacaacggccttcgtggagcccctggtcatcatgctaattctcgtggccaatgcgatcgtgggagtgtggcaggaacgcaacgcagagagtgcgattgaggccttgaaggagtatgagcctgagatgggtaaggtgatccgatctgaccgcaagggtgtacagaggatccgagccagggacatcgtccctggggacattgtggaagtggcagtgggagacaaggtacccgctgacctccgtctcatcgagatcaagtccaccacacttcgagtggaccagtccatcctgacaggggaatccgtgtctgtgacgaagcacacagatgccattccagacccccgagccgtgaaccaggacaagaagaacatgctattttctggcaccaatattgcatcaggcaaagccctgggtgtggctgtggctacaggcctgcagacagagctgggcaagattcggagccagatggcggctgtggagcctgagcggacgccattgcagcgcaagctggatgaatttgggaggcagctgtcccatgccatctctgtgatctgtgtggctgtgtgggtcatcaacatcggccactttgctgacccggcccacggtggatcctggctccgtggtgcagtctactacttcaagatcgctgtggccctggctgtggctgctatccccgagggtctcccagcagtcatcactacatgcctggccctgggcacaagacgaatggcacgtaagaatgccattgtgcggagcctgccttctgtggagacgctgggctgcacctcggtcatctgctctgacaagacggggacgctcaccaccaatcagatgtctgtctgcaggatgttcgtggtggctgaagcagaggcaggcacctgtcgtttgcatgaattcaccatttcgggtaccacgtacaccccagagggcgaagtgaggcaaggggagcagcctgtgcgctgtgggcagtttgatgggctagtggagctcgccaccatctgtgccctctgcaatgattctgcgctggactacaatgaggccaagggtgtgtatgagaaggtaggagaggccacagagaccgccctgacttgcctggtagagaagatgaatgtgtttgacacagacctgaaaggactgtcgcgggtggagcgtgctggcgcctgcaactcagtcatcaagcaactcatgcggaaagagttcaccctggagttctcccgggaccggaagtctatgtccgtgtactgcacacctactcgtgctgaccccaaggtccagggcagcaagatgtttgtgaagggagctcctgagagtgtaattgagcgctgtagctcagtccgagtgggcagccgaacagcacccctgagcaccacttccagagagcatatcctggccaagatccgggactggggctcaggctctgacacactgcgctgcttagccttggccaccagggacacacccccaaggaaggaggacatgcatctagatgactgcagccggtttgtacagtacgagacagacctgaccttcgtgggctgcgtgggcatgttagacccaccgagaccagaggtggctgcttgtatcacacgctgttcccgggctggcattcgagtggtcatgatcacaggggacaacaaagggacagctgtggccatctgccgccgacttggcatctttggggacacggaggatgtgttgggcaaggcctacacgggccgtgagtttgatgacctcagcccagagcagcagcgccaggcttgtcgcactgcccggtgctttgcccgagtggaacccgcacataagtctcgaatcgtggagaacctacagtcctttaatgagatcactgccatgactggcgatggggtgaatgatgcaccagccctgaagaaggcagagatcggcatcgccatgggctcaggcactgctgtggccaagtcagcagcagagatggtgctgtccgatgacaactttgcctccattgtggctgcagtagaagagggcagggccatctacaacaacatgaagcagttcatccgctacctcatctcctccaatgttggcgaggttgtctgcatcttcctcacagcaattctgggcctgcccgaagctctgatccctgtgcagctgctctgggtgaacctggtaacagatggcttaccggccacagcccttggcttcaacccaccagatctggatatcatggagaagccgcctcggaatccccgtgaggccctcatcagtggctggctttttttccgctatttggctattggagtgtatgtaggcctggctacagtggctgccgccacctggtggttcctgtatgacaccgagggacctcaagtcaccttctatcagctgaggaacttcctgaagtgctctgaagacaatccactgtttgctggcattgactgcaaggtttttgagtcacgcttccccacaaccatggccttatctgtgcttgtgaccattgaaatgtgcaacgccctcaacagcgtctctgagaaccagtcactgctgcgcatgccaccctggctgaacccttggctgctgggggctgtggtcatgtccatggctctgcattttcttatcctcctggtgccacctctgcctctcatttttcaggtgaccccactgagtggtcggcagtggggggtggtgcttcagatgtctctgcctgtcatcctgctcgatgaggccctcaagtatctgtccaggaatcacatggatggtgttctcgggacatttatgcaggctcggagtaggcagctgccgactacttccaggaccccataccacaccggaaaaaaaggacctgaagtaaatcctgggagcagaggggagtctccagtgtggccctcagactgagagcatccaggcatttgtcctgttcccacccctgcccccacactcagccacccgtctcctggaccctgctgaacataacaggccttaaacaggaatggccacctctccgtctggtcccaggttcccgtctcccatttctgtccctccctactgctctggcccagaagctgagtccaggaggggaa

SEQ ID NO: 1731 - protein, 1055 aa, Mus musculus
LEEKRPGRRGRPGRQHGGGAPALRCRRAASLLGDSRGRLEPGAGDRRAGALRPQRASLSPIPGKSLWELVVEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTDAIPDPRAVNQDKKNMLFSGTNIASGKALGVAVATGLQTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEAEAGTCRLHEFTISGTTYTPEGEVRQGEQPVRCGQFDGLVELATICALCNDSALDYNEAKGVYEKVGEATETALTCLVEKMNVFDTDLKGLSRVERAGACNSVIKQLMRKEFTLEFSRDRKSMSVYCTPTRADPKVQGSKMFVKGAPESVIERCSSVRVGSRTAPLSTTSREHILAKIRDWGSGSDTLRCLALATRDTPPRKEDMHLDDCSRFVQYETDLTFVGCVGMLDPPRPEVAACITRCSRAGIRVVMITGDNKGTAVAICRRLGIFGDTEDVLGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYNNMKQFIRYLISSNVGEVVCIFLTAILGLPEALIPVQLLWVNLVTDGLPATALGFNPPDLDIMEKPPRNPREALISGWLFFRYLAIGVYVGLATVAAATWWFLYDTEGPQVTFYQLRNFLKCSEDNPLFAGIDCKVFESRFPTTMALSVLVTIEMCNALNSVSENQSLLRMPPWLNPWLLGAVVMSMALHFLILLVPPLPLIFQVTPLSGRQWGVVLQMSLPVILLDEALKYLSRNHMDGVLGTFMQARSRQLPTTSRTPYHTGKKGPEVNPGSRGESPVWPSD

SEQ ID NO: 1732 - DNA, 60430 bp, Homo sapiens
caggaggcgggtccccttgggccaaaatgcaacagtccaagtgtcctgggctggttgggggccctgggtgcctgctcggtcctgctgaccacacatccccacttccctgggccccagaagaccagagtgtgctccactcccagaaagaggctccagagtgttcccacctaacttagtcattcaacaaacacccctgacacctcccgggagcagcatcgagttgggtgaggtggctgccagagaggggagcagggcggacagtgaacacccagaggaccaggtgcagggtactcggcgggtcgaccaggagggagtgggagggagccctattggcctcagggattgaggggcttacagtcctttaggatgggtaggaattagccagctgagagataggtgttacgagcagacagaagggcatgggcaaagacccagagctagaaacttcctactgtgtgcaggagctgaatgtggctcagtgtggcccccactactgtgtgcaggggctggatgtggctcagcgtggccgctactgtgtgcagggtctggatgtgtctcagtgtggcccctactgtgtgcagggtctggatgtgtctcagtgtggcccctactgtgtgcaggggctggatgtgtctcagtgtgccccctacctactatgtgcaagagcgggatgtgtctcactgtggaccccctactggtgcaggggctggatgtgtgtcagtgtggaccccctactgtgtgcaggagctggatgtggctcagtgtggccccctacctactgtgtgcaggagctggatgtgtctcagtgtggaccccctactgtgtgcaggagctggatgtggctcagtgtggccccctacctactgtgtgctggggctggatatgtctcagtgtggaccccctactgtgtgctggggctggatgtgtgtcagtgtggaccccctactgtgtgcaggagctggatgtggctcagtgtggccccctacctactgtgtgcaggagctggatgtgtctcagtgtggcccccctactgtgtgcaggggctggatatggctcaatgtgggtctcatgggaggcaggaagtggtgagggtggggtcggcacctgaagggaaagtcttgagggctggatggtggctgagagggcagagctgatgaggtgggagggtgggagtctcgaggctcctaggaggacccatcatagagcacagagagaggctggaggagccaggtgtgaggtggctccaggccaggggggtctaggcccaggaggatggatggggtgcatcagagactcacacaggggtcccgaagcccaaaagacgacaacaaaagaacttggggtccgggcaagataataggggggtgtcgcccaccctgaacagctgggagccaaggtcctcccctgcccctcccctgagggaaggctgtcaaatagggagctggggtgggggcttaaaacagcagacccgatgctcagatgacatcagataagacgaacaaacaggtgactcgctgctcagcagcaggtctttagaacacctgggacacctgtccaccaggcccaggtgaccccgaagaagaggaaggtgaggttcccaagcctgcaaggctgtttgcattttgactcaaaccaatttacaaaccaaagtggggcagcagcagggcaaccccgccactgttttctgttctctctgcgggaagacgctgcccccgccacttccccttcaccactgacatgacggtcagggggctcaggcccagaggcgggcaggcacctccaagacatcacagccaggtcaagcttgcagagtctgttccctcagcctgcgacaccgttccctcccctgtgccttcagatttcagaagtatcccttcctccagaaagcctcccgatctccctgactgggtgacatccgccctccaccgcctgtcatgttctcaaggcagctctgaccacactgcgatctgttgctgcgtgtggttttctgggatgaacggcttgcttctttctcaggtgtggccatggggagaacaaggaccatgtctccaagaacatggtgccatgcctggggcatgctgggtccttgaaatttttcttttttcttttctctttttttttttagagatggggtcttgctctgtcacccagggtggagtgcactggcacaatcatggttcacagccttgacctcctgggctcaagcagtcctcccacctcagcctcctgagtagctgagaccacaggctaccatacccggctaatttttaaaattgttttgtagagatgggggtctcctatgttgcccagcgtggtctgaaactcctggcctcaagcgatcttcccaccttggcctcccaaagtgctggaattacaggtgcgggccaccacacccaactgataattttgtttttttttttttttgagatggagttttgctcttgtcacccaggctagagtgcaatagggtgatcttggctcactgcaacctcctcctcccaggttccagcgattctcctgcctcagcctcccaagtagctgagattacaggcgcccgccaccaagcccgactaatttttgtatttttagtagagacggggtttcgccatgttggccaggatggcctcaaactcctgacctcaggtgatccgcgtgcctcggcctcccgaagtgctgggattacaggcgtgagctaccgctcccaaccaagaaatatttttgaatgaattaagctaggataacaagggggcagagcccaggcctcctgcccctccccgctgccccccagccctcccaaactccagcctggaactatctcctgaacagtggctcaaactcttcatttttctggagcaagacccttcctcagggcagggttagaccccctgaggccaggctgccctaaggtcagtccctggcttttgaggagactgtcctggtcctagcccagcagaggacccagcagtcaaaggacccagaggacccagactcatttgtgtgttgaggaaagccatcaactcacaaagagcagcacatgcctgggccgggggttcccgccgaagctctgcctcagcctccctggctccatgtccctgcttgagtcctttcctttccctgggcctcagtttccccttgtgtacaagcaggatttaggccttcatctctgggggcctccacaggggtctcattcagagtcaaccaagcgtgcagggaagagagtgaatacacagggttggagaagccaatgaaatgagtttccaaattttagggagaggagccggaagagcgatctaggccagaggaactgcatgaaccaacgggtgacgctaggatgtgcaaggccagtggatctggaagagacaggtttgccttggctaggagcctgtggctaaagggctctgctgggctgaagagtctagacttgatcctgccagtactagggagctaagggaggttcttgaggagaggaatgaagtcatgaaagcaccatctcggtgaagcaatcttgctgtaccagaagtaagtctggagacaggaaggccaggaagcgggctattggaaaggtatagcttgagagagaagaggggcctgagttcaggcagtgacagaaaggcaggctcaaggggatggagcgtgtaggacatccttctctgcccagcgaaagctgcactgacctagtgttttgggacagaccccgacaagcaggctggggattgcttaggagcctgtgctttggagtcagatcaggttttaatcccagctgaacgcccctgggcaagtccccgaggctctgtgagcctctcaggcttttatctgtaaaatggaaagaggactggctacataatttgcggagcccagtgcaaaatgaaaatgaggacccttagtttaaaaaacagaggggccaggtgcagtggctcctgtctgtaatcccagcactttctttgagaggctgaggtgggaggatcctgggagcccacgagtttgagactggcctaggcaacaaagtgagaccctgcctctacaaaaaagtttaaaaaataattagccaggcacggtggtgcgcacctacaggcccagctactgtggaggctgaagcgagaggatggcttgagcccagcatttggaagttgcagtgaaccatgattgcaccactgcattcctgctgggcaacagagtgagaccccatctcaaaagaatttaaaaaataaaataaaatgaaaaaccggggaaagagtctcattaaaggcactaaaatataaaacttttcctttctcgtgcagtctcgctcaacttgtcatggtgcttttgaaaaatctacactttaattttctttttctttttttttgagacagagtctcactttgtcgcccaggctggagtgcagtggcatgatctcggcttattgcgacctccacctcccgggttcaagcaattcgcaattctcctgcctcagcctcccgagtagctgggactacaggcatgcgccaccacaccaggctaattttgtatatttttggtagagacggggtttcaccatgttggccaggctggtctcgaactcctgacctgaggtgatccacctgccttggcctcccaaagttctgggattacaggcgagagtcacggcacccagcctacaaattcattttctaagaaaagaagaaataaaaattctaataatttgcatgaaattttttcatttatctttactttgtgcaatgcccgttttaaatgcaaaatgaagagcatttaactcatatgtgtaatcactaaaatgaccaagtcttggcgtgtagcttgtacatgcacatacattttgttctgaccagaacaggaaaatgccgtacaacatggactcggctgtttccatttcacttgtcaatatgaatacactcctccaacaccctctgcctttgctttactgatgagtaaagaagggctgaaaagaaaaggaactgtgggttgccttatcttttcctttccttctgtgtcatcatgttgaatgcgagtggttgttgaacgcagggaagtaatgtgagtaagaaatgatatgatagggaccccgacctttcgtgtttctcagaacactactgtcttctttctgcatgaagcaaattcgggttcaaatggaaagcagggcctctcggctgtcagcaccccacttactcagtcgcagacataacacattcaccctagacttgattcgagtccactcaactcccacccaccatgagtccaccagaattgtgtgctcacgagcacagtgagcactttacgggagagagatggcgtattaaacgggcctctttggctcacagcatgccccgttttcccaacgggcttcacttacaaagcacaagttcaaagagaaaattactatattaagaatttcaaagggccaggcacggtggctcactcctgtaatcccagcactttgggaggccgaggcgggcagatcacctgaggttgggggtttgaaaccaggctcaccgacatggagaaaccccgtctctactaaaaatacaaaaattagcccggtgtggtggcgggcacctgtaatcctagctactcgggaggctgagggaggagaatcgcttgaacccaggaggcggagcttgcagtgagccgagatcacggccactgcactccagcctgggtgacagagcgagactctgtctcaaaaaaaaaaaaaaaaaaagaatttcaagatggcggttggagagcattaaaccaagtgggaggccgggcatggtggtgcgttcccatggtcccagccactcaggaggcagaggcaagaggagcacttgagtccaggagttggaatccagcctgggcaacatagcgagacccccatctctaaaaacagccacaacaaaaatcaagcagacggtccttctgacaactggtgacctgcgcaggttgcatgcccatgaagccagctctgaatggggataataaaatcctcctccagggttactgtgagggttaaatgggagtaacttgtgaaacaagcttagcatatggtgaatgttcaagtcagtggctctaatcacagatatttccctacacagcttagaggcccctcccctggggaggcctgaaggaaatcagggtgctggggcatgaccctgactaccgctccatggtcctttcagccatggctctcccttttaatctcttctccataccagcttctatgggggacttttctagcaggcaaacctggccccatctctccattgcttaaaacccttcagtacaaaacccaggacataacatagacaatcgaggttctcagtgtcctagccctgtctctctaatctgccctcctggtccttgcactcctgctccttacgatccagccacactaagggatcaaatcactatccctgacatatggctgagatttctcaccttcaactcaggctgttgttttctgcgggcagcaccctcttctccatgtgtctgaatatttccagaaaagctgggtgtggtggcttacacctgtaatcccagcactttgggaggctgaggcagctggatgagtagagaaggactgaaaataaaaggaactgtgggttgccttatcttcaccatgcctggccaacacggtgaaaccccatctgtactaaaaatacaaaaattagtgagaccagcctggccaacatggtgaaaccccgtctctactaaaaatacaaaaattagctgggcatggtggcaggtgcctgtaatcccaactacttgggaggctgaggcaggagaatcacttgaaccccgaaggcagaggttgcagtgaaccaagattgtgccactgcactccagcctgggcgacagagcaagactcagtctcaaaaaaaaataaaaaataaaaataataaataaataaataataattccagggaagacctctgtttcctcatgcccacccgggccccctcaggtgaggcgggtagatatacttctgctagataggtggtatgttctgccaccttctgtctggtggaggaggtggcaaaagccgtgtctaggtgccaggcatggagttcttggttcctggcagctgggaggtggagaatgtggacctgccctttggacagcctgcctgtgaccatgtcgccctggccaccagctgtgtgtctgtccaggtacaaaaagagagcatggcggggagggacgtgagcccggggcaggcagctggagtgtgaaatgactgcatgtgattctgtgggagctgggggggcacccagaagttgtgacaggggcagccgagcaggcgggcatgctgacaggtgtgtgagcctgccaggtgagggccccggttgctggcaactgtttgtcctgccatggcggtttgaaggtagggtggggtgggctggagaaatggaacataggcctggctgccagagcaaacagtcaggccttctggccctaccttctagcaaataccaactcacagctgagggtgcggtggagcgggagaggctggggttaaggtccctagggccagcagagaagaagtcagacctcaagatgtgtgtgtagggtggagcaggggtttcccagcggcttgaacgcctagggctcccgatctctgggaaatagggctctagcggggagctgtgaggctctgtccccagtcaagtcctggctaacatttttcctggcaacttagggatacagttgggattttgtggactatagcagtgggggagaaaggaatagggtggaaatatctggggatatcagacttgagatataaaatgtcaggctgagcgggatgcagtggcttatacctgtaatcccaacattttgggaggccgaagtgggtcgatcgcttgagtccaggagtttcagaccagcctgagcaacattgggaaaccctgtctctacaaaaaaaaaaaaaaaaaaaaaaaaaaaaaaaaaaaaaaaaaaacctgggcgtggtggctcacgcctataatcccagctacttgggaggctgaggtgggaggatcgcctgagcccgggaggcagaggttgcagtgagccgcgatcatgccactgcactccagcctagatgacagagccagatcctgtctcaaaaaaataataatggggctgggcacggtggctcatgcctgtaataccagcactttgggaggctgaggtgggtggatcacctgaggtcaggagttcaagaccagcctggccaacatggcgaaaccctgtctctacaaaaaaaaaaaaaaaatacaaaaaatagctggatgtggtggcgggcgcctgtaatcccagctactcgggatgctaaggcaggagaatctcttggacctgagaggtggaggttgcagtgagttgagatgtcgcctcgccactgcactccgcctgggcgacagagtgacactacgactcaaagaaattaaaaaaaaaaaaaaggaaaataataataataataataataataataaaatcaataaataaaataccaggccggaggagccacaaccagaaaaccagcattcctctagctccacagcaccaggctgagacgcagctgatatcagggaatccatctggatcacccatcaaaagccccaaagcacctttcggtccagccagtcctcagggagtgtctttgctcagggaggcaccgagaggcggagaggaggaggggcccagtcctgtcccaggaggaagagcacagaatctgggggtgtgcatgatctggataggggtcagcagctccagaccaggctggaagttgaggctctcaggagcgggtgaggggctgtgttgttggggcagggcgcagctgcagctatctgggaaagcttcctggctgcagaggcacagaaggggtttggggtttgaacagccagctgtgcgggctcaatcctggcatctctgaccctgtgcagccttggtggatggcagagactgaggctctagaaggcagagcccagctcgtggtgggaggcagataagggctggggtgaggctgtctgggtctctcaagctggagggagcggcaatcaggctgttctcttagctcctccttttggcggggcgagtggtttctgccttcctgcgacttcctcctctgacccgctgccacttctcctggccctcctggggcgggtggagctcgggagcgctgaggcggaggctcatccatctctcccctccctgggccagggtcagtcccctgggagccctgggcagaagacccccccaccccaccctctcgggcccctctggggagccccacctttgctccctggttacatttcctgctggggtgacggtgtgagtctagggtaacgagcctggttttctgaactttcttatgcaccggctctttgttaaaggttctggttatgtgaggaataacccctcgccggtgggcattggaaaagaataaagaaagcagaaacaccaaataaggagaacatccagcactttcctctagagaagacccgcttattcagaggctttcgggttccctctggagtcacttcgcagaattcgagctgggaagcaggacgccccgggcccaggagagcccagaggaggcgacgcgcagcccagagccgggtgctccgcagaccgccccagctctcggccagatcccacccctagcagctccgcggaccgggaccgaggacccccgggccacgcgcccccggctcccgacaggcccagcacgcgccccgcgggcggtctcagtttcccctctgcagaatgggcgggggacccaggcggtgcgccccggggcgcggagggcggccggaaggggtgtgatggggggcgggccccgcgccgccccgccccggggagggagtcccgggcgcagcatcctggcgcgggccggggccgccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacggtgagcgcgcgggccgggccgggccggggagcgggggccgcgcgcgccgcagtctcagtttcccctcctgcctccccacccggctctgggcgggcaggaagcgagggctccggaaacctcttcggatgctcctggggcacccggcggggctgcgcggccaccttcgccggcgccggggctgggggctgggggctgggagcgggttccagctggggagaccggacgcctggcaccctctgcgcggtcctcccggacttcccacctccactccggccccgtccaccctggaagcgttattccaccccatcctggaccgtattccaccccaacgccgcgccgctcccgctggcatcctgcaggtgcagcgcagacaccggcgggcgagggacggccggagactcaggctcggcctcccagctggccccagggtctcccctgagggctccagaaaacgcccaggaaggtgccgcttatcagctagcagccttggggcccccacccccaccccaggtcttcctctttctgcaacccgaagcggatgtggctggcggagtcggtgggggctttgaactgctgaggcgggagacccaccttcctggggtggcggagtcaaggcctcagggaactgccagggaggcctttcccatctctggggagggagggaggcttcactatcatttcatcctcacctccttcaaaggagtgtgggattcttgctcttgccaaaaggcacattgagtgccaccgggtactgtccagatgtggcctggcaccttggaggtcccatgagggtggaaaatacagaggtgccctccccacatcccttccaggcaggacctgccacccccttgctcatgcccgcagcatcgggcagagtgtgagggatcccaggagaaataccctcaccatctacagagggcagcctgggtctgcatcctttggggacttggagccttgcccttttggggttcccagccagccagaggggaaggtattctagccctgggatcctactactcagggctagcttgaaaattaggaagaagtgtcagaaaaggacttttgggttttgtattggtttatgaaaaccacctcttatataaatattatctttctggagcagaaatcctttttcaaaaaaattagttgctatatttagttgagctgtgggaggaactggggagataaatattatttaatatcccccattagtgacttggcagggaggttgtgctttgctgcaggagagctgggcagcatgggctgcctctgaccctggggtgggctgggggcgagggccggcgcaggcaggtctgcggtcccactgcctcttttgtgctgctatagcctccagcttgggaatcctgattcctgagggaaactggagacgcagcccttggcctgtccctggaatcacacaaatactgcttctgtacgaccctagccaaggtctgtcttcattctgatatcatgtcttcattggtccagcggaggaggaactgactgggagggagggagccccagccttccccacctgttatttggttagatgagatccttggggtgccctggccagcgcacacctgtgtgaactgatggggaaggctgtgggcttggcgtggtgtgtaggtccacagagggtggatgtgtgttggggtgtgatgggaaaagttggggagggatattgctgggctcccctggatcctctgggcattgatagtattaataataaaagctgatgttcactgagcacttactatgtgccaggttctagtctcagcatttttcatctattatctcatttcttccccaaaacaactccataagggaaggactgttgtcatccccattttatacagcaggaaacggaggcacccagaggttaaaccacttgcccgaggtcacatagtaggtggtggagctggcactggttacctgctcctctctgggcctcagtttccccatctgtacaagacagtcacaagttctgcaggatgcagaaccctggtgtgggcgtctgtgctaggagtttgggtcagccggcagcagctttttcagctttgcctccagccttcttgggtccctagagggctcttctctcagatcactgattggggctgggggcattccagggctctagaagtctttaggtgagcagaggggagccagctgttccttcctgcctcaggcttgccatggcttgaggaggaggtgcagatgtccctagcacagctgctggggtggagctgatgaggctttgaaccctagccctgccccttcatagctgtgcaatgctggaccagcctctttgcctctctgtgcctcggtttcttcaccataagcgaggctgccatagaacccatctcccagggttgtttgtgagtctttagtgaggtcacagacaccaagtcatccttccttgtcgcagaagaggctggggcgggctcctggccacaagctgggtggcagggtgggtcaggcctgagggcagaagggacaccccagagacatgtgttctccccaccccaggagtctgtgcacctgcaaggtcgttattgttggaaaccacaaggaagtcatttgcttaagtcctgaagcttgcaaattctgccaggggagggaggcagcggctgggcatcccacccccaccttcccaccctcctccctcactgcacacagacacttcagagctggggagcctcggcagcgcagtcagtgagcacgctagccagggaccccctccactcacacataaaaccccatctgccgtaacccccaacagggagtgagtggggaggctcctggccccagcacctcctgtgagcccacctttgcaggtgccagaggtacccagagttcagcttccttggggggcttttacttgtacatcttttttatttttgaataaaaatgtgcacagtgcaacattcaaggggttcaaaaggtatacagtaaattctccgccccgtccccagccacccattcccagtcctcccaatatcttgtgtcttcttcccaagacagtccgtgcatatacacatctggagctgtgatcttgtgatcttttcccacacggaagcaggaggaggataagtgctctttgtccctgctttgaccttgacagtcattcttggagccggtgccaggaggagcacggtggggcttcctagtggctgcatggcatttcggcgtgcggcttttctctgacttctggtggacgcttgtgttgttggcagcctctgctatgacacgcagtattgcagagtatccttgttgccacatcatgtcacgcgcttgtgaatatcactgaaggacgcattcctgggggtggaactgtggggtctaagtgggtgtatattttcagtgtcgtcagctgtcactaaacttctctgtgcagttgtgccgactgaacggctggttctctgctgcctcgccagcacagggtgggatcagacggtctgatctgtgccagtcaggtggaagagtcctctcgtaggtttgcttggcatctttctgtttaaagtcacattgggtgtcttttcatatgttaaggagccaccaaatgggctgcccatctcctctgctggactggagccaaggcaagagacctggctgtgttgggcatgtcctttctgtagctaaagtccctggagaccccagtgacctgagagtcgggcagatcccaggaggtcttctggggtggtctctgttcaagggagctggcaggccgggcagaagcctgccttcccgggccacacgcggcccatgtgcagtgagcgccttggccccagggctgccaggtgggatgagtggtccagatttagactcctgccagcggcgtcttggctctggccttatttgctgccctcaaataagttccaggccatagctggtgctgaaactcgggcaacccatatgcgtagcccacggaaaccaggccaagaggaacggagtgtgtcaggaagagggggccatctgagtggccctgcttgctgggtggcattgggcagacttggccctccctggacctgctgctcctcaggatagcagggatgggaccctgggatcccctaagggccttgcgggatctgagagggtgtggtttgcccacagccctttggaagctcaacgtctttcatgcttcaccctagttttcactcccactggcccctgctgggcagctgaagccccccaggagcagcatcaggcctgcccagctgggccccctcaccctcttacaccctaaggcagggcctgtattttcccatagcacagtcggacgaagagatgttgagcaaacccttcatctccagctccggataagccaggggtgctgcaggccccgctgcagagcggagagctacttccaaggccccgcagtggctcccgcagagcaaggtcaggtgtccactctaggtggaccccggagacacaggcagggccaggtgggctgggcgggtcttgcccagccagggcctcttcctgactctgcaagtgacgatttaattgctctgtaaatttacctttgaggaagacctgggtgagtgcttgcctctcccggctggaactgacatttagaagctgaaataccagtttccaatgaaggaaggagtagaggggggatgaggggagcaggtggtgtggagcctgggggcagcccaggggcatcgcttaccccccttctccctggctctggactgtgggctcagggccctggcctgcaccacggagcaactgagtaaacaatgactgtaaggactcagcataaacacagggatgactcagccccgccccaccctggaagtgttccagtgtggtggggggaccctaatactgacaactggtcagagaagggcacagcgatgaggtaggggaggggctttcagagaaggcttcctggaaagggggtttatatgaggagataggatgctgctgtgcacagaaggaatggcacaagcaaaatgttggaggaggaaggccgggcgcggtggctagcaccttggcatctcagcaccttgggaggccgaggtgggtggatcacttgagatcaggagttcgaaaccagcctggccaacatggtgaaacctcatctttactaaaaaataaaaataaaaaattagccaggcatggtggcaggcgcctgtaatcccagctatttgggaggctgaggcaggagaatcgcttgaacccaggaggcagaggttgcagtgaaccaagattgcaccaccgcactccagcctgggcaacagaatgagactccatctgaaaaaaaacaatatatatatatgtgtgtgtgtgtgtgtgtatatatatatatatatatatttatatatgtgtgtgtgtatatatatgtgtgtatatatatatgtgtgtatatatatgtgtatatatatgtgtgtgtatatatatgtgtgtgtatatatatgtgtgtctatatatatgtgtatatatatgtgtatatatatatatatatgaatgaggaggagaaggttttgcaaaacgggattatcaacacatcacgctggaccccataattgtgtacaattatgatttgtcaattacaaatacactaaaaagcaggggtggcaatcctgaggcttggctaacagagggacagatgtgcattcgggatacagacatgatcctagaagggcaggtggggacagatccaggaaggccctgaagcccgtgctaaagttggtctttattctgtaggccaaggacagccactgaagctctgtgaacaggacagaggcagggtcagtcatccatcacatatgtttactgagcacctgctatgctccaggagctgctctgggtgctggagacgctgcgcttaacgaagtcctgctgccctagagcttatattctagcaagtgattctggctggagcgtgttcactgtgtgctacgcattccaagtgctttatgcatgccgttcaatcttccggcatccctgtgaggtacttacatttatcaccctctttttgcagatggagaaacagacacaggggattaggtaactggcctgtggccacagaagtaccgtgagatagagcaggatttgaacttgagccctctggaccagattccttgctctaagccacgaagcttctctgatcacctccctcttttcccaggactgcaggctgactcccaggcctgcacgctgggcctccgtgaacacaggccctctcagtctggcaacatgagccaggcaggggtcaccgtggcggaggctcagattagaatagtggccagccccactgtggctctcagagagagcggcacctcctggtcctgtctctgccccctgcagcccagcggatggcactgagagtgggcagagccagggcactctctcatttaacagataggacatctggcactgccagaggcccaaggccgccatttcaaggggaactatctcagcctccaacacgcagcctgggagagagcaaggaaggaggcagcatcttccaggaatgcctggggtaggggatctcccagccctgggctccctccatcaccctggggctcattcatgcgaggggagaattgggtccttcagggttgcatttagaagcagatcaggcctgagcaggcagagcctcgtaaacccctaaagcaccatcagtgaggccagcagggccttttggacaggaggatttgggctgtgggctctctacagaggggcacgccgactgaagggatggggacatccagcccaacggtcaggacatgggacaccaagggttttcagatgagcttgggtgagcggtaaagagagtggaggagggaaggcaggacagcctaagagttagcatcggaggcccacagcagggggtcgagaaccagactgcctgagctcaaaacccttccctgtctcccccgctgtgtgacggtgaactagtcactcaacctctctgttgtgtactctgtaaaatgggcataacaatggcatcctccttcccagcttgtttgcggatcatgagaataaggcacgcaaggagttagcagggtgtctggcgcacaccaccagctgctgctgctatgacctccgctaagcacctcacgtgctcggtccccagcgtcttcccatttgttctctggtgataatgcggtaaggcacctggtacattgcttggcaggtgcttggtaaatgtgactcttaacagtaatgatgatgatgatcaccacagcaggccttcaaagtgggtgtgggtaccccacctcccaaatgaggctcaaggccccacaaggagctggctgtgtgggcaggaccagagctgtgctcagcggcaggtcaggcctccccaggtgggcggggtgagaggggagctttgcggaggaagccaggtcacagcggagggggtatcagtcaggttcagcttggatactgcagcaatcgcctccaaatctctcttggcaccttaaaggaccagaggctcatttctcactcctgctgagtgctggcagcaggctggtccccgggtgctctgtgccttcctcattctgtgacccaggtcgatggagcagacaccatctcacaggctgctggctgctgtaggagagagtgtcaaagagctccagccgcttggctatttacatttaaatgcatgaaaattaaagtaaaattcgaaattagtcacagtccaggggctcgccagctgcatgtggctagtggctgcggtcctggccagcacagacggaggatacttctgctctcacagaacattctactggacagtgacctcctagaaagtcccccaccaaaagtcaatgctccaacctggcacgaatacacatccttcttctcaaaactcacacgggggccgggaagtgccctcctactatgtgcccacaaggtgggggagaaccagaaatatttggggaacaacataatgagcaccaaagactggatcctgggtcagggtgggtcagagagcagaaggggagatgatccaggtagacaggtagagaaaggtgaactgagccgggcgcggtggctcacacttctaatcccagcactttgggaggccgaagtgggtggatcacctgaggtcaggagttcgagaccagcctggccaacatggtgaaaccccgcctctactgaaaatacaaaaattagctgggcgtggtggcaggcaccggtaattccagctacccgggaggctgaggcaggagaatcgcttgaacctgggaggcggaggttgcagtaagccaagatcccgccactgcgctccagcctgggcgagagagcaagactccatctcaaaaaaaaaaaataaaataaaataaaataagagaaaggagaacttgagagaccagccggggcaggcaggaggcatcatggggacctttgtggggaagtccaggactggagctggcacgtgtaccccatgacacgcttcccaaccccaggcctcgcccctgcccagaataaagaaaggtgagggttacaggcatcccccgggaagagcccagcacaagcccacccatgcgcaccatgaggttagtgctgtcctgattcgaggctggggcatggctggggtgacctcgaaagcacactgctccattggagaattggcccagaaaccagtcctggccctccccccgcctttcctgttcgcctcagctaaatagatcagaaggaaaaagtctgtttgattttaatctcgacgcaggacactggagattacattttccacggaaaatgtcagccactgccgaaaataggactttggagaaaatgctagaaagtgtatttttaggctatatatttccctcctggattcctacagtccagtgggctgcttgatactccccagggttcagctgccaggtgcagaccccaaagcttccaaacaggtggtccggggagagggctcccgtaggaaaaaaaaatgcctgtaggccaaaaacaggtggaccaatgcaaggacctgtttccagtgtcaggaagaaggaggtggaagagagccagccatggccggggcctcagattccgcatggctaacgagcttcggggagatgccacagatgtccggagactgtcctttgagtggcaagagacaagaggaggcagggctcagttagactgcggcctgggaagggggagcttctccaagcccaccctgcagagcctggctcccgcccctctcatccccacacagacccactcactcactgtgtggccttgcccaagccacaccgccaccctgatcctccgtgcccgggtctgtgaagcagggcaggaactccccgccacctgcctgccctttaggctgtaggaatgattcaaccacttcaggggcccgaggcacctctgcctgatacaaaaggtgcttcgggaaatgttggagataaaaatcagcacctaggcctgggcggtggctcacgcctgtaatcccagcactttgggaggccgaggcgggcagatcacaaggtcaggagttcgagaccaccctggccaacatagtgaaaccccatttctactaaaaatacaaaaatcagccgggcgtggtgccgcgtgcctgtaatcccagctactcaggaggctaaggcaggagaatcgcttgaacccgggaggtggaggttgcagtgagccaagattgcgccactgcactctggcctgggcgacagagcgagactctcttaaaaaaaaaaaaaaaaaaatcagcacctcaattgaggtgggtgctgttagagtttggaaacagtgttcttcaccatgttgtgtggggggcgactgggtatgtggggcggggctggggggtcttcactgagctcgatggagtgcagggcctgggggggactgcaccatgggagggatcctcactgcggggtgctggctgctggggtcctgtccaggggagccctgctgtgcggtggggcccagcaggccggcccagctgcagaccttgtccagctggtcccaggggagcagggatgttagaggcagggtgagcggaaggcgcctgagctggtgttctccatttgagggaggggctgccttgctgtgggggtggcagagactcaacaggactctgcggccatctaaggaagggctatgcagggagccgtgagaacagcccactctccgtgtgacctgggtgggggaagtgtctgttttctaggcctcagtttcccttctgtgaagtggggcagggaggggctggactggaggggctggaaggaccctcttggctccgtactcatcccacgatgagccaagtcaccctagatcttcctcaatctgagtcgggggagggtagaggggtggaagcatttgggctcaaaccatttatcctgtggcctcagagagccctggggatacatccagtccgtggtgggggtctgggcgggcacggtggggaggcactgccagactcccccgaggcccctgcgtgacccactcctctcttgtctcctcatggctcccgtggctgcctggatcctgcagagctcccgagtgaggaaggtgaggctggcaccgggatggacctctaggccgcgggcagcatccctgggtcgttctctgtctggtcatgacttccttctccccgctgagtgaggccttgctgagctccccaggatcacccacctgagcctctcagcgacctgggttctccctcttctgagtgcagggagggaatgggccgggaggtctcccgggccatcccagctctgagtgggcagggtcagtggtgggggcccagcctcacacatgacccccgttcccagggaagtccctgtgggagctggtgctggaacagtttgaggacctcctggtgcgcatcctgctgctggctgcccttgtctcctttgtaagtagggccctgccagccatcctgtggtagtcggtagccctggagggagagccaggctgggcagtgctccgaggtcctggagcctgggcctgtcctccacaccctgggcctgcgccctggccttccctggccctgccctgctcagacttcagcttcccttgcctgaaccctcatggcccctacattgggtccccggctcccacctgacccctccaatccatcttatcctctggctctcagcgagctccccaactcacatctgccccccgccccgccctgctgtaccctagggtttctctgcctcagcactactgatagtttagaccagatcattctttgtcggggtgggggtgggggctttccactgtaggatgttcagcagcatacctggactctacccacaagatgccagtagcacctcccggggatgaccatcaaaaatgtctttagacagctgggcctgacagctcatgattgaaatcccagcactgtgggaggccaaggcaataaaatcgcttgagcccaggagtttgagaccagcatgggcaacatagggagaccctgtctctacaaaaaatacaaaaacattagccgagtgcggtggtgcaggcctatagtcccagccactctggaggctgaggcaggagaattgcttgggcccaggaggatggagctgcagtgagccgtgatcacaccactgcattccagcctgggcaacaaagcaagaccctgtctcaaaaaaattaaaaatgtcttcggacattgccaaatgcccctggggggcaccttgtccctggctgagtgctgctgccggagccccttccgtggatcccagtgtcccccacatggattttggggtctgaacctcttgcagcctcctcttggctgccgcatctccttgctgttcctccattcccactgatgctcccctggctaatgggctttggatgcgtgcatcagaatcacctgggcttggctgggcgcagtggcgcatgcctgtaatcctagcactttggcaggccgaggcgggtgagctcaggagttcagcctgggcaacgtggtaaaaccccgtctctactaaaatacgaaaaattagccaggcgtggtggtgcacgcctgtaatcccatctacccgggaggctgaggcatgagaattgcttgaacctgggaggcaaaggttgcagtgagccaagatccagccaccgcactccagcctgggcgacagagcaagactctgtctcaaaagaatccgtaggcttgccgacacacaggtgactgggccccaccccagaatttacgactcaggaggtctgggagggaccccaagatcaacatttcttacaagttcccagctgctgctgctgctggtctggggaccacactgagatgctctgctccaggcagacagtaaggcctcggtgggcagccatccaactgccccacagccttgaaggttggcctgggtggggtggtcactcctgtggggtgggcaccctgtgccaaggccttctcggaggagtggccctctccaagccaagagctccccagtgctatctccccaaagcagggaagcaagcaggagatccggggtgccaaggaaaaggagagcagatctcggcccgcagcagggcctgagctcaccagctgtgatcctgcaggtcctggcctggttcgaggagggcgaggagaccacgaccgccttcgtggagcccctggtcatcatgctgatcctcgtggccaacgccattgtgggcgtgtggcaggtgggaggcactgggggtgggaccgggcggggggcggtctcccagccactaggagtgccctccacctggtgctggcgtcctgcagactctcctgcttccacctccatcccaggccccagaggagtcactccaagggggtggtctgcggggggcagcagggacagactgcctgccggccttctattctgcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcaggtatgccggggcctcctccttttattttattttattttatttatttatttattttatttatttatttatttattttttgagatggagtcgtgctctgttgcccagactggagtgcagtggcgcaatctcggctcactgcaacctcctgcctcccgggttcaagcaatcctcctgtctcaggcttctgtaggggcctcctccttttattatgtgggcctgggagccccatccctctctgtgcctccgtcattccggccgtatatacagagggggtggctgtcggatccctccaaagccctttggccaaaaccctgttggacagatgagactgtgggccagaggggcaggggtcaccagagcgatcacagctcaggcacccgacgcccagccccagccttgggttctgggaacccttctggcttttcccagctggtggtgcccaaagccaccctcagccaagccattctccccgcacagtgggggacaaagtgcctgctgacctccgcctcatcgagatcaagtccaccacgctgcgagtggaccagtccatcctgacgggtgaggccccccccaggaggccgggacctagtgggccaggactaagggatgggcgtgtcttcatgtggggcttctcatctctgattccctgaccaggtgaatctgtgtccgtgaccaagcacacagaggccatcccagaccccagagctgtgaaccaggacaagaagaacatgctgttttctgtaagtcaaatgtctggggcctttgcccagacaatgataaaaataacaacattaggattatgatcacgcctgtaatcccagcactttgggaggctgaggtgggtggatcacctgaggtcaggagttcgagaccagcctggccaacatggtgaaaccccgtctctactaaaaatacaaaaagattagctgggggtggtggcgtgtgcctgtaatcccagcaacttgggaggctgaggcaggagagtcacttgagcccgggaggcggaggttgcagtgagccaagattgtgccactgcactccagcctgggtgacgagagcaaaactctgtctcaaaaaaaaaaaaaaaatatttttttttctggccctgttgcccatgctggagtgcagtggtacgatctcgggtcactgcaacccccgccccccaggttcaagctactcttgtgcctcagcttcccaagtagctgggactacaggcacctgccaccacacccggctaatttttgtatttttagtagcaacaaggtttcaccacgttcaccaggctggtctcgaactcctgacctcaagtgatccgcccaccttggcctcccaaagtgctaggattataagcatgagccactgcacctggcccaacattaaggttaatcagctaaagtcctacggggaagaacctcatcgattcttgacaatacatgcaaatttatagtaataataatagcttgtgtttactggggactgtgtgcctggcactgttctaagctctttacacatactagtttatttaatccttaacaccaaatctttgaaataagtactcttgttatgcttgttatctatattttccagcaaggaaagaaacaagcacagagagattaagtaagtttcccaaggtcacacagccaatgagtggcacagctgggacgaactcagacatcctggatttctgctgggagaccctgccttcccctggagaagggcagagcctccctataatcactcgatagaaatgctctagaggaaggaggtctgccaaaatggtggaggatggtgggggatactccattctccgacaggaaaactgacccacaaggcatgatgcccggtctacctggctcttctcagggatagtgatgggttcagctttggcgggagagacctgcctctgtggcctcagagaaagctagcaagtgatactcacagctgccccgcagtagcctgaggccagcaaggagcgtttaggggcacaaggaagggtcaggccagtcagacaatggcccaggccaccaagttatcgggggatagaaaacttcctggaagggaagagggatgaagaaagtgaaactcacccagaactccttttttttttttttttttttttttttgagacagagtctcactctgtcacccatgctggagtgcagtggcacaatctcagctcactgcaacttccgcctcccgagttcaagcgattctcctgcctcagcctcccaagcaggtgggattacaagcacacaccaccgtgcccagctaatttttgtattttactagagacggggtttcaccatgttggccaggctggtcccaaactcctgacctcaggtgatctgcccgccttggcctcccaaagttctgagattacaggtgtgagccactgcacctggcccagaactcttcttgagaggggcctacctagctgcatagaagccttggacaggatgccttggggtggggagggaagctctgagagctgttgctccaggatcagcagctgtcactaagaagctttggaggggccgggcatggtagctcatgcctataatcccagcactttgggaggccaaagcaggaggatcatttgagctcaggagtttgagaccagcctgagcaacatagtgagacctcgtttctactaaaattcaaaattaaacaaaacaattttctaaagtaataataaaaagaagctttggaggaaggtgtctggctgggccctgcatgttgggggctggagctacgttgcttaagacagaagagaggctggggcctgccttctcgccagccccaacagcatatgcatttgaaggggcaccaggttcttagcctcctcagaaaaactatcttgggcctgtgttggaccactttacagaagaggacaccaagccacaaggctggctgtcccttatgctaggaattggggattttactggagccttggaaatggatgagctgaggctcaggttttctggattttttagtaaatattaatggactgtttattgggttcgtagtcagctatgctcctgtgtggctatagtgattgtttacgaaatcacattttgtggggttgatgcttgtgctgcgctggttgattatatcatcaatatcagcccccgtgcctcctctgtgcccggccccgtgctaggcactggggatacggcgatgaacccaaaccctgccttcctagagctgacactctcatgggaaggcagcagggaccccgtgcatacatagctacaggagtctggaagcactagcaacatggagaaaaggaaagccgggtagaaggataagtgccttattccggcctgaaggagtcaggggtcctgggcccctggttggctgctgagcagctttttccttgtccctcccctggccagggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccgggtgagtgacggccagcttggtgttgctgtgcgttgcagagcaggctgggctccctctctgggtctctcccccacctccttttcagtgagggatggaggagagaatctgtgggctgtcccttggcccagagcaggtccaggttttcacaagatgacagggagactatagcaaatcatgcctgggtagccacatgtcactgaggcctgtgtgtcactgtggggccctggccaggttgctgacagtctgttaacctcagtctcctcattggaagcctggctgtgtgagccctgctaggtaaacgtaaaggacataggagaggctcaagttcagccttggcataggggccaagctgggcctggatccgggttccatcctgccccatcatgactctgtgcagtcgacacctgtcaccagataagccagctccggtaacctgggaagggccagggcaggaattattcattccctgcacttcatcccacatcctgggctcactgcccacacggccaagggattctggctgagacttcagcaggcccatggggcagaaggctcctcctgacccagcagatgggtgggtggggagatggtgaaggctatgtgttccccacccttcccaggtccccagtgcctctctgtcacccctgcttccacatctgcccactgggcttggaaacccaggctctgtattctgagaccctaaggccttctgggagcccatcaaaggctgctttaggggaggggtgctaccgagctttactgtcctgctaaaagccctcataggattttatttaaacagagtgtttcttgactaatagcgatttttttttttgaggcagagtctcattctgtttgttgtctaggctgaagtgcagtggcatgatctgagctcactgcaacctctgcctcccaggttcaagcgattctcctgcctcagcctcccaggtagctgggactacagacaggcatgcaccaccacacccagctaatttttgtattttagtagagacggggtttcaccatgttggccaggctggtctataactcctgacctcaagtgatccacccgccttggcctcccaaagtgcagggatttcagccctgagccaccgtgcccggccctaataaatttttttttttttttttttgagatggagtctcactctgttgccagactggagtgcagtggcacgatcttggctgcaacctccgccttctgggttcaggcgattctcttgcttcagccacccgagtagctaggactacaggcgcgtgccaccacacccagctagtttttgtagttttagtagagatggggtttcaccatgttagccaggatggtctcaatcaagcttgacctcgtgatccacccgcctcggcctcccaaagtgctgggattacaggcgtgagccactgggcccagctaataataaagagttttaaagtgcagtgtggggaagttgtaggggccttacgtgctggatgctgggctgtgcttgctgggtgactgcccccaggagtagggaggagagcgggaaggaagggacacttatgcatctactgggcgctgggctggccatttgcttgagaatgtgcggtgaggccatgtccacgaagcaagaactgtctccccagcagagctggctgaacagacaaagaaataggcatgctgggccaggtaagcctcctgttcctgaggtgcacaggtgggggctgagtgacccagcaggccctgtggcaggggctcactctctggggacatctctgggctagaggggtctgtgccccagagaggcgtgtgggtttcctcccttgaaggccaggaactcatttccttgaaggcaaaggagggggcggttcccatgttactagtggagaaactgaggctcagctacttggccagggatcgcacagtgagatgggcaaggacccaggctttctgcctagctcagggctccctcaagctggcaactgcccccagagcactgaagaatctgccataaatccctcagaagtccaggacattgggacaaaccggagccggacacatctggcagagcagacggtccctgcctcagcctggaccctgcgttctatttccctcctggtgggcacggacggccaggccggtttggccctcggtcgggcagggggcctgcaggaccccaccctggggtcgactggccgcccggggaggagggaggcgaccccgcccgcctaagcacgcccctgcgctccccagatgttcgtggtagccgaggccgatgcgggctcctgccttttgcacgagttcaccatctcgggtaccacgtatacccccgagggcgaagtgtgagtgcggggccaggggacgcgcgggcgggcggcctgggggcggggccacgcgtggcggcgccgaggtggccgtgggaggcccctgggggcgggccaggaggcggagcctctcccggggcggggccaggaggcggagcccttctgggggcggggccaagaggcggagccccctcctaggggcggggccaagaggcggacccctctcgggggcggagccgaggtcctcctggtgaccgccccggctccgcaggcggcagggggatcagcctgtgcgctgcggccagttcgacgggctggtggagctggcgaccatctgcgccctgtgcaacgactcggctctggactacaacgaggtgggcctcaccccctttcatgacctccctagtatccaggcgaccaggacagacccttttcccagcctcaaagctcccagggttggcagcccttgctccctggaagtgccacacccagggagcacggttacccctgcacacccctctctgccgcccctccctttccgcagacaggcttcagaaccctccccctggggctcttggtctgtgggggactgccatggaaggggctgaagggctggggaaacctgtggggggaagagatttggggaacaggaccaagaaaatgttgaaagcagaagacacagcccacaaaaggcccacgttcagttaaagcctcctgcgacttaggcattcacgtggccggggcagtggaatggggcatgcagcaggcgtctgcccaaagggaggtccttggccagacccagtccgaggccaagctgagggcagtagagcaccaacgaagagttttgagcaggagagtgacatagtcagatgtgcatttacagaagatcactgaggcttccgtgtggaggccagacagacagtagaggaccgaagccagggaggcctatgtggtcattcaggccagagagatgcgggctgagccctggctggagccttggggagaggggagaaggtatgggtcagagacatttaggagccaaaaatcctgggacttggtgactggttaggtgaaagagacagggaggaagccaggggggctcctggttcttgtgctgtctggggctgtcgccggagtggcaaatacagagagtgggagaggtggcctgaggggtccccggggaacaaggttcagcaggcagctggacatctgggcttggggctcagcaaagggccccagggagagcaggtgggagggtggaagcgggcccagacagcagaaaccggtgaaggaggctgacaggaagtggacagagatgcaggcggagggcagggacggtgtgtggcgatcaatgccagtgtggggggctgaatgtcagtgtcagacaccaccccgaccccagggcggccaggctgggaagggctcacgggccggtgcaaaggaggttacacggaactccagcaaaggcagctgcaggggcaaggagtgagtgaggctggggatgcgggctggaggctgcctgcccctcactccctatcccctgggtccttgccaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtgagcagggctgggggctcaggcctccggctgcatggctggggcttctgggacatctggagaaggcagacaggacactgaagtttttgttttgtttcgttttgtttttttttttttttgagacggagtctcattctgtcgcccaggctttagtacaatggtgcaatcctggctcactgcaacctctgcctcccgggttcaagtgattctcgtgcctcgacctcccggcgcgtgccaccacacccggctaatttttgcattttttagtagagacagggtttcaccatgttgtccgggctagtctgaaactcctgacctcaggtaatctgcctgccttggcctcccagagtgctgggattacaggcgtgagccaccgctcctggctgacggtgaagtaagacttggagaaaagaggggagaaggctgcgtgtgggcaaaggtttggagttgggctgcacacagcatggtcagcaaacggcatcgtattgccatttctggggctggagagggaaatggaggccttgaatggtggggtcagaggagtgtagatgtcatcccacacagagcaagaggctctcttggggccaagcagttggtgggaaggcaggcgagagttgctggctctgtccttcatgccctgacctgcctggaccccgcaggtcatcaagcagctgatgcggaaggagttcaccctggagttctcccgagaccggaaatccatgtccgtgtactgcacgcccacccgccctcaccctactggccagggcagcaagatgtttgtgaaggtgggggcctgcctggctggcctgggcccctgcgcgccctggggaacctggtcatccacgctcctctgtgagccccagtcctcccgtgtgaatggcagggttgggttacaagttctcaggagccccttttgcctctaaccggtggtgtaggggtggttggtgccacccttggtgctctgtgttttggaaactgagtcccagggagggaaaggaatcgactcccttgcagaccactgtctacagcgtctccgttgctgctcccaaaaccgaagagagaaatacagctctagcttcaccctgcaagggaagtttaaaccccttttgaaatgaaaaggcttctgtactgggagctcgggccacttggaaaagtcagtgcctgggtgaccttttaggagcaggagaagccactgaaggagctttagaggctgttcctaggcccggggtgaggtctgaggtgagacctgaggccactgaggggcctgtcatccctggacccccttcccagggctatgcccgccataccctgtgtatggctctatttctggtccccaggcagggctcagcctgcctccctgctgctgaggcccctaccaaattggaacccgagtagcaccagggaagcagggcctgcaggggatgccattctcacccctgcctgcaaaacgctgcagtgcccgagtctgctgtgggctggtgggggaagggcatcgctaggttggtggctgcccccaccccagcacactccccccattctctttagattgtctcacagggggacccacttggttctcattctgaactttcagtgaatggattctgctccctgccttgcgtgtgtacccttgggtggcctttgcccgtatcttagtctcagtttcctgagtttgggcaggaaggagaggaggggttctgactgatgagttacctcttctccctctccccacctcgcagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgaggtgggtgcaggagccgattctccctgcagtacgaggtgggtgcaggagccaagtctccctgcagcagctgagcaggtggtaggtcagggatgggctcaggccccgcttgaatctgccccctccctacagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatggtgaggccacagcctggagccccaggagggggtgatgagtggggccacggggtgtgaaaagagcaagccgtgcaactctcccctctgcctcattcttaccttttctaacatcttattaccaaaaaattcaaatacaaaaagaaatttaaataatgttattctgggccaggcgcggtggctcacacctgtcatctcagcactttgggaggctgaggcgggcggatcagttgaggtcaggagttcgagacaagcctagccaatatgaggaaaccccgtctctactaaaagtacaaaaattagcggggcgtggtggtgcattcctgtaaccccagctactcaggaggctgaggcaggagaatcacttgaatccgggaggcagaggttgcagtgagccgagatcacgccactgcactccagcctgggtgacagagtgagacttcgtctcaaaataataataataacaatactaattttattctgaacacctacatgtctatcatctggattctacaactaacattttattgtatttgctttatcacatacctgtccatgcagccattctttgcccatccctagcccatcttttcttaggtgtatttcaaagtcagttgcagacatcggcatacttccccctcacctactttagaatacatgttaaccagagagcaatgttgtttgtggttctgtttttcctttttgaggcaaaatttgccttcgatgaagcacacagatctttggcgtactatctgatgagtttaggaacatgcacacacctgtgtaactcacagccttatcaagataggaaaatgccaggcatggtggctcacgcttgtaattccagcactttgggaggccaaggcaggaggattgcttgagcccaggagtttgagaccccatctctccaaaaaaaaaaaaaacaaaaaacaaaaaaaaaaagatatgacacattaccatcaacccatgaagttccgtcacacgccttccccatctctgtccttcgtcgcaaaacaggcgatcactgttttcggttttttttttcaccgtatatgagttttatctgccctagattttcaaatgaatggaatcatacagtatggactgttttggtttggggcttttttgagatctatctgccttgtcgtatcagattattgcttttttttttttttttttttttttttagacagagtctcgctctgtcacccagggctggagcgcagtggcacgatctcggctcactgcaacctccgcctcccaggttcaagcgattctcctgcctcagcctcctgagtagctgggaccacaggcgcgcaccaccatgcccagctaatttttttatttttagtagagacggggtttcaccacattggccaggatggtctcaatctcttgaccttgtgatccgcccgcctcagcctcccaaagtgctgggattacaagtatgagccaccgcgcccggcctattgcttttttattgttgagtagcattccactgtgtgaatatttcagtttattgaaccattcctctttggatggacatttagtttgggcctagtttttgttcttaattgctgacctattcttctgacctcagcctctcccctgacctggtctctgtttttaatcttgacctccagcctaacccagtccttaaccctgacccatggcccagccttgatctgcacaccaagcttgactatcactgcagcctggttcttgatcttatctttgacctctgtgctgactttgtccctgaccttgatgttgaccctcatcttaatctaattctttttttgtttgtgtgatgaggtctcactctgttgcccaggctggaatgcagtggcacagtcatggctcactgaagcctcatcctctcgggctcaagagatcctcccacctcagcctcctgaggagctgggactacaggcatgcaccaccatgcctggctaattttttaattttttgtagagatgaggtctccctatgttgcccaggctagtcttgaactcctggatcaagcaatcctcctgccttggcctcctaaagtgctaggattacaagtgtgggccaccacacccagcccgacataactatttacgttgagcttaaccctgatatgaattccagtcttggccgggcacggtggctcacgcctgtaatcccagcactttcggaggttgaggcgggcagatcacctgaggtcaggagtttgagaccagcctagtcaacatggtgaaaccctgtctccactaaaaatacaaaaattagctggtgcatgcctataatctcagctacttgggaggctgaggcacgagaattgcttgaacctgggaggaggaggttgcagtgagccgagattgtgccattgcactccagcctgggcgatagagtgagactctgtcccccaccaaaaaaaaagaattccagtcttgacctggaccaagaccttattctcaacgttgaccttgacactgccccacccccaatgtaatgctttatgttgacctcaactttgatctggccttcaatttttttagatggagtctcactctgttgcccaggctggagtgcagcagtgcagtctcggctcactgcaacctccgcctcccgggctcaagcgactcccctgcctcagcctcccatgtagctgagatcataggcacgcgccactgcgcccagctaatttttgtattttcagtagagatggggtttcatcatgttgcccaggctggtcttgaactcctgacctcaggtcatccacccacctcggcctcccaaagtgctgggattacaggcgtgagccaccgctcctggcctggccttcagtttgaccttgattgcaactccagacttcatgtcacttgacttcactcctcatgtggaccttgacttggcctctgcctttgccttgatcttcaacttgactacaacacctacctggctctttacccgggccatccccttgacttcattcctgacttgacctcagctttctccctaacctcagtttcatcttctaccccacatccaacctcaatttcatccctaccctcatcgctgactcaccgtcatccccatccccacctcatcatcttccctaacctcatgcttgatattctccccaactttgtccttgtctgcatcccttgccttctcctcagcctcatcctctgcccaatttctagttcattcttgaacccaccatttgttctgtctaactgtctgcttcctttggaacatcccctaagattgggggtgggctgagttgagaagagatggggaggtggaagggaagtttctcaggcacagccctacctgacctggcccacagactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctggtgaggccgggccttccctcctctcagccctctcaatccgctctgtgcccctgagatggggaaaacgcctgttcctcggatgcgctgcagggatggaggggcctgtgccctgccctggctggggctttccagggtcccaccttggagtggacaggggagagcacctcttgtcattctccagaggccctggtgacctatggatcatggtcaccccagcacccacggaggtgcctgaagagtcgcctgtcagccctccagccatgaacttcccacttgcagattagcaagatgagagaaaagccccacctttaggcagtcgtgtgtgtgtccgtgtgcgaatgtgtatttgtgtgcacatggcctgagtgcctgagtgagaggtgtgtgtaatgtgtatattttgcatgtgtgctctggtgcattttgagcgtgagtacaagcagaaggatttgtgccggcgtgtgactgtgcacacactcgtattcacatgtgaggatgcctgtggggaatggtgagcgtgtgtgttgctggacatggatggattctgcatctctgcacctcagggcagatatgtaggtgtttgcttgtgtttgccggatggtgtggcatgtgctaggtttttgcacatgtctgattcttgggcatgccctcttcgtgtgcgtgtgtgtgtgtgtgtgtgtgtgtgtgtgtgtgtacttggcctctgctaggcctaaagagcaggtatgtccaggatccagagctgggactggggaaggcaggactggccaggcccgaggcagagctgtgtacacacacccttcacatcacagctggcggagggaggaggggctgctgtggagacagtgggtgggtgagctcccagccttgggtctgagcaggagctggagcctgcatctgccgggggctaggcctaccggggctagagctcatgactctgttccagcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggaggtgagtggggcctgagccctccgtggaattcctaagcttcctaagagccttgtatcaggcttgcaagctgcagacagtgtgactcagcctggcttgtgccagtagaaactgtatgagctcatgtaatggaaaagaccaggcatggcgggatctgggtctcagtatcactggcatattttggcactgcctcagcttcattctcaggcccacgtccctcatggtggcagaatggctgctgcagccccagccctctgctcactccattacaaccccaaattcagcagaagagagagtcttttatcatgctgctctcccggtagtatgataagaatctcaggcctgggctgggcatggtggctcacacttgtaaccccagcattgtgggaggccgaggtgggcagatcacttgaggtctggagtttgaccagcctggccaacatgtggctcacacctgtaaccccagcactttgggaggccgaggcaggcagatcacctgaggtcaggagtttgagaccagcctggccaacgtggtgaaaccccatctctactaaaaatacaaaaattagctgggcatgatggcaggtgcctgtaatcccacctactcgggagactgaggcaggagaatcgcttgaacccaggaggcagaggttgctgtgagccgagatggcaccattgcactccagcctgggcgacagagtgagactccgtctcaaaaaaaaaaaaaaaaaaaagtctcaacaggcctgttctcattggcccacatagggttcacctgctcatctccaagcactggggccaagggtatggcagatgctgattgaccagccagggcccaccactggcatcgaggggaggtgcctgcaaaccacagggctgagagaggaaaagggtggctccctgcagggaattcagggaattattaggcaggggaaacagacgccagaaaaccaccgccattctctacagccggtctcctcccttccccgcagtgtacgtaggcctggccacagtggctgccgccacctggtggtttgtgtatgacgccgagggacctcacatcaacttctaccagctggtgagcaagggctggccagggagcctgttgaacttacagctcgagttgttggagttccaggggagatgggtctagagccgcatgggtggcctgcagtgtccttccccactcgctatacacgaataaacatccccacctggggagccgagctcagagcccacgggaaacccagagacaccagcacggacccccaagccaaaggcgcctccccatcccagtcagttagcggggaccaagaggcctcactgccagatgtatcttacctttgtcaagggacccctaaaacgttgaggcctcagaggaatgagcccctaaatggtgggactttaggcagagggtcaaactgaggagatcaagaatggaggggagggctgggcacggtggttcacgcctgtaatcccagcactttgggaggccgaggtgggtggaccacctgaggtcaggagttcgagaccagccgtccaacgaggtgaaaccccgtctctattaaaaatacaaacattagctgggcgtggtggtgcacgcctgtaatcccagctactcaggaggctgaggcagttgaatcacatgaacctgggaggcagcggttgcagtgtgccaagatcataccactgcactccagcctgggtgacagagcaagactccatctcaagaaaaaaaaaaaaaaaagaatcgaggggaggctgggcatggtggctgacgcctgtaatcctagtactttgggaggccaaagtacttgagcccaggagtttgagaccagcctgggcaatacagtgagaccccatctctaccaaataaaaataaaaatgaaccaggcacggtgatgtgtgcctgtagcttcttgggaggctgaggtgggaggatcagttgagtccaggaggtcacagctgaactgagccgtgatcacaccactgcacttcagccttggtgacagagtaagaccctgtctctagaaaaaaaaagaacacatcctgccgcggtggctcacgcctgtaatcccagcactttgggaagccgaggtgggcggatcacttgaggtcaggagttcaagaccagcctgaccaacatggtgaaaccctgtctctactaaaaatacaaaaattacccaggtgtggtggcggatgcctgttttcccagctactcgggaggctgaggcaggagaatcgcttgaacccgagaggcggaagttgcagtgagctgagatcgcaccactgcactcgagcctgggagacagagcaagacgcagtctcaaaaaagaaaaaaagaaaagaaaagaaaaccaaaccaaagggggtcttgcaggacacagggaataggacataggcaggcaggcaaagggaaggagtgggcacagcagtggcctcaccagtagaaatgggctcctccagggcttccccatgtgcctgtgaggcagaagctccagcccgacgcactgtctttttttgtttgtttgtttgagatggagtctcgctctgtcacccaggctggagtgcagtggtgcaatcttggctcactgcaacctccacctcccgggttcaagtgattcccctgcctcagcctccccattagctgggactacaggcgcccaccaccatgcccggctaattttttgtattttagtagagacagggtttcaccatgttggccaggatggtctcgatctcctgacctcatgatccgcccgcctcagcctcccaaagtgctgggatcacaggcgtgagccacggcacccggaccccagcgcaccttctaatgaataattccagaggccacaccgagacctatgacctggggaatactgtgtgtgtgtggcaggtgcttgctggtgaaacccagaaggtctgcactgggcagggcatttacagcaagagcaacagacccattgaaacatatttatttatttatttgagacagagtctcgctctgtcacccaggctggagtgcagtggcgcgatctcagctcactgcaacctccgcctcccgggttcaagcgattctcctgcctcagcctcccgagtagctgggattacaggcacccgccatcatgcctggctaatttttgtatttttgtagagatggagtttcaccatgttggccaggctggtctcgaactcctgacctcaggtgatctgcccgccttggcctcccaaagtgctgggaatacaggcgtgagccaccgtgcccggccgaaacatcctgacatgatcttgttggtattttcttctctgtgtagacgcataagcgtcttaagcattcacatgcccgagtgggaggtgtgtgtccctatgtttgtgtgtacatgtatggataggccattaagatctggcagggtgaggcccgacaacagtggcacaattggcaggaggatttggtcctctcggtcactgggtgggtagagtcaggttcaaagttctggaggttttcccttctctatgatcagcaccaaatagaaacgtgtggctgctcacgcctataatcccagcactctgggatgccaaggcgggcagatcacttgagcccaggaatttgagagcagcctggacaacatggcgaaaccccgtctctacaaaaaagacaaaacttagccaacagtgacggctcaggcctggagtctcagctacttgggaggctgcggtgggacaatcacctgagcccaggaagtcgaggctacagtgagctgagatcgtgccactgcactccagcctgggtgatgggagtgagaccttgtctcaaaaacaaaacaaggccaggcacagtggctcacgcctgtaagcccagcactttgggaggccgaggcgggtggatcacttgaggtcaggagatcgagaccagcctagccaatatgatgaaaccccgtctctactacaaacacaaaaattagccacgggtggtggcgggtgcctgtagtcccagctactcaggaggctgaggcagaagaatcgctcgaacttgggagatggaggttgcagtgagccaagatcacgccactgcactccagcctcggtgacagagtgagactcagtctcgaaaacaaaaacaaaacaaaacaaaacaaaacaaaataaaaagaaaacaagacatatccacttgcctcaaatgctggagcttgagttttggagaaaacgtccactatcgatttaagagattatcagattctctatctctttgttaaaatatctagccaggcttatttctcttcctgcacgagagaggagaaacgatactcagagtggccttatctgcatttgtgcagtgtgggaaaacggatgtatttatgcgacagacagtagatcagacagccgggcattttacacgtttttctttgaggattatgttcacagcacatggccccaatttctaatttaaaagatctccatggccgggcgcggtggctcacgcctgtaatcccagcactttgggaggccaaggcgggcggatcacgaggtcaggagttctagaccatcctggctaacacggtgaaaccccgtctccactaaaaatacaaaaaattagccgggcgtggtggcgggcgcctgtagtcccagctacttgggaggctgaggcaggagaatggcgtgaacccgggaggcggagcttgcagtgagccgagatcatgccactgcactccagctcgggtgacagagcgagactctgtttcaaaaaaaaaaaaaaaagaaaaaagatctccatgttcagattagactcccaagagcaggatctatatttttggtgaactaagctggttaacggttggaaacattcaccctcatccctataatatggaagagaacaagacaagttcccccaataccctccgttcagcctcttagcacgattctgtgaacaaggtttttgagcagtaagaaaactcccctgaggctataggggttatcagccctgagcgcttcatgttaattacagagaagctacctgttacagctgcaccttggcaattcattagtctctgtcagaagcacacatcagatctgatagagttcagtttcagtggcagaaatggagtgaggtatgaggtgtaaatggaatttttttttttttttgagacagagtcttgctctgtcacccaggctggagtgcagtgacgcgatctctgctcactacaacctctgacccccgggttcaagtgattgtcctgcctcagcctcccgagtagctgggattacaggcacgcaccaccacgcaggctaatttttgtatttttagtagagacggggtttcaccatgttagccaggctggtcccaaactcctgacctcaggtgatccacccgcctccgcctccctgggatgacaggcatgagccaccacgcccagctgtaaatggaatcttaataacagtgaacagggcctgcgtagccttcatcttctataccgcaaaggtgaattccactcccgcatggttttgttggttgattttcacatgcatttccctattcagtgatctccaggctcccgctagcctccccaggctaatgccagctgttctccttctgagccgctgcactcctgctccagaacgtctgcctttcccacgctgtgcccttgcttctccctggcacggtgcagctctccccaccgccgccccgaccccgcacccctcccgggatccccagcccaccccacggcagtgttttgtgtgctggttgtgcccaggcgtgggccaagggcaggatgaggcttccctcctcccacccaccagcccctcgcctgacctgccgctctctctgacctgccacggtgcccccagaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacaggtaggctgggcgcagggcctggagctggggccgaggagtgggggctgagggctgggggttccagtatcagtgtctgagggtcaggggtccaggtgggctgggcgcagggcctggagctggggccgaggagtgggggctgagggctgggggttccagtatcagtgtctgagggtcaggggtccaggattggggtctgtgggtcaagagggtccaagattggggtctgatgtttggggggttcaggattgggatcagaggttcaagggggtccaggattggggtccagaggtcaagagcatcccagactggggtctaggggtcaagagaggtccaggattggggtctggggtcaaggggttcaggttggggtctgatgtttggggggttcaggattgggatcagagggtcaagggtccaggattgggttccaggggtcaggggagtccaggactgaggtctgggagttagaggggtccagaacaaaggtctggggccaagcggggtccaggattagggtctgggggtcagtgggggtccaagattgggatccaaagatttggggatctggattggggcctaagggtcaaaggggcccagagaggattctgagagttcatggggaccggaattggggcccaggagacaaagaaggctgaaactggggtccaaagaaatcggccaagattaggtctgaggggcagagaaaggggtcccagcccgggacaggccctggcaggccgagcgggcaacagcaatgcaccgctagagaagtggtgaggctcctcccatgggggtgggtgcctggcagggcctccctgcaccccggcctaaggggagcaccctgtgccctggcagcgtctcggagaaccagtcgctgctgcggatgccgccctggatgaacccctggctgctggtggctgtggccatgtccatggccctgcacttcctcatcctgctcgtgccgcccctgcctgtgagtcaccccgcctgccccactgccctggtccctggacatcacaggccctgggctggtcactggacctctctggcccccctgcaatggaaactacctggaggagagggaggtgagaggtctggccagccaccacctccagctgtggccccaccttcaggagctcccagacctgggggacggaagagggggaaaccccttgctgaggggactgtgcccaggctggggtgggaggaaggacgagctttcccagggcagaatcctcccgcctcccaacaggatggatgggagttgacccagtgggcaagggcagaggtgggcccttgaggcagaggaagctgagcggacaaagattggggggtgcagctgaacagacaaagatcggggggtgcagctgagtggacaaagatcgggggtgcatccagggggttcttaggagcgctcatgaagagtccatcagagcccaggtggataaggccagcagatggctggggcacgggacagccagtccttcctttaaccaaacctcccttcccctccccgccagctcattttccaggtgaccccactgagcgggcgccagtgggtggtggtgctccagatatctctgcctgtcatcctgctggatgaggccctcaagtacctgtcccggaaccacatgcacggtgagtgggaggccccgtcccgcctccagcctgcctccccgcccgcctctgctcctgggctgcagtggacgctgtgggtgtggagcgcagagcctctctgtctgcacatcggggaggcgttctcggatcaccaagtggagggtgtgaaggggctctggtggctgggtcccaaggtgtccgcagggtcttgcactgcaggggacctgggctcactgggccagcaacgggagcacctcttgggccacactgcctcactgtcttcacctgccaccccctacatggccagggcactgtgtgctcttctgggcctcagcctctgacccctctgcacccagcctgtctttatccaggccttctcaggacagtctcgcaggcctggagtaggcagccgctgaccacctcttggaccccagaccacaccgggttggcctctttggtatcaccttgtgggtgggtcaaggggagggttgtttctgagctcacagctctgggtctgccttaaccccggagtggagaggacaggatggcaggtgtcgggctggagagaagtgggctgggacatggggtccatccacctgcctctgccaggtgggctctgagagtgggtgattctgaacttccaagggccagggacacagcatcgtctcgctgtcagagctgctcagagagggaggaagcaggggtgagctccggttcctgggaatttgcgcagaggcagtggccgtatggctggactgctgtgcaggggcctaggttgggctgggcagtggctgaggcctgcactggggcagctgggtcgttgggggccacctctggcaggaatgtgccccaggggagtgggtggagggactataaatagatcacgcgtctgtcattccctaggggctgagcaagggagctggcctgtccagggagtggccagacacatgtaggggctcactcgagggtgcaggtgggcactcagccaaggcaagcctgctggggccaatgggtgggggtggggggagctgagcaaggccattctgccccctgtctggttctttctggccaatgctctgtgacagccctggggagacactggaaactcccatccatgggggcccaaggcatccctgcactggccggagcaccgggccggtccgccaggaaatcctccagccgcccttgaccacactcactcacctgcacagccaggcctctgggccgtccttgaccacactcactcacctgcagagccaggcctctggggacatgacagctcaggtggcttgtcttcctcgggagagttcccaaatggccacaactgcctaggagctcagcagattttcttgagaaaacttaaaagtgagaaaattatgcccatggctaaaatgtctcagccagcacggaaaagcctgtgtctcagatgcctttcagcattggctgctggatggtggaggattccccaggcctaaagagcgggagggtcctagcgggaggggacaggctaggagggctgggagggagagattcctgctgggccaggagtgagggggagtttctccaggctttgaggttaaagcagtggttggaaagaacaggattgaacctggtggaacagggctgggtgagcacagatgttgacactcagcatgcagggcagaggggtgaggcccggcaggggcaagggccttgagtgccaaggtagagaccctggacattgtcctcagggcagtggggaagcacgggaggagtgtaagcacggtgcggactgtgtcaaccatggaggacaggcaagagggggtgagactaacgggccgggcgcagtggctcacacctgtcatcccagcactttgggaggccgaggtgggcagatcacctgagtcaggagttagagaccagcctggccaacatggtgaaaccccatctctactaaagatacaaaaattagctgggcgtggtggcaggtgcctataatcccagctactcgggaggctgaggcaggagaatcacttgaacctgggaggtggaggttgcagtgagctgagattgagctactgcactccagcctgggtgacagagcaaaactctgttcccccactctcccccaaaaagagagggtgagactaacaccaggaggtgggcgagcggcattgaacagatctggggagctggccccagaaagcacctccacctccacctccttgagatgttgacggtggtccctgtgaagtttggcttggaaaggtggtgcctggctgctggaggacagacacaggctgggtacctgcggctccatctgaggggtggggtggaggcaccccgaggaatgtgctcactggaagcccagacagccctgcccagcgctactgcagtccctggggcctcctaaagccagacggggcgggggtgagagagggaccctttgcgctcccaagccagctgggtggccttttagggaagtttttctgaagcctgatgcttgtggcttccccgtgatttatgtcatttacgagggatgtgtcctggggagaattctggatcctgggtcagtcctgggggctgggggcggtcctctcaccccacctcctggctctgcccaggtgtggctgagcagttgtcaggggaggcgtgggggctgggctgtggtggttgtattggggacagatctgggaggttacaggcgggcttagactttactctgaggacagtgaggaaccatgaaatggggtgttgggactggatttcggcttttgcttgatgctaggggcagaagtatgatgggacggtaagactggggctgggggcagggcggcaggccttgaggccttgaggcctggttggggaaggcagtgggagagatgagctctcgcaatttgggtgaaatcaggcctgggtgtgtgtgatgggcaagagaagcaaggatgagcctggtgtctgaaccttacgataatgggtggtgattccccaaaatgaaaaccaggagagtatgtactggagggtttgggggtgctgatggaacagtggagtgaaggaggcgtgggggacgttgcggggatggatcctggatgcagcttggggggtccggtggggctggggtagactgaggtctggactaagggaggccttgggagcctggggctgtcctgggagaagtggaggatggaaggggctggaaggaagctgtctggatgtgtgcccttacacatacatcttaacgcgctcttgggtttttcttccagaagaaatgagccagaagtgagcgctgggaacagggtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacggaggatcctcagcgtctgttttcctggggagtggtcccgccgtctccacctatggggcgtctgcctggggccctaccacctgcccataccacctgcccataccacctgcccacacccagtccaggaaacgctgagcaaaggtctggggttcacacatcaccaggattgctcccttggcccccaagacaaggctctggagagccacactcgagtggcaggtgcagcgcccgcagagcctcccagcttgggatgctcgctcctcacagggacggtgttgacaatttgtgcacgagttcaaggccttttgtgcattttattttatttgtttatttatgtatttatttgagacagagtctcgctctgccacccaggctggagtgcagtggtgcgatctaggttcactgcaacctccacctcccgagtagctgcctcagcttgaagggtagctgggagggcatgcgccaccacagccagataatttttgtatttttagtagagatggggtttcaccacgttggccaggctggtctcaaactcctgacctcaggtgatccgcctaccttgctcggccttccaaggtgccgggatgacaggtgtgagccacctcgcccagccccttttatgcattttatgatctgcatgtcaccccctgaggaaacagcctgggagagttccatgattgggcctggggcagggctgggcccggagcctgaatctcaggggccccttgcatcccacagaggagcctcaaccccagctcttctgtaggtcctacagctctcctgctctatctccctctcctcctcaaatcccaggatcccatccacctttggcccttccaagcccagctcaaatgcacctcacacctaccacctccccagggcttccctcagctcacaatacccagggacctctgcgaggctgcctggggtgagccggctcgcacaggtggccctaccttcctggaagccggggctcagggaagggagtcgccatggccctcgtttcaccaaaacccatcatgaaggcttagtatctaatccttcactcagctatcctgggaaggagacgcaggccctgcccacagggccagaggcaggattgtctacataatttgcagggcccattgcaaaatgaaaacctggaaccctttgaccaaaaatgacaagaattacaaagacagaagaacattcaatatgatggccggacgtggtggctcatgcctgtaatcccagcactttgggaggccgaggcaggtgaatgacttgaggtcaggagttcgagaccagcctggccaacatggcaaaaccccgcctctactaaaaatacacaaattagccaggcgtggtggcgggcacctgtagtcccagctactcagaaggctgaggcaggagaatcgcttgaacccaggaggcggaggttgcagtgagccgagatcacatcattgcactccagcctgggtgacagagagagactctgtctcaaaaaaaaagaaaaaaaaaagaacattaaaattcaccaaaccgtgtgcttaaaatgggtgcattttattgtttgtgaattacactgcagtacagtttgacttaaaagggaaaaaaagaggtagccacagaagaggtgggtgggcacatggctggcatgttggtgtggtggtgtcagaaccctcaggactggagaggagtgctcagtgtttgggggcagggccagcccccaggagttcttaatccagggcagagagaggccgggaatgagggaaaatggccccagcacagagcgtttttgagcccggggcctggtgcaggtacttggatcacacgtccatgatgccagcttgtcggtggaggcagcacccccacccccaacccaggagctcccaggttccttagcagggggcctggggttggcgccgagctcacagcaggagcagggtaggcagaaggcgcctccctccacatggtccacccgtaagacctctcataccacaggaccttctcatacacttcatctcccggtgtcttcagccagccctgggagatgggccaggcaagggctagggctccatttacggatgaggagcccgaggcccagaatgggcgggccatgccttccccaaggccctctgacgatctgagcatctagcttgcatcacgggggccaggcaggctgtgaggctcagatgggctgggggtcctgcggacaaggcggtcggctccaggcttcccagccacgctgcctccacccccgcccaggccggcctgagtccagctccgtccagcccacagcacggagccgacgggccaggatggggcggccaaggtaaacagaggtctccttacctcacagctggtcacccaggagggaattccggggcaagccctggcacgcttctaactggcaactaccaaaaccctcctggggaccctgcccctccagagaccaggactctgtgctccccagaccccacgctccagtcctcacagtggtgggagggaccccggtggggctgtgttaggagaaatggaggcacaaaatcacagcagggaggagaagggaagctggacatgcgcacaaaggcccccgagtgtccacagcggcttcacccagcacaggcctcagatatccatgaacagatgaaggataagcaagctgcagtacgtccacgcaaccgagaggaaccaaccactgatgcacgcaactgccacccgaagcctaaaccgctgggctgagcaaaggcggccagacgcgaaggagctcctcctgcctgattccacctccctaacgctctggacgagactgcacaaatctgcagtgacagagcgggtcagtgattgcctgggcctgggggtgctgaggaaagatggaccacaaacgggaggcgggagtgttctaggctgatggatttggagggggctggtgcatttgtcaaaactcatcaaaccatgtgcttaaaatgggtgcgttttattgtatgcgaattacaccccaagacagttggatttaaagaaaaaaaaaaaaaaaggctgggcattgtggctcacgcctgtaatcccagcactttgggaggccgaggcgggcggatcacgaggtcaggagttcgagaccagcttggccaacatggtgaaacctggtctctactaaaaatacaaaaattagccaggtgtggtggcgggtgcctgtaatcccagctactcgggaggctgaggcaggagaatcacttgaacccaggaggcagaggttgcagtgagccaagatcatgccactgcattccagcctggatgacaagagtgagactccacctcaaaaaaaaaaaaaaaaaaagaaagaaagaaaagaaaagaaaaaaagaaaaagaaacagaaaaaaagaggtgagtgccagagaggaggtggatgtggccaccatgctggtgtagaggtgtcagcaggattgggagctggcggtgggcgggggcaggtctcccacctgagtgctcagcactgggtgtttgaggggcagggcccagcccagcccccaggagtcctctttatttttatttaattaatgtattattttgagacaggctctcgctgtgtcacccaggctggagtgcagtagcatgatcacggcttgctgcagcctccacctttcaggctcaggagatcctcccacctcagcctcccaagtagctgggactatgggcatacaccaccatgctcagctaattttttttctgttttgttttgttttgttttttgagactgagtttcactttatcccccacgctggaatgcagtggctcgatttcggctcactacaatctccctgtcctgggttcaagtaattctcctgcctcagcctccctaatagctgggattacaggctcccgccaccactcccagctaatttttgtctttttagtagagatggggtttcaccatgttggccaggccagtcttgaactcctgacctcaggtggtctgcccgcctcggcctcccaggcagctatgggctataagcatgctccaccatgcccgcctaatttttttttctgtatattttgtagagacaggatttccctatgttgcccaggctggtctcgaactcctgggctcaagcaatcctcctgcctcagcctcccgaagtgcggagattacagacacgagccaccagccctggcctcccaggagttctcttaatccagggcagagagaggccgaggatgaagggaaatggcccagagggatggaggaggaccaggagggtgggacattttaaacacacgggaggggggcttcggccaggtcacacccagagttgggggatagaagaggcctgagaagcagcccgggtccaggcaatgggagacgccaaacatgggggcccacgctgtactccccaggcctccccgtagctgtcggccctcccccaacctccccttgacagcctctgccaggctggcccagggccctgctccagtcagggtctaaggggctatgtggcattagaggaatctctggcccagatggcatcacggtttgactggggtgtggttgcggcatcctcgggcccctgagtgactaaggagacctgttggaacccgtgtctgctccctcgagggctccagccggcctccagcctccacgctgcacagagccgctaaatttagccaggccggggaggctgtcccggggccgagtgcttggcagcagggctgtctccctacaaggcccggcccagtacccgagtcggccacccggtctttgggcttataaggcaggactggcggctctcaagtgctggaggcttcgagtgggcccggggccaagccctcagactttggggagcctccttctcagccaccagcagacatgggaactactcactgtgtgaccatgggccagggacgcaatccccacagcctcagtctcctgatctgtcagatgtgggctctaggacctgcctcatgggcctgttgtgaggaaaaccctgccagactccagagggtggagctctggcctctgtcctgcccacctcagccccaaacacccagaacaaaggcaggtgtctgtccctgaggacgctggggcagggcccaagggtgagaaatcacagcctttggatcagaaagatgcattttagagccagtgaaagagacattgaccccgacagctggctgtcttgctcttgtggagttagcagcagcaggaaaataaatgtaggtccctggggtacactgtggatatgataagatccccaaatgagacagtgctccaggccagtccactttctcagggccagggccagggcctaggctgtaactgaatcacgtgtgtgtgctctgtcggtccatcaatctgtccaagcaagtctgtcagtccatccgtcaatctctctgtcagcaagtgtggctccttggaggaggaggaggaggaggaggaggaggaggaggaggaggaggaagaagacatggtggtgatgtgagaggaagaacttcctgatcttccttccttccctccctccctctctcctccctccctccctcttccttcctccctcccttttttccctccctccttcttctttcctccctccttccctccctccttccttttttccttccctccctccctccctccccttcccttcctttctcctccctccctcccttccttctttcctttactccttccctccctccctccctcccttccctccctccctcccctccctccctcccctccctctcttcccttccctcccttccttcccttccttctccctccctcccttcctccctccttcctcccttcccttccctttcctcctccctctctccctcccttcccttcccttccttttccctccctccctcccttcctccctccgttccctcccaccccacccactctctagaacgcatatcagggagaagggtggctgaaaagggacccagaatggcccacacagtctcagcacccaccccactccccatcacaagcagctgtgtcctggtgcctcccattccaatggccacaggggcagctgggaaaggaactgtctagggtcaaggtcaggccaaggggagacgtggccaccacagttctggctcccagcatctctggattttctttagaaaagcccatgacacccactggattagcagaaactccgcgaggggtgaggctgatctacttgacaaggagagactgacctgggtgctggaaggggccatgggcagccctctgtgggtgacccccattcagacaggctgccgggattcccagccccagggcctggctccctgcccagagcacttccagctcatggctcgccagcaagaagactccttatcagccttaagggtggggcggctccgacgacagggccgtgggggctcgccagggaggcccctgcttccagcttgaacctccagtaccaccccgggtgagcttgggcaactcatttctcttctctgagcttggtttcctcatcttcaaaacgaggggtggggctggggaggcctccagctctgaggagccaacgtgggaccctctgcccaccccaaacccctgtgttcagggcccgagctgggggtgggaagggaaggcagggactgcagaggtgctgtgccccagactcaatggtggcctccagttctctgtcccgtgttgctgagacccatcccctgtgagcctcgacctagaaggaacagcccttattaccccaatttacagatgaggaagcaggctcggagaggcaaggtgacacccagcccccacagccaagaagtggcagagccagggatctccgaggtcaggctctctcggctggtcttgggccccccatggcaccggtgacggatgtggtgctggtcttggctgggcacctgccacctctctccctctgatggtggccccggcaggacagacagtgggagaggagaggtgggggatagagatgccagctcagcaccgaggttgaccgggcacaggccaggctggaactcagagcctccttcctctctgccttgctcgctgcagacccccagggacgaagcagccaaccctggtgggggagggtggagggtggtggatggggctggggatggaggtctcattttggcagtggaggggagtcgcggggagtcccctaatctgaggagactccagcttcccccaggccccggccagagctccatcttgccaggttttggggggaggataacttgaggagtcgactgagagctttatctttgcccctgtgacgggtggcctgtggtttcctgccaacaactcctgtttccggaggcccaacaaggcccacgcagagccaggaggggcagtggggctgggcctgggtggccccaccagccccgccccatctatctttgggaatttatttgtccatgggcgaggctggcctgcagtctgttgccttccaggggccaagagctgctctgatcacccagggattctctctccaacccaagtgcctccagctgacctctggctcctgtcctctggctccacctgcaccgccctgctcttcctaaggggccaggaagcccccagaagctctaccatcgacgtgggtggtggcacccggctcaccctgagagcagaggccgtgcagggggctcagttctgagccccagccggcccaccatggcacggcggttccaggaggagctggccgccttcctcttcgagtatgacaccccccgcatggtgctggtgcgtaataagaaggtgggcgttatcttccgactgatccagctggtggtcctggtctacgtcatcgggtgagtccgggcgcctcccgctgcctgcaccagcccctaccccgggcctgtcctccagactctgacatcccttgcgtgacaccagcgagcccctcttcctctccatccaggggaaggccttcctggcaagccactgtgcgagaatagaaaatcctgccaactcgctgttgagatggggacgaggccggaggggaagccctgcccgggggccttcggtgaacaggaggcagagtctctgggttctgaggagccggctcagtgttatggttcctttgagtggttagtggtgttcagggccagggcaccaccaaccacagccactgagtcctcgacctctgaccgcctgccaaaccaggccgccactgacacacagaggccatgccccacacccgtcaccccatatgacaagttagagagagacagactctgctgccagcttccctgcctgagcaagggacatccagggacgtttgaggcccccggagcagagaaactctcacattctgaatacctggtgccttcatgttggcatgtcaggcggaggacagagatcggttctggtcccagggatgatagttcctttctgggcatctctggacctgtcccaccgggctgggagtgcagaatcagaggcagcgtgggacgctcctgcagtatggttgtctcgggagccaagacaggcctggcagaggctggcacacttgtgagtgtgcatatggagctctgtgcctatatgtgtctgggtgtgtgtccctggtgctgggtgcccacatgtgggtacccttatgtgtacatatggctgtgcccatgtctgccctgtggccaagtgtctgggtggccagtgtgtgtcccctgtgtgtggtgcatcttgtccactcacagtgactctgcagaggtctcctggaggccccagggccactggagggggctcagcccctgttggggtcctaggggtgcccagtagcccctgcctgcctttgccgtgtgattctgagagctctaccctccccatttttaccatggttccgaaccagaactgctaaatggagtccagggcaggctgacccagggcccaaacaaggaccacgaagtcctagtcccccggaaacttctggcgtccaaaagagccctccttctgtcccaccagtccccagaacctcagagccggccaggtggacccagggccagaccccagccttgacctctcctctctcttgttcagaaactaatttgacatctgtgatgtctgagcttgtgagggaaactgaggcccagagaggggcagtggggtttccaggtccacagcaagtcagcagcaaacccagggttgcagctgagccctcctgacccccaggcctctgctgtgccttctccttcctcaccatcacaaggggctgtggatcctttctactgggcactgatggtgggatgccaggtacaggacgggccggaagtccacccttagtatcactcctgaccgtccctgggagaggctgtctgcgcaggcccagcctacccttgctggaagaggctgggggaaggctgtcctctctctgcccctgcggctccctagttctgctttcagatctgcaggtgtgaggggcaccaggtccctcctctgtgtgtgtcacaggctgtcagcgttggagggacccacccattcccagccgtagcctatgccccaagctgctgcccagccgggaacctatacctccagtgacggggacctcactaccgtcctcctgcctgtcttccctcccaagactgtctaatcagtttccaaatggatgtggcccttctcggtgtctgtggggctcaggaccacagggattagccaggatctcacagcttagtaagagactaaccaggatttgaacccacctgcatggctccaaagtcagccttgatattctggaaaggcaacctcctcagagagagggcactggcctgcccacgtcacacagcagagggtggaaggaaggcagagtccgtcatcaccagcaacccccagggctgcaggcccaggcttccagctcctgctcaggctgtggtgcctgctgtctcttgcgccctcgtctggccactgctcagtactgcactgacctctcagccaggaacccacagcggcaaaccgaacccctgacccagcctggacttggtcttggcatctccggactcagcttcctaaccggcccgtggggcacgggttgcagggg

SEQ ID NO: 1733 - DNA, 4535 bp, Homo sapiens
ggcggcatggaggcggcgcatctgctcccggccgccgacgtgctgcgccacttctcggtgacagccgagggcggcctgagcccggcgcaggtgaccggcgcgcgggagcgctacggccccaacgggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagggtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 1734 - protein, 993 aa, Homo sapiens
MEAAHLLPAADVLRHFSVTAEGGLSPAQVTGARERYGPNGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEEMSQK

SEQ ID NO: 1735 - DNA, 21562 bp, Mus musculus
  misc_feature (1)...(21562): n = A,T,C or G
cacaccctgtgctgcccctgcccctgccgccccagccggctcgggagcgcgatggcaaactcctagaggtgatcgagcgcaaacgctgcgtgtgcaaggagatcaaggcacgccaccgtcccgaccgggggctctgcaagcaagagagcatgcccatcctccccagctggcggcgggtccctgaaccccgcaagtctggtaccccgccctgccggcggcagcacacggtcctctgggacactgccatctgaggaatacaggggcggctgggactcctggattgggaggggaggggcctgcctaggtctccttgaggcttgagagatggaggaagtaggagaaagttcctactaggcccatcatgggggcttggggtgccagcagcagcccaagtaatttgggggaggaggagggtttgcttgatgttggaaggaagggtctaagtgtgtaggctcctcttgaagtgaaggccaaggtggagatctctgtggggtaaaagggtttgaaagaagcgggggtggggcatataggagtctgactggagtaacagggaaactcggctcttttattgagagccaggggagtggggaagggtatttattttgctatttattttagtctggagggcaatttctgggcccttctgacctactcctgagcaggaggtggagaaccaaggctaaatttgcactctccccaaggccagtgcctacaggcctctgccatccttgcccagtcaacgggagggagggaatgtggctgcctccggagcagagtcagaaggcagagaggcccagacagtgacagtatttatagttttcccagaatttggtagtgagtgtggtctgctgtaaaacaggcattttatttagttctggggtaagggtctagccagggatgggtgggatgttcggggaagagggagaacgtaagcgggtggagggaggagcggggtatttatttaaattaaaaaaaaaaaaaaaaagctgtcaggaactttttttaaattcctttcttttcagaataatatattaaaagactcatgatcctagagctgtcttttttatatccccacccccacccccaccccgtgtgctctgtcttttatacatgttctttttcccacaatgccctgggtgggtgggaatccaaggtgccaccgggagccatcgtgaccagtcacgaggaaaagcagagtttccggtaagtgggaattctgtcatgctgcccatttcttaagttcctccggtgtgtgtgtgtgtgtgtgcacttgcgtgtgccccctagcatatgcgtcatgcgttgtgcatgtgtgcacttgagtacggaggtcagagattgacctccgggagctgcctgtttccacctaggattacagacttttcacgtaggggctttggaatccatactcagctccgcatccatcagttgagccatcccccaggatccggtcactccattttccctgagcatccgctgtgttcctggcagggctcagatgcagaatgtccagaccatgaggttgggatcctgctgatcttgcagtctactctgggagctgaaacacccagactccagtaaacactgatgcaggactggcagagaaaaaggagagctgttggtcatttagagcactagtggatcgggaaagaaggctggggatataagactgcagtagagcatttgcttacagtctcccagagaagggactgaagcacggctcggcagtagattctaatccagaatcttctggtgagtggcttatcactggtctaagtttattgcaagcctcagggttctctcacccgtaccaccaataataaataatggtgaggcatcatgtagagtataaaaaaattgatgacaatgctctgcaggtttttagaattgagaacaccaattacaaataatgggggcaggatgtgttgtgtgtgcatatctttaaccccagtacttggaaggaagagttccaagccaacctggtcttaaaagtgagttccaagatggccagggtcatacagagaagccctgtctcagaaaaaaagaaggaaacaaagaaatgaatggtagtttgagagacgaggtaagatacagaggttggaggtgcagtcctgcaataccggcctttgggagtcagtcagagggaggaagatcaaagttctgaccctgtctcaagaaacaaaagcaacaacaccccccccccaagcagtagatatttttatgcctacttaaaatgagcagaagacaggtatagagtgagtgcctataaccatagcacttagaaggtaaaggcagggggttcaggagctcaaggtcatagttcaaagccagccttggctatatgtaagatcccgatgacaagaaatggaaaaagctggagagatggctcagcggttaagtgcactggctgctcttacagaggacctggatttggtttccagcacccacatggtggctgacaggtgtttgtaactccagttccaagaagataggtctgataccttgttttggaatccaagggcaccaggcatgtacacagtgcataatgtacatacatacatatatacatgtgtgtatgtatgtgtattatacatatataacatacatatatacatatatagcatatgtatatataatatatatgtgtgtatgtatacacacacacatatatatttaaagaaagagagagggctgttaagatggttctacagtcaatggtccttgctactgagactgatgtccttgttttgagctacaggactcacataatagaagggagaattagctcccacgggttgttacatgacctccacgtgcacactatggcagtgcacactcacacaggcacaaatcaataaaaatcagaaacaccaaatgaaagcaaatagtatgttaataacagcatcaaaaaaatcataatgtggggatgtagctcacatggtgctcacctaatacatgcagaaccctggatgagccatagcaaggctgaggtctgtgtccaggaaaaaaacaaacaacatacacctgggagtaactttaataagaaatagaaccctagctgggcagtggtggcgcaagcctttaattcccagcacttgggaggcagaggcaggcagatttcttagttcgaggccagcctggtctacagagtgagttccaggacagccagggctacacagtttaaaacaaaacaaaacaaaaaatagaaccctaaaatccttatcagaaggctggagagatggctcagcagttaagagcactgactgatcttccagaggtcctgagttcaattcccagcaaccacatggtggctcacaaccacctataatgggatcaagtgccctcttctggtgtgcctgaagacagctacagtgtacttacatataaataaataaataaataaataaatcttaaaagaaaaaaaaataatttgagagtctggaatttgaatccagactgttctacttaccagcttcaattaaaaaaaaaaaaatccttatcagatcaagcaataaaaccaacatcttacaaagtcactttaaaaagggaatttttagagagtaatgccctgttcaaaaacaagctggagagctgagtcagcggtaagagcacttgctctcatagaggatccaacgttggttcctagcaccttcatgattcacaaaggtttacaaacatctgtaattccagtttccagggcatctgatatcctcttctgatctcatggtgcccaggacataacaggcaaacctacatatagaaataaaatgagtgaatctaaaactaaaaacaaaaagctggtgtgatggctcaggggtgaaggtgcttgctgccaagtctaatgcaccaagttcgattcccagaacccatacaaaggcagacggaaaaaaagggagactctgtagagttgccctctgaccttgacagaaacagggtagtatgaatgcacacatgcacacatttaaataattttaagcaaaaaggtaagatttgaataatcaaggagtaatgactcgtctgtacatttaaacagcgtaatatatagatggcagttttcaaatgaatctaccacagccctaagggagttatttgagaaacttgctaaaatttgaaagttcatccagaatgataatgggggaaggcagaacattctgagacagaataacagggtgacctgccttcctgaacactagagcataaaactggaacatgtcagccctagaacagagctcaaatagcaaataactcatcagaataaggagcccagagagacccttgcatctagaacttactgaaaagagggcttgttagaaagtagtttggaagggactcgttggtttctgcagggtgtttgtgatcccagcactcaagaggtggaggcaggaggctcagaagttcaaggccatcatctgttacagagctagcttcaggctagcctgggctactctgtttcaaaacaggctgtcttgaagaattaacctgttaggaggggtatgttagaggctgtagcgctcatctcgttgatgaatttgtcccccagaactaatcctgtgacctattgaagtagtccctactcgagagagcgaattgcagtgttgtcggaaagaatgacaaaaacaacccctaaagttcatcaggctagcattgactaaagaattgaaggtagaataaacttaccaatggaaactggcccgggcgtggtggtgcatgcctttaatcccagcactagggaggcagaggcaggcggatttctgagtttgaggccagcctggtctacagagtgagttccaggacagccagggcgatacggagaaaccctttctcaaaaacaaaaaataaaaagaagaagaagaaaaaaaaaagctgtatgcagtggttcatgcttttcgtcccagcccagaggaggcaaagccaggtggagcccttgagctcactgctggccagctggcctagcctagaattggtgacctccaagccatcaaaggaactcttatctcaaaaaaaaggtgaatgacacctgagggtagcacccaaagtcgacctctgacccccacgtttgctctcactcacacccactcacattgggtgctaacacacagacacataaaattcactttaaagtcctctatagtcccagcactccggaggctgagaagggggtgcagtgagtctgacccaagcttgctctatggaatgggttctagggtagccatgggctacagagtaacaaagtggctcaagaaattaaagtacataaaaagaaaatgaaaaaagatataacaacaataaatagaaccaattctaaaacatttttaaggtgtgtctgtgtgatgtgtgtacacattttgaattcaggtaccagggggagtgtgtggtcagaaaacagctgcaggcacctatccttgctttccccttgcttaaggcaggaggcacagttgacttattttctatctccaatattccaaaccaacctcaaacttactgtgtagccaacgatgacactgacctcctacctctcctgcttttccgtctaagctgagccacattcccagtccatctgtgattcttctttaacattttaaaaatgattttgtttttgtttttgcttttgtttttttgagacagggtttctctgtatagccctggctgtcctggagctcacttgcagaccaggctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtctcgaaaaacaaaaaaaaaaaaattgtttttctcactttgacagcagatatactaaaaattagaatgaaaaagaagatttgcatgtctcatgtgcagagctgacaaggaaagctttcaagtattccatatatttcagggtttttttttttgagacagggtttctctgtgtagtcctggctgtcctggaactcgcgctgtagaccaggatggctttgaactcagaaatccacctgcctctgccaaccaagtgctgggattaaaggcgtgcaccaccatgcccggctatatttcagtttttaacagggtgcttgtgaaatnnnnnnnnnnnnnnnnnnnncttgtatgaggcttggcatttgcttcaagtgaaatgagaggaggaaacaggcccatggtgcccacgagcaaccccccgatatcggacaatgggcatatgagtgttcactgaaaatgttttctcggcaaatgagtctgtttgaaattttccacaattttcaaaaatgtttattttaagtcagtatgatgagtcaaaaaattttcctcctttgaaaaaaaaaaatgagtactgggaataatgagcccaggaagtccctcctgtcccagacaaccatggctctaaaaaaaacttacccccttttcttgacagtctgatgtagcccaggctacactcaaaatgactatgtagccatggatgaccttgaatgtctaatcccactgcctccatcatttgagcactgagggtacaagctaaagccagcgtgaccaattttgtgcaatgctggggattgaacccagggcttcgtgtatgctaattaagcactcttatcaacagagccatttactgcttctaagcagtaatcatatttttctttcttttttttttgcagaagcgatgtatgtgtgtggtagaaaatgtgcagtcactagaaaagcagaactaaaacaatctatttccactgctcacaagtcacggtttactgtatatggcagaaaccgttctctgaatatgtgtatttatattgaaaacaaaattaggtctcttggcatgttttaaaatgtgtgtatttgttaatattgctgtggggaaggggctttagtgccagggcattggtgtgggagtcagaagacaagattgtggagtctgctctctttacaacgtttccaaggatcagactcaggtatccagatttggacagctccttgaaccgttttgagccaccttgccagccccacaggtttagtgagttggggttcctctgtgtagctcaggctagccataaattcttagtcatcctccctccaagataacatggagctggaactgcaggtaagagctacctactccttcctaaccagcttacttcaagtctccaatgctggaattacaagtggttatcacaacaccactgagagattctggggatcggaacctggttctcagatgtgggcagtgtatgttttcattgctgaaccatcaccccaacctcaggatctttagggaaaaaaaatatatattgtgtagtgccaggaggtggccatggcatttgagaggcagaagtagactgatctctgagcttgaggccagcctgggctacagagccagttccaggacagccagggctacacagagaaacctcatcttggaaaaacgaaagaatctcatgtgtatatgatgtaggtgtgtatacaatgtaggtgtgtatactatgtaggtgtgtatactatgtaggtgtgtatacgatgtaggtgtgtatacgatgtacttgtatatgcacaccattgtgcataaggtgtctgtgcatgtaccacagcgcacgtggatggcagagaaagcttccaggatttatcctttacccttttctctgttgctgctgccaccgacaacaccgggtgcttcatatgctaggctatgtgcccagtgaacttcagcgtatccccctgcctcagtctcccatctcattggatgaacattgagattatagatgtgttgtgtggtgcccaaatctacatgggtcctgaagattcgaactcaggctgtctgttggacagactatcctcccagacaaactgtcaccatcttcctgagttcagctatgcttgcttgcaaaagatcaccacagctgtgcttgtccactgctgaccctctctcattgaaggaggtagagggagggtcatgggaccctcacaggaatgcccagccaggtcttccagttgtatgggattctgccctaattgtaggtgctttaagatctgctttcaggggctggtgggtaagagcaccagactgctcttccaaaggtccagagttcaaatcccagcaaccacatggtggctcacaaccatccgtaatgagatctgatgccctcttctggtgtgtctgaagacagctacagtgtacttacatataataaataataaataaatctttaaaaaaaaaaaagatctgctttcagatcattcacactcttgcccatcgctcccactgctccataagtccacctgagaagccccttggttcccctgcctgaatgaacactggcggaatcatatctccttcatttattggtttgtcactgggactttagtaggagggagatatttacatgtctcccacgggagggacttttagcaatattttcacactttcgaatctcacacttatttggcaagtactttacccctggaccatctctcctggccttccatacttctttgtttttacatttgtattacgttatttatttacttttatatgtggataggtgtgtacacgtatacatgtaccacagaatgggtggagatcagagaacatcttgtgtgtgtgtgtgggggggggtcccttcttttcttccatcatgtgatccctgagaatcaaactgaggccatcagccatggttaccccaagtgattgataactttggacccatttgatcttaagacaatgtctcagctcttgctcttgctccttcgcctgcttgctgcgtgagactgagtaactgctagatccttggacttccattcacagctgcgactgaacaattgttgggaattgggctgctcctgactccccgcgggacttccaaggcagcataacttctggtccagactgggctgtcaggcttttccaggaaggatccaggaaccccttaactaatccaggcagtgacctgggagaactcaggagaacccgtggcagctcccagcatccaggatgttcactctgaccaaagccttggaaaaggctcttctccagcatttcatatacatgaaggtgaacatcgcctatgccatcaacaagccattccccttcttcgaagcgctccgggacaaatccttcatcactgagagaatgtacaaggaatctctggaagcctatcaaaatctggtccctctgtccaaagtggtgcacaatattctcaccagtctggagcagactttccacccgtcagtgctgctgacgttgttcagcaaggtcaacctccgggaataccccagcctggtggcaattttcagaagcttcagaaacgttggttatacctacgaagagaaaaacagacccccactgaccctgcttgaagacctggccaacccagcagaagggtgctcccttcagacactgctgccaccaccccgaccccagatatcgctgcctgttgcagccgccagcagctcgcaacatgaacggttcgactgagaaggctactcgagctgtaagagaggaatctagacggggcgaaagaagaaacggagctaagacaaattcattctgatcaaagctcaaattttattgttgggacactagttatgaaggaagggggaggggacccgattcccgccgaataatctcgggtccagtagaaaggtgcacgtgtgtggctcctcaggttccagcagtgggcgtggcagaacgaatgagcaggaagctccaccctgagcaagcaggtttcaggctgggggaggggagactacagctgccaagtcatctgtcctcagcaccaagagtctgtgaccccagagcaaccgcacagccaatcattgaggtcctggatgagcagcccagtccttctccccgagctgtgcctctccctggctgcattcaggaaggaaaaaccactccagtgtcctccagagatcaccagagaaaagataaggaagactctcgagagatgccccacagtccctcaggacccgagtcagtggtaaaagatgactctccagcagcaaatgacctggcaatgacccaggaagtaccctgcacacctgcaaacaagaaagcaagaagaaaaaaaacgtccgaactggtcaaattccaaaagaagacggcagggaaaaaaaaaaaaaagccccgtcaagatgagatgatggtcgtctcagcaggagtggcttcacctggacagggagttcaagagaagctcaaggcggtgagcaggaggactttgtggaaagatgactcatctacgaacgtgaaggaggtgaccaagacactaagagcaaggatgaggtgtgcccagacatccaattcacaagagatcagcaaagaggcatcaaaaacaagtggtagaaagaggcccagcacagcacgaagaaccacacaggtgcatcgagggtctaatgggtgaagaattcctgaagtcccaatgccttcgattcagcctggtccccactttgccacagattactcaagttgccatctaccatcctcttattgatccatcttgcgctgccatccagtgcaattgctcatccattcatctggacccagtcttgccttttaggctctgcagtggaactcaactctacagctcaaccatgaccctgcagtcaaatccaatcatgacttcagtgcctgtccagagggctcagggtcctttgttatctcaccctacagactcctatgacttcccagctgtctcccaactctggcttgtcaagtgtttgccaccttaactcttggtagctagcctgtaatatatagatatagggatagaggtagatagagatatgttacatatgacttatgttgttagtaagttataaacttatgtttaatgtatcagctaagagttagtaattatgttggaatggcctgtttgccttggccagggtcattaaggaaagcggagctatctgacagatgactaccagtgaaaccactgcttgtggatttgttattattcaataaaatgttttagaaagaaaaaaaaaaaaaagacaatgtctcacatagctcaagttggccctgagctcccaatgtagaaaagatgaccttgaatttctgatcctcctgcctcctccccaatgctaggattacaggaatgaatcaccgctttgggttgtccccatcgtcctgacttgtggaatagcctgggcttagttgtcctggtaatcatagaattctgcatgaacttggttgcttcctccaaacgcctcttacagctcacaggaagtgggaactagaggatcccggcacttcctattcaggctttggcttctgttgtgtgtgcaacagcagagtgatagttgaccctgagtgtccagcatccatgtctctgtctcctccatgacggtgctcagcatgctgtctgggctcatccagcccacactttgtcctctgtcaccaccccagggcaatctctggttactaaaaatggctgacatccagaacccacagatcggaagttccagagatggcattgctaccatatcaaaaactttccgctgaccagatggtgaccttttctgattgtgtttggcattccttccttaaagctcagggatgggtgggacagggacatgtacacagtccagaaacttcggtcacgagggggaaacctggaaaagttagaatcagagggaaagttttaaatatgtgcgttatttaccgcagggccccttcctatctgaatttactcggctcatctagcaacttaaaagatatctctgcattcgggtcataaactgtcatggttgatacccttagacacataacagcaaaaagataatgaaaaacactccctcttccccatctctgcatttcaaggttgggctgaaagagtacaaagacctggaagaaaaacctaccatctcctcccagtttcgttttgtttcattttgagacagattctcgtctatgcagacagatttccaactcactatgtagcccaggatgatctgaactcatgacccttcttcttcaacttcccaggttctggaattacaagtgtttaccatcggatccagcttccttctcttataaactccctcccacgtgctgggatctcagatgtgcaccatcacatcttagatctcttgctctccttcgtagctaagtgaatcaagagagctctgaatggaaccttctttttttttttttaaagatctatttaagtggatgtgtgtgtgtgtgtgtgtgtgtgtgtgtgtgtgtgtatgacagagtagggtgttatatccccttggagctggagttataggcagttatgaactactgaatgggtaatgaatcaaactcaggtcctctggaagaacaaagaatgaattatcaaccactgaactacctctccaggtcccgggagcttctcacagacagcacacttacttatgtggaggcagaaaggagccccaaggcagcaaaatgcgactggaacacatgacaagttagcttctaaagccctggggtagggacggtccctcccttcctaggtctacttgtttacctccccagcccgctgctgtagctgaaagagaggcatacaaatgaggaaggattcctgttctttgatttttgcctaagaggaagtctgatgaaggagggacagtgaccctgcctgccaccagagcaacacgtctctcttttttaacttaatttttcaaaagctttgttgtatgtgtatgggtgttttgtgtgtgtgtgtgtaccacttgtgtgcctggtgtggaaactggaagaaggcattagatcccctggaactggagtgatagatgttgtaaatgtctttgtggatgctgagaattgaactcagatcctcgggaagagaagccagggctctaagccactgagattcctctctagcccctccccctttattttgtttcatttcatttcatttcatttcatttcatttcatttcatttcatttcatttcatttttaaatagaagatcactatacagtcctgactggcttgaagcttgctatatagatcagctggcctcagactcacagaggtcagcctgcctctgcttcccaagtgatgggggtactgggaacagaactcaggtcccctgcaagagtagcaaatgctcttaacctctgagccatctctccagctcacacaccattctggctctctggagttgaggagacacaggaggccagtagggaagctagcctctgatactggaagtgaggaacataaaaccaccagatggggctcagtggtgaaggtaccctccagagggggccagcagcagcagctgttctctcagaggctgaaaaggataactgaagatggtcagaaagtgatgtaggtaggtacactcagcacagggcatgcactttcctgtctggatggtattgcagtccaagaagagattggaggcccaccatatgttccctttggtagttagaatgtgactctcacccacatgatcttgcccactccctacttcgcctgggacgtctggcaataccttggttgtcatcaaggcaggtcattgatccacagaagcctaaggcaccactaaacaggacagcccctccccacaacaaagaatatcctgtttgaataccaatccttgtgttacagacaaggatccccatgaggggctggagagatgatgtcagcattgaagaccataaatgctcctgcagaggacccaagttcggtttgagcaccagtcatatctccatccctccaattcccgaaaatctgatgcctctggcctccatgacaccagcactcttgtgaacatgagccctcaacactgcccccccccacacacacaaatacacatagtgaaaaataaaataaatccttaaaacagtcctaaatcagattatcttaatgcttagcagaaaatagttttaaattcctcttgtaaaaacctgacatgattctgcctacaagtcttggtccttttcattttgtgttacttttgcaaaagaactgggtctcactctatctctggctggcccggaactcactatgtcaaccaggctggtcttgaattcacagagatctgcctacctctgcctcctgagtcctagattaaagaccacacctagctcttattttaaaagtattattattgttgttgttgctactgctgctgctgttgtattaaggaccatacccagctattattattattgttattgttgttgttattgttgttgttgttgtattcatatgtgtctgtatgatgtgtgcatgtggacatgggcatgagggcactctgcacgagtcagttctctccttccactgtgggttccagggactcaaccaaatccattaggctcacctgacaagcgctttagccatcctagtcacctcagggtcttttgtttgttttgtatgccaggaagagtgtctctgtctctctctgactctgtgtccctccctccctctccctccctctccttttccctgtcctcttccccctccccctccccctccaacacacaaggctaacctaattatccataggggctggggctttagctcagtagtagagcacttgcctagcaagtgcaaggtcctgggtttcatcctcagctctggggtggggtggagtggcagcggtgacaataaccaaaaggaccaaaaccaaaactaaagcaactgaggaaacataaacacccaagttaaggctcacataacctttacaaataatactgtgtatgcatacatatatgtgattctgaaaccagtatttttagcttcatcctcttgcctgagctgcagaagaacagggcagtttgccctaggcccaccctaaaatagcacatctgttcttgagctcgacatggagcttcaaccacctaccacgtcctgctcaaccaattgtatcgggatctgcatgcgtcccacagctaaagtctctacacaggaatatcgagttcctttctacctcacgtacttgattaatgaggatatcagcttaactacttcaaaacatacccaaatgacagcgattaaacaaatagggggttacttcttccttgtataactctctagacattagtagtccatagcagatgttcggctccagtagagcagcagccaggctctttctggttcctgacatccctgagggctttgtcccagtagcttaaggccaaatccactttttgtgcagcagggtggaccctgttatgcttcaatagacgccatctccaaccagcacagcaccaggtactggtgacatcaggttgaaccagaaacaattgacttatttttcagatggtaaaaaaactgggtttgtggctcagtgacagaagccctacctagaattcccccagaaaggggcttagaggtgtgactcagtggtagagcccctgcctagaatcccccagtgaggggttggaggcatggctcagtgatataatacctacctagaatccccagggaggggttgaaaagtgcttgcctatcatactcaatgtttgcgttctatcactgagggctaccagaaaagaaaaaagtactcctcaatgaactgtcatggatcctctgtttcccatataccctgattaaaaggaaagttaacagctcaaaagaaaaatgacaacttaatacgactatataagaatgttgtgggctggggagatggctcagtggttaagagcactgactgctcttccagaggtcccgagttcaatcctcatctgtaatgagatctgatgttctcttctggggtgtctgaagacagctacagtgtacatacatataataaataaataaatctttaaaaaaaaaaaaagagtccttacttgtaccatcatggggacctgaggtcaagttcccatatagccctaagccccataaaaagccaggtgtggccgggcatgatggcgcacgcctttgatcccagcactcgggaggcaaaggcaggcagatttctgagttcgaggccagcctggtctacagagtgagttccaggacagcacagccggggtgacacagagaaaccctgtttcgaaaaaaaaaaacaaaaaaacaaaaacaaaaacaaacaaacaaaaaaaaagccaggtgtggtcacacaccactagccccagccctgagagaagacaagaggattgctggggcttgctgactgccagctgaattctaagttcagggagagaccctgtttcaagagaataacctggagaatgataaacagtataattttcaccctcctgtagcttctgtttacatgtacacgtgtgcatacaccacacacacacactcacacacggtcattaccaaatgagtggtaataaaagactatttttcatttattatgttgttgttacatgaggcctggaatttgctctgtaggtcggggctgcctctgcctcccaagtgttggtatcaaaggctcataccaccaatacccagcctctgctttctttttcttttcttttaatgtagtgtcactacgtagcccaggctagcttcaaactcttgagtctcctgtctcctcctcccaactttggggatgaccatgaatgccaccacacccagcttagcagaatagcactttggtgaaagagagtctagcagctataacctccctctgggacttttaacaccaggttgagacataacctgtgaaggcggggttggtctctcaacatccttcactgcctgtttaagagcatgggttatgggccctggagatggctcagcaagtaaaggcgcttgccactaagcctgacaacctgagctcaatccccggggctcatatggaggaaagagagacccagatcccagatccaacaagttgtcctatgacgtacacaggagcttgtgggctgtggcaagcatgcaccatgtgcaatcaatgaatcagtcaatgtttaaaaaaaaataaaaaggatctgggttatgggtctgggtttggggcatttgttctcatttgctgtctgctctttcttgctactctgtatttctctatcccactgtcttcccgtctcagcttgtcttttcatatctttgctgtatagttgtcacatgtaactctcgagtctcttactattcactgcacacgtagtacagtttgatcagccctacccttaattgaaaatgcaaaagaacagaatgtcccaggactccacctagatctcatttccaccaaagagcaccttcttgcctggtcttccagttaattaattcatttgtgtatttgtcaggttagatgtaggcgcaggtttaaaagccagagtgtgccagaagtctcacggatcagctacagctctgcacacttctaacctgcttctctgagatgactgttggccaagtccttcagctgtgttttctggcgggctcctctccgtttctaagtttatctgcttcttgatatttcagtgttttacgtgtattctgagaggttttaaaaacagaaaatgggggccatcaagatggctcagtacgtagtagcttgctgccaatgctaacaacctgagtgcaattcccaggatacacacacagttgctacaagagcactgactcccataggttgtattctgacctctatacatgcccatttccgtttctgtctgtccatctgtctgtcacttcctcccttccacatcccctctcaataaaaatgtgaaacagaacaaaaaaaaataggattgaattcccacctgtcctcacagtgtttagtattaaaactcagagaccttgagctgctgatccgcctgagttctggatctccaggctgcatcaccatgccagcaggaagctgttattttaattgttcgtgtgtgtagacttctctttccactaagatccatttcatgattaacaagctaaaaagccaagtgtgatgtcacacatctgtaatcccagcactcagaagactgaggcaggggaactatcacaagttcaaggacaacctccaaggaaaccctcaaaaaggactggaaatgtggttcaggtggtggagggctttgcctagcttgtgtgagagcttggatttgattccagcactcaagaagagacagaggcaggaagttctctgagttcgagaccagcctggtctatgtaactgaagtctcacctgctacactgtgagaatgattttgtttgtttgttttaagatttgtttgtttgtttgtttattatatgtaagtacactgtaactgtcctcagacactccagaagagggagtcagatctcgttacggatggttgtgagccaccatgtggttgctgggatttgaactcctgaccttcggaagagcagtcgggtgctcttacccactgagccatctcaccagcccttgtttgttttttaagaccgagtatttctgtagctctggctgttctggaactcactctgtagaccagcttggcctcaaactcatatatatgcctgcctcttcctcctgagtgctgggattaaaggtgtgtgccatcaccttcctggaggagagtgtctcaataacaaacaaacaaacaacaacaaaaccagagggtagagtgagtgcgccccctaaggccagaaggatcagaagttcaaggcaatctccggctacacagcaacctggaaaattccaaatcggcctgggctgatcttatctcaaaagaaaagaatcttaaagctgcagttccaagattttgctaatcaaacactaaccaataattttcccacccagaatgcttaatgtccaaaagtgtttgtgtatgcgtgtgtgtgtgtgtgtgtgtgtgtgtgtgtgtgtgtgcatgaagaccatcacccctgtgcggaagcagaagaaaactttgtggaatcagttttctctacccttatgtgagttctgggaaccaaacacgggtcacctggcttgagtcacaagtaccttcttgccagaccaacagctgtcttttctaattaatgtgatgtccggttccatctaatttcttgtaaataatgactgcattcttctttatgactaagcaataagacactgctgaacatatataaggggtgtgtgtgcgtgcgcatagacagagtctcactctatagcccaggctggcctcaaaggattacaggcatgaactttttatattattattattattattattactattatggctatattttatattacttacagctaatccatgtaacagactatgattatattttttttctcttggaatttcttttccaggacttgttccctccccccttctctcccccctgccccatctatgcgtgtataatgttcctgcgcttatgtatgcatgcttgcatgtgtgtacatctgtcatctgtgcacatgactgtggaggtcagagatcaacctcaagggccctttccccaatcttgccaagtcgaccatattagtgggtcagaaagccccagggatatgtctggttctggctccccagggctggggttacaagaacctactaccaaatccagcaaatccagcttgtttgtttgttttttggttttgttttctttttgagacagggtttgtctgtgtagccctggctgtcctagaactcactctgtagaccaggctggccttggactcacagagatctgtctgcctctggctcaggtgagctgtgtttgaacgtgagcactaccactcaactttttttccatgagttctggggatataattctggtccctctgcttgcatggcaaacccttctctctctctctctctctctctctctctctctctctctctcccttccttcctttctctctctctctctctctctctttctttcttcctctcctctctctctctttctctctctccctctctctctctctctctctttctctctctttgagattgggctgactgtgtctcactttgtatccttggctggcctggaatttactgtgtagaccagactgaccttgacgtggtagagacctgatggcctctgcctacctgggtgctaagattaaagactagtgccagcacacacannnnnnnnnnnnnnnnnnnncatgtaggtgctaggaattgaacatgggttctctggcaaagcaatcctttttcttttttttttttttttttttttaaagatttatttatttattacatataagtacactgtagctgtcttcagacacaccagaagagggcgtcagatctcgttacagatggttgtgagccaccatgtggttgctgggatttgaactccggacctttggaagagcagtcgggtgctcttacccactgagccatctcaccagcccgcaatcctttttcttttctcttcttttcttttttaaataagggctattgagatggctcagtggttaagagcacatccttttgcagaggacccaggttcaatttcccagcacccacatggcatctataattctactccaggaggatctgacacgctcacatgtgcatagtcatacatacacacatgtacat

SEQ ID NO: 1736 - DNA, 1147 bp, Mus musculus
ctcctgactccccgcgggacttccaaggcagcataacttctggtccagactgggctgtcaggcttttccaggaaggatccaggaaccccttaactaatccaggcagtgacctgggagaactcaggagaacccgtggcagctcccagcatccaggatgttcactctgaccaaagccttggaaaaggctcttctccagcatttcatatacatgaaggtgaacatcgcctatgccatcaacaagccattccccttcttcgaagcgctccgggacaaatccttcatcactgagagaatgtacaaggaatctctggaagcctatcaaaatctggtccctctgtccaaagtggtgcacaatattctcaccagtctggagcagactttccacccgtcagtgctgctgacgttgttcagcaaggtcaacctccgggaataccccagcctggtggcaattttcagaagcttcagaaacgttggttatacctacgaagagaaaaacagacccccactgaccctgcttgaagacctggccaacccagcagaaggagcaaccgcacagccaatcattgaggtcctggatgagcagcccagtccttctccccgagctgtgcctctccctggctgcattcaggaaggaaaaaccactccagtgtcctccagagatcaccagagaaaagataaggaagactctcgagagatgccccacagtccctcaggacccgagtcagtggtaaaagatgactctccagcagcaaatgacctggcaatgacccaggaagtaccctgcacacctgcaaacaagaaagcaagaagaaaaaaaacgtccgaactggtcaaattccaaaagaagacggcagggaaaaaaaaaaaaaagccccgtcaagatgagatgatggtcgtctcagcaggagtggcttcacctggacagggagttcaagagaagctcaaggcggtgagcaggaggactttgtggaaagatgactcatctacgaacgtgaaggaggtgaccaagacactaagagcaaggatgaggtgtgcccagacatccaattcacaagagatcagcaaagaggcatcaaaaacaagtggtagaaagaggcccagcacagcacgaagaaccacacaggtgcatcgagggtctaatgggtga

SEQ ID NO: 1737 - protein, 345 aa, Mus musculus
PGRTQENPWQLPASRMFTLTKALEKALLQHFIYMKVNIAYAINKPFPFFEALRDKSFITERMYKESLEAYQNLVPLSKVVHNILTSLEQTFHPSVLLTLFSKVNLREYPSLVAIFRSFRNVGYTYEEKNRPPLTLLEDLANPAEGATAQPIIEVLDEQPSPSPRAVPLPGCIQEGKTTPVSSRDHQRKDKEDSREMPHSPSGPESVVKDDSPAANDLAMTQEVPCTPANKKARRKKTSELVKFQKKTAGKKKKKPRQDEMMVVSAGVASPGQGVQEKLKAVSRRTLWKDDSSTNVKEVTKTLRARMRCAQTSNSQEISKEASKTSGRKRPSTARRTTQVHRGSNG

SEQ ID NO: 1738 - DNA, 67810 bp, Homo sapiens
tatactgtattttaaatttttatattactttttattgttgttatttatgtttttaatttttagaaaatattttgcattcatggttggttagatccatggatacagaatccacagataagaagaaatgaccgtattgatgtacttgtctttttttttttttttttttgagatggaatttcactcttgttgcccaggctaaagtgtaatggtgtgatcttggctcgccaaaacctctgcctccctggttcaagcgattatcctgcctcagcctcctgagtagctggaattacaggcatacaccatgacacccagctaattttgtatttttagtaaagacagggtttctccacgttggtcagactggtctcattgtcttacattttttaaagatgatttccaggcttctctgaccagatatgtaaaaaataccagaacagaagaataaaaaaagcagaagcagcactcactctctacctgcttgccttttttgttgggtctcatctgctttcacttcctcctaccaagtattcagagatcctgaagtgattctagggctaagagccacatagatgggctcagagcagaaccggtccccaactacacagcctggaaagtgtgacaacagacaggcgtttggattttaattcttctaaaaagatcctttttagacagagttgtcttttggagtggggataaaggaggcctgggggagaagagagggttcagaggtcacggggaatcatccaatcctacacaaagcctcagaacaggcatgatgttcaaacagctccagtccagccatttgcagatgtaagagaataggaagatgatgtgagtcacggcatccttgagtttctccaacagccaatccctgcaatttaaaaaatctgattgcctcgttatttatttgtaactgaattctattgtatacctgtagagtgaagctgggtagacattaaataacaagtatgaaagggaaccctaccagagatgaaggacagacgggaaaggagacgatgacccacctgaagttgagattgctgtctccacttgccatctgcccctgctggccctgctgggccatgagcttggcctaggatcacacccgattcgattttcactgccccgttccttcctgcagctctgaggtgaagctgccaactgcccctcggtgctcagtcaaagaggaaaagaaaagtgaaattgcctaactagctgacgtgggtgcaccaactctacagtcctccctccacccaatctccatgacgtctctcagtcaagggaggaggagcagagccagccccacgaggccacggaagacagggtcacttgttcctgccaaggaaagagggtggaaaagtcattcaactcaagcagatcaaagttgttttgaggtaaggtggcatcatgaggaggaagtaaactctgtatttgtccccaccccttgctgaggtggctgagaaggacaagtgaagaccagacatttcaaatcttcagtcaggctccagggctggccatgcaccttagtgagcctgggctggatggcttaggcccagtgtttggacatggggccagggagaactgaaatagcatgcattagaaagtgggggagatgctcttagcactccatgaaagcagacagaggtaaaagacaactctctcaactcctccagccaaaggcaagtgctgaggttgggcagggaaatgaggtgcaattctaagttttctcaaatatgtgggcactttacaacagcagccaggggtgactgggaaaaaaatgagcttcaaccatttcactgaaatcttgaggagagtgacagccttctcactggatggggaaagggtttggagctgagattatctagaccttcaaggacaatatgatacaggaggatagctgtattacatttatgtttgcacacaatttttcatttatacccagccctcattctgtaaaggatttgaaacaatttacaaaaacacactatatcagcataaagtcgagtgataaacaaatggaagcaaagggcaaatataaaaaatataaccacaggactagaaatccaggcagaaaaatgggtcaaagacagggggctgatgagagccagggtatgggtagaatccagggccagtgacagaacagtagtgaggattgaaaagccagaggcaaagcagtatttttccaaaacatgtgctcctgaatcctactttttctggttcattacacatatgcaaggaaatttgcatacataagtttgcaaaatacagagtgcaagaaatttctaccccttccacacttctgctttctttctaccaaaggaacaaacaccaatctggttgagacaaactctagaacactgatgaggacaccttttccagtatctctctctctctcctctctctctctctctctgtcctctctctcctctgtctccctctctctccctctctctccctccctctccctccctctccctctctctccctccctctccctccctctttaaaacaagaaggaaaagtatgctgggcttctgttagacacagctgtcctctcctcccagtctccatggggctccaacaaggcctggtacagactataccgcctgctccagcatcccctctctctcttctctctgcccttaggcagtaggcagacccaggacaccaatgaactggacatttttgaaaatgtgccagcttcttttgcttataagcacaaggccattggtgttcctcagctgactggtggtaagattggtacttcaggggtactgctgctactactagaaagccctactttgcaacaccatgcattagcccaggtaaggatagcctgaaatttcagttctatttcccactatcttgtttttccctatgctcactacagaacctctcctgggtaagggattcctgggccaggcatatgtaggaccatcagaccatctctggttcccaatgtcttcctttactgccacgtgaccagtggagtcagaaggctccggcctgcctcctggctctgttcccccatccagatttaggccaagtaggtcataatccccaaaggtaaatcaatgctttcattctacctggaagatttctcttcattttgctaagcatgctagaatctgacacctggaattggggaaatgaattgtatagagtcttgatcacaatccagtgctgtaatttaatttgccaacttacccctatttgcccacaactccaaaattcctgactctgaacgctaatggggatgttcactgtttttatgtccaattatgtcagataaccaatcccagattgatcatatttccttgaatatctcttgcctataattcaacctctggtgcccaacatttttatcagtcaggatttgggagtaaaagtaatccaaactgactctggctaactcaggcaaaaagtcaatttcttagaactatattgggtagctcacagaatgtatgggaaagccagaggactaggttaagaaagtaggcagtccaggcaggttatattgactcacttgccctttgtcataatatagttgaaagatatctggatcacctggacatcccatagaatgtcagactgggctgggcatggtggctcatgcctataaccccagcacttcgggaggctgaggcaggcagatcacgaggtcaggagatcaagaccatcctggccaacatggtgaaaccccatctctactaaaaatacaaaaattagccaggtatggtgatgcgtgcctgtagtcccagctactcaggaggctgaggaaagagaatcacttgaacctgggaggcggaggttgcagtgagccaagattgcgccacagcactctagcctggagacagaccgtgactctgtctcaaaaaaaaaaaaaaaagtcagactgattgatgacatcatgctgatcagacaggatgagcaggatcttggtggctagcatacctgctaaagaagaataaattactgacccacaacaacagagatgaatctcaaaagcatgatgatgaggaaaagaaagccatacaccaaaaatgcattccatgtgccttcattgataaaaaaaaaaaaaaaaaaaactttaatacacacgaaactaatctgtggtgatagaaagcagatcagtggttgcctggtgctggccttaaggaggggattgtttgcaaaggtcacagggaactttctagggtaacagaaatggtctgtatctttttttttttttttgagacagggtctcactctgtcactgctcaccagagactggacctcctgggctcaagcaattctcccacttctgtctccctgatagcggggaccacaggtgtatgccaacatgcccaattaatttaaaaaaatgtatttttgtagagacgaggtcttgctctgttgtccaggctggtctcaaacacctgggctcaagcgatcctcctgctttgacctcccagaatgctgggattataggcacaagcgactctccaggcctagaaatggtctacatcttgactggtgtagtaactacatttggtaaaatgtacattacaatgaataaattttatacctcaataaaatggagctaaaaagaattatgtataatttatctcagtacataatcactagcatgtgaattaacaggtgacgttttcccattattaccatgttctcaagcatgcatttttttttttttttttttgaggcgggatctcactctgttgctcaggctgaactgctgtggcgcagtctcagctcactgcaacctccagctcctgagttcaagcgattctcatgcctcagcctcccgagtagctcggattacaggcatgtgccaccacgcccagctaatttttttgtgtttttagtagagacgggattttgccatgttggcaaggctggtcttgaattcctggcctcaagtgatctgcctgcctcagcctcccaaagtgctagctaagctacaggcctgagccactgtgcccagccaagcatatatggcttagaataaacatctttcatcctcattcgcagctgtctttttttcatgtaacaatttttgcctgatttgacattgactttattttcccactcctgctttacttttgtttgtttgttttgcatttgcctggtgtatctctgaatagatctaaaggaagaagttcttgctgccaggatcctcagatgcccatgaaggggctttccaggtgatggggaggggcttcaggtaagtgacatgtgacatttgcataaaataaccttaattcctttaccaccgccatcccctgcatcacagcgctgtatgttactgcatgctgaggcatcaatgcaccctctcctcagctgttagcattgaatttttcctggctgtggcttccatgcctctgtttcacccacagccattacccgcaaggccgggtctgctattctgtacatactagggtgggatatgctgtttgtgcctgcatagaagggcttgctcttatgcagttagccttggtttcaaagcttcttaaactttagatccatgtctcccatcttttatctgaggagtttgtggatgtcctggtaggggaacttgtgggtcaaatacatttgagaattattgatttaatcaaagttacatagaattctttttttttttttttttcgagatggagtcttgctctgtcacccaggctggagtgcagtggtgcgatctcggctcactgcaacctccacctcctgggttcaagcaattctcctgcctcagcctcccaagtagctgggattacaggttcccgccaccacatctggctaatttttgtatttttagtagagatggggtttcaccatgttggccaggatggtctcaaactcctgaccttgtgatccacccatctcagcctcccaaagtgctgggattacaggcgtgagccaccgagcctggcccaaagttacacagatttctatagtgcagtggtgcaatcatagctcaccgcagccttgaactcctgggctcaagcaagtctccagcctcagcctcctcactaactaggactacaaggtgcatgccaccacactcagttaattttttatttttttattttttgtagagatggggtctcactatgttgcccagactggtctcaaactcctaggctcaagcaatcctcccatcttggcctcctaaagtcctgggattataggcatgagccactgtgcctggccaatagtttaggatttttcataggccccacatgtcaatgtacattagggatctttaaaaggggcatgagaaggggtgtccctgccagcccttgagttactgctctctggaatcagcaggtcccagttctgcctcagactcctggctcccaactacctgcccagctctcagccatttttctgcctggaggtctgcctgcctctgcacaattccagttcatgtgcaggttccctttcatttcaatttcttcctgtaataatcttatcctgacaagttctaggcatttctggcacattctctttgtttttttgtgtgttgttagagtttgataacacactggataaattccagtgaattcattcagttatgtaaacatcaccacaatccagtttgagaacattttcatcaacctaaaatgtacagaatgaggacaagtcatgggaaaatagatgtggttagggaagcatttggacgctgagttcccagttcctattgccgctggggctgtacccttatgcctcctcctcccatacctccctctctgggctgatcccaactggcaacacgccctcccccaaaccccaactgccaagacgtcctgggagcctcacaagtgcccatgaggaggtggagagaggctgcaggcaccgacctgccttcagcttccggcttggcaaactccgaaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggtgagtttctgtctttgctgctttattcttcgctcttggtgactgcagctcttagagttaacttcgcggcagcagctgcagggtggagttcaactatttaaactctgaggctctctcagagctcagacatgtggtacttattaggagactgttaaaagggggcacatggagggaacactgacacctctttttttcgccagagtccagcctgttattgtgaatggagccgagatttgccctctaccctcacctaagctctgatccttcagtgcccgcaataggcggctcatctgttatccattgtgtaaatgactagaggtacttgggaagctggtggaaaagaaaaaaatgagagtacatttaatttcgtctctagtgtatcatgaactttttatatattttctctaaatacatgattatttccttgaaataaattattagaagtggaaattcaaaggagcacatgttttaggacatttgacactgattactaaatcagccttcagaacatttggacctgttgaccttcccactcacagtgtctgagattattactattattttctatcttggccaatttgatagacaaatatgttatcaaattgtcttcatttacactttttttggttgtttgttgttgttgttttctgagacggagtctcgctctgtcacccaggctggagtgcaatggcaccatctcagatcactgcaacctccacctcccaggttcaagcgattctcctgcctcagcctcctgagtaactgggactacagatgtgcaccaccacgcccagctaatttttgtatttttagtagagacagggtttcaccatgttggccaggctggtctcgaactcctgacctcagctgatccgcccacctcaacctcccaaagtgctgggattacaggcatgagccaccatgcctggccttctttatgctttctactagctagttaacatgcttatcgtattattcattgcacatttggcttattcttttatcactctctgttcatgtattttgcttttttattttctagttggatgtttgtcttttgcttattcgtttgcaaaatctctttacataataaaaatctgaacagtcatatatgagatgtagtatcttgcatagaaagaaacagggctttagagtcagacaagctctgctttgccactgaataccttgggtgagttactaaacctctctgtgcctccctttcatctttgggactcatgacagatgaagaatgaggaagctctagacttcctgttctgagcgctgctgtataatgaattgttctaaaaggagcctccaagaccccttcctcttcttagtatatgtttactctgcctttctctgactttgcactgatctttgcactatctccttcccctgtgcatattgtggatagtagatttctctcctatctgttctctatcttccaagacttctttaccaccacagactctcaatggcatcttttcttgttttcctatgcgattgcggattattcttttcatgagtatttttttctgccaagttaaaaaaattggggaatgaggagaaagagactagggtgcttaatctgccactgggattaaatccctgtaaacagttgttaattacgatttacttttctgttcaacacaaaatgaagttggaaaagtggaatccatgtttgttctgtttgttaaaaactgtcaagttgattgaatgttttgttagtgcttttccttttcttgacaatttgtcaagaatgtcatttgtaaactttcttcccattataacctattgatatctcctcacagtccataaatggccaatctttaatacatgctgcatgggcatgggaaaaggcgcatgtctgagacatgaaatggttgcagtgaacaagtcagttaagtcacttttactaagtatgcctttctcagccctcatgcttttatttatgcttggcccatttgtgttgaagattgggagtggttcgttaaagtttccaaatattaccaggtttccagctgaactctacccattttagggtggtccctgttgcatgagcattgctagttaatggcttcagccgtagcccaggtcatcttgtttaacccagatcagtgtggccatagaacacatagttagcactgtaagcctggaatcaggatttgctcccagctcttccactctctagttgtgcaaccctggggcaagttattaaacatttctgtgtctcagttcctcaacagtataaacaggtgcagtcataggaaccacctcgcaagggttttatgaaaatcagataagttactgcatatgaaacccttagaacaaagtctggcacacaggaaacactccataaatattagctacttttaataccttccttatgtttacctgcagcgccttgggattctgtcattatattttcagtcactctcagcctccattgttgctgggaattgtccttgtttcctatacccatgagccttttaggcagacattgctttgcaggctactaaggatgcctttgggaccagaatgcttacctttagatctgcccatttaatgcagagagaagcttcccacattcctcaaggttttgcttctattttttttttttttttttttgagatggagtctcactctgtcacccaggctggagtgcagtggcacaatcttggcttactgcaacctccacctccccggttcaagcaattttcccgcctcagcctcccaagtagctgggactacaggcgtgcgccaccacacccagctaatttttgtatttttagtagagacagagtttcaccatgttggccaggatggtctcaatctcttgacctcaggtgatccacccacctcggcctcccaaagtgccgggattacaggcatgagccaccgcgcccagcctttgcttctattttttatcatgcctctttccataggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggtgagtcatgttgaacccttccatggcagcccagcccccaccaatatgcctgattattaaagtctcaaaccacaaaccaccagggcttccagagtttggaaggcccagcccaggcatgttcattatcacagaaggtgggggtagttaggagagagggtgtcataggggctatgttggtttctagggtgtcataaggactgctgtaacaatgactacaaaccaggtagcttaaaacaacagaaatatattctctcaggtgtggaggccagaagtccaaaatcaaggtgttgacagggttggttccttctagaggccctgaggagaatccgatagctgcctatctcctagcttctggtagctgttggaaatccttagtgttccttgccttgtagatgcatcactctgatatgttttcatctctacatcacctctcttttgagtcttctacctaatcttctgaggacacttggatttagggtcaccctaatcaaagatgattttatctcaagatccttaacttaattacaactgcaaagacactttttccaaataagttcacattcacagattctagatggatatatcttggctgagatatatccatccaacattcaactcactacaggcatcatcccaatttataacagctaatattgctcacagtgcattctgatgtgagacaggcaggcactgggagatatgctatgtggacaaaagtggacctatttttatataattttggtttttaaaagcattaattgagccctagactcaaggaagtgccaataatcttcccttagtcttagtctggttggccccaactccctcttcagatcacagcccagagagcactcctcagagacatctccttggccaactcatctcatgaagaccccttagttattcagttccatagcaatctatgctttccctccgtaacactactctcaattgtaaatgggtatttatttgtgtttattaatgctcatcttctccacttgacagtgcctaccctgacccccaaatataggcaactccatgttggtcttattcagtgctgtgtacccaaagactcgctgaccgagcctagtagatgttcaataattatttgcaatcagttctctcttgccgtatttctccttttgtccatcctctaggcaaggaaaattctcagggtgacttctctgtggctggaatccattcaggcttatctcaagtttgagagacacagagagagactgagcagaggctcacaagcaaccagcagaattgcctctgtgaccatcactagaaccattgctgaagtatcctgcccacagctttaaagaatcaattacatagtagcatcctttaaccccactttccttccttcaaatttctctcgtctcaaatgtgcctgaaagttggattcagaatatagacttactttaagaaagctaaattatttatttttgttgctagtcatccaaatatgtgtaaagtttcaaaaataagcatgtaaaactgtgaccgctctaccttagagaatgtgactatatattttatgttgaatttcttcttaaaagagtaaggtagctttcttaaaacttagaaaaccataaatgtataacttcccattcaattttatagtcatttataaaaaccttcactccatttttataggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtggtaatgagatttctcaagtgctttttgcatttaaaaagttgctatggtaaaagtctgggtttacttctagccctgtggaatatgcacgttaatcccccgccttctctctggggtggaatggaccatattctctcattggtacagctgcaggagcagccccttgctaaagctgatcccaactctctaagatgaacttctagaggacataaacatttcttatgtgttctatgaatttggaaaaaaatcatacaatttggcatactggaaaatctatagggaatgcataaggtgacagaaatgcaaagttacaaagatcaggtctggtggaaggacaaggagagccagggaggaagaaaaaatgaatgtggacggataataataagtatctttttttggtgccttatcgcaaacactttatttgattatctcacatcatctttaaaacaaccctttgaagtcatttttaaccccatttgactgacagagaaattaaagcccagaggtaatcttcccaaaattacttgttggttaagaagcagagcaagagtcctacttgggtctcccaataccagggcccaagattttaaccactagtccggacaaggacagctggaaggcagattgtaaagccagagaagggaaaaaaggtagctacagagaaagggagtgaatcgcaaacatagccacagaaagagagggtctgagaaagaatggatcatgaagtacgtagagaaagaaaagagactggataaataaaggagtaggaaaaagaacagtggcagagttgggaagaaatcagccagggaaagagagaggcagtaaagtcattttaggttggaagtaaaacactgtggccaaatcacatgttcacttacctcagaacaacaagcaaaggaccaccagctcacattggatattttcattagtggaatcaccattgttgacagttcctcctttgctctctgacacttcaccatcaaaaggcttccccctgaagggagagatgatttcttgagctacatggacagtgaaaggggcaagtccacctccaggtaggggcagctacagagggcccactgtcctggcagcatctgggcaatactaggagaggcatggccttaaaggctatggtaagaacatctgagaaccatggggacccacacactgatgtgcccctgacctggctgagcttcagtcatcttccgggatcttcaacctgatgattttgttctgaatccctttccaaaatttgaagttactttcctttttccattcactggttgagaccatttacttctgaaataaatgatggagaagaatcttaagagaaacccagcactagccatgcaagggaatagcatgcagaaagccaagggtctggggtattgtggatgggagagaaagctgggtgtgaccagatcacagggtacaatagaaggcacagaagctgactctgcagaaatgagcagaaaccagaatataaatgtcctaatacaccctgctaaggaatttttattttctcttatttgcttcggggaagtatgatctgtttatttattaaaacagagacctcttttaaaactatagcatgttcattattgactaaattatatgacaccaagattaaagaaaagttaaacccctgggtacaaacccaaactcaacttttatgtgtgaaaccattttggtattagatcagggcttagatgcacttattgtagcactcaatgcccaaaccagataaataaaatattaaggggccacaaatggataatgatgacaatgaatcagttctctgcacctgggggacaatgaatagctccatgcccccatcctattggaaggcatgtattaagaaatccccttccccaagtaattctgagtctccagggtactgatgtgtgtcccttcaccaatcccagttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcaggtgagaaacagatcccatccaacacctgtatatcctcagcctaaggtgcctgtgccatgttgccgccaatcccagcatcttgacttttattgtcctagttcttctcttgcacccacctacccaaacacaacccttttcaagagggattatgagcactgccggggggtgggtaagacctagagtccagaacacctgcttcccactcccgggacattccaaccctctgcccttgtgccttgatgctctatctgccccaggcacttttaacattcactcttctccctgacatccagtccctgcaatctgtaataatttcctttcctccttcagtgaccaatgacaagttaacatccaaaatgaatgcggaagaagactcagaagagatgcccagcctcctcactagcactgtgcaaggtaacactgactggggctgataccgcttagctcaaggtgactgtgaagggagaacatgcgtctgccaaccaagaggctatggtgggaaccctgggaaaaagaactgagcaatacaaaggaaaagaaacagaaggggccaattcaccaacgcagcaatgcaaaacaaaccaacaaccaaaacaccattctgaattgacaagtaacctgcgtaacactcacactagtgacccttagctgattcctcacccccacctgattatgggggccttagagtttcaacattcttcatttttatatggtttggattctaagaacaatgttatcaaaattactagaaaagatgataaaatgtttaaaggtctgctagacctaatatttagcttctcaaattgtatcacttgtcctccccaaaccatcatcataatggagtttgattacattaaacgtaagaatggtatgatattgggcattgtcaaaaatgataccatggattctgagctctccagtactgagaagaggggtcctcttcgatccaaataatattgcatccactcctctaatacctaccatccaaaaaggttaacataatcaggaagctaacagcaatggaagaacaagtggctaattgagagtgaatggttgcttactttcccactctatgccatcctttcccaggccttggttgctgttaccccgtcatttttacttgttggaatagagcattctcttttctcctcattctggtccctgcttgctgttcctgagatctaaaactttttcttcctccattcagtggccagtgacaacctgatcccccaaataagagataaagaagaccctcaagagatgccccactctcccttgggctctatgccaggtaatcttggtttggtcaacctaaaagcttgcctttgtttctgtgtttactaagaggaaaagccattcggatcttctagagagggggctctcctcctgcctctcagcaatcttggcccagcttccagttcacccagcacttgggagcttgaacaggcaggagacccgacctctgaatggatacagagtccctgggggagggcaaaggaggcaagtctggaaaaggtagacttggatagggccacggatgatgatggacagagccccaccagtgcctgtaggtttggactccaaatgccacaaagcgcctgaaagggaaacattcacctgccacaaagggttgtggcaggaaccccaggggaaagcaagggaactgagtcaggctggactgtttgacagagccactcttctgaggccacttcaataaagtagtgctcaaaacggctctgtcaaaatgcaaagcaaatgaacaaaaacactgtgtggccctaatagtgaattgctgcagcagacatggatggtcctccttccaagcccccacctgactgtggggaattttcactttcaaccctggtcatttctatatcacttggagtttaagagttgatattatgaatataacttgaaaggtaataaattattccaaagatctaatgactgcttgccacctgcctcagtcacctattcctaagcaggccagcatttgagaccaatctcaatgcagtgtgtaaagaaaaaggtgacagcttcatgtgagatgagcctttatttgttatggcttcaagttctctgtctttctttgtgcagcaaaaactagcagagctttatatgtctttgctgttaacaggtgctagcaagcacaggctagctcctgctttcttcaaacaatccttatatacagaaatatataaggcatttagccttctccactatttctccaagtaaaataaccacagatagagcagttaaagaatatccacacatagacgtcaaagcaataagatgtatttttcatacagcaaagacattccccttcatcatggacatcagatttcaatatcaccactttccgctctcagcttcattccttgagcaggggctgctgggagcagaaaccatgtgactatagtcatgatacccagcacagtttattcctgcaatttccattcattgcaccttcttcactcacttctcttccatccataagataatctctctaaaaggatcagactgagcctctgctgtggggcagttgtgccctagttccctgtgatggtcgcacaggtaacaataaccacaagttggcaaaaatcaagacagagccagggaattcttagggcaagcagattcccggccctgggctgcatgtactttctacttttctagttcttgcattgacttccctcagcactttctcttcactggatctgagctctgaaatgacttatatttcttttgtcagagataagagataattctccagaaccaaatgacccagaagagccccaggaggtgtccagcacaccttcagacaagaaaggtaagaaaagcctttcttctgtagaggtcagaagggtgaattcagagttgctttctgtttttctgactgtatcttgtcaagagcaccactatgtgaccacagtcctgatgccacacacagttcgtttctgcagtttccatttgctgcatcttccaaaaaggcctttatgaaaattatcaggaaaccagaaggcatttgggggtattgaaatatgccattggaattgcctgttctgaaaaaatcaatctcctatattcacaacttcttagagtgttaattgcacttccctctttaactgaaagttggttccccagagaggaacccacttcctcttaagacatggctaggcattctctgccatccatcactcacacctcatggtgagagacaggttagatgtctgtcctttgctgcctactggccccatccagccccttcctccctgatcctctcctttgagtcttaaccattcaattaaaatgttcactcactcatcatcaatatcatccaataatttccccaataatcctttcaaaagctgcttttctgtcatttcaagtcccagcatcatcctagatgccttcagggtacacacggataacagacaactctgttatccaatactctggcccctcaaatccttcatcttctcattttccatgactttttcctccaccaattcttggcctcccatacccaaaggcaagctatagaccctatcgtcattcaaacctggctcgatttcccaacagttaatttcagaattccttttttgatacctgtccttgagcttttctccttttatagctatcattcaacctctgatcactctttcccagcccaatcctaacaaaagaaaaagaatcaaaaatatatttttctgtgcttatttatttgttgtttcctctgaagttgtccttcaacctcatttggatcaccagtccactggcctttcctccttccaagccatcatctgcttttctttgcttcccagctttttaacattgacactaactcacagtccaagattcatcatttcagtaatctattgccattatcttaaacctgcctttcctctctgccttttcctagaactctctggcaagtcttggaagaccctacttacctacttcctgtacactgcatctgaaagccagcagtgctggagagagttccacagcagggcagagtgcactcactggtcttcatggttccagcacaaatcatctctccttactgtgtgacaatgctacttcctgcaataatcctttcaaacctcaagccctatttttcaaacctctgaccccctcacctcctgctttttgctcaatcagtgactttccctcctgcaccataaggagatatcagatgagaatccccttatttgtgctgctagtcctacaaaccctaactacatctgtctccctcctctccgagttccctccttctcttctaagacaatccttctgcctcatcttatagtatccatgatcccttctctctcaagtattcattaaagcagtatgtctcacacaagaatctgcattacatgtatcacagctcattaaaaaatgctttttcttgattctcatctcacttcaactacttccatatctctctccttcatttcacaaccaaacttctagaaatgagctacctaaactccctgtctctatttcttcgtttctccttttcctctgtcattttagagtccttcttcccctattactccctgaagtaccatcacctaaggtcaccaatgaacttctagcaatgtggtttgaagaccaaaagtaaaagctgaatatcattgacatacaagattgggagatcaatgtttgtaactataaaacattatcctttctttttaggaaagaaaagaaaaagatgtatctggtcaactccaaaaaggagacataagaaaaaaagcctcccaggaggtaagatgagagtacaagaggaagctggaggctggaaacagctcatgcagggcttgtaggtcaagctgtggagggttgaattttattctaaatgcaatgggaagccattgaagagatttagtcagtgaagtgacacaatgtaagctcaattttgctacggtgtaaagaatgagttggagctgggaaagaatggaggcagggcagccattttggggcagatgccatgagagttcttggtggcttggattcagatctgacagtggagatgcagagaagagtgccaattcaagatcagttttgcaggtattgttgacaggatttgacatattattagctacagatgagaaagagaaaaatcaaggcccactcttcaatttctggcttgaacaagtaagtggtaatgcccattgctgagggaagatgcaaatatattgggggataactcttagagttcaattattgacctgttcctttagaggtttctgctagccatctatgcagctgtgtatagatgtgtgttttgtcaagaactgtaaagggtctaagatgttactccacttgcattggtatctccttatatatatgagtgctgcaggaacacaaggtatctggtcagggaaaataattctttactgatattcacaaccagcttatcagccagagcaatattgcagcgtctgtctcccatacacaaacccaaaggcaatgctaagagagctaatggaatctttctattcaaaatagactacaactcatgtataagggatgtagaatgatggatttttctgtttagatacatgagagggatagccatcatcctttcctcctgaaaggaaaagaaaaaactttgctgctttgagataaaatggaaaagatcctcgttccaaagctctccatcctaacctttggaatttaaatgcatctttccaaaggccagagaaactctaggtgttgctggcttttacaacctaaagatgtctccaagttctgggctttaccccttgtgatatataaatacctagggaaagaccactccagttttcctggtactttaggatttaacctaggaagctagtcctgggtgaacccatttggccatctcaggagataagagaggttctattctccctctagatcagagtaattaactagaaaaatagctatagctctaattctcatggtgtgggaagaggaaaatgtttctggggaagtgaaagcaagtatttcctatatttatattgcatacatttctgtgtctccgggactagggctttttacaggaacactgagaaatcaggaagttatattccccacaatatggcaatttggcactcactgaaaaagtgtggtccatatatatatatatatatatatatatatatatatatatatataaaatctggaccagataatatataatatctggaccagatatatgtatatatatgagttatcaataaaataaaggtattctgatctatgggagaagaaaagagaaccacagacctagccctgctctaagtaatcccagtggaagaggaatctagcaagacagactgagggaacgagaccagtgaagacagaggagcaccaagaaagaacatgttagcaagccaagagggaatggttgactatactgagagactaagataaattcagagaagagggccttgagtttggtcacaaagaatcactggaaaatttaagaaaaattttggtgatggaggcaggagccagttgtgtgggaaggataatgaatgggaggtgataacatatgtagacaactctagctgtaaaaggaaacagagcaatagatggcagcctaagccagtggcttaaagctcctcttccctgacttagtttatcattagtatgatcccagtgtccaaaatcacagggctggtgtccttttaagacacttaacagaaatgattccattctaagaaaagtaagtgaccttcctgggcaggaaggagagacaagctgctttctcccccattctacttattagtcaatgccctctcaccatgttatgtgtattctctatgggcctccttggttcattgtaaactagtcagattattcaactcacacttctgagctttgtcaatcactctcacaacttcaattaccacctttatactgatggctcccaactctacgtcttcaactcaggtttgtcttcaagaaacacatagccagctgcacactgggcgtctttgtttgcaagtctcccattgacactacagtctcaatatgcctgaaattaacttcaccttctttaccaaaaacctagtcttctaagtaccattcagacatttattccaacaaatatgcagtgagcactaactgtatatacccattctgaaagctgaagacagattttttttttaaagagagaaagtaagaaagtaagcaaaaaacaaaggggaaagctcatggaggttacatcctggctgggggaaggaaagaatataaactagaaagcacataaacaagataatttcaagtactgatgacaggatgaaagaaaataatggataggattacaatagtgacttgcaggttggggtgggagtcactttggattggatggtccaggcagagggactcaaaagtgcaaagaacctgaggcagagaggaaagaccagtgttgttggtgatgatgaagaaagaaggtggtaggaagtgaaaaagtaaacaagaatcagattatgtagggtttcacaggcccttgggagcctgttgtagtttaacttgaaatgaggaacttaatctacccaggtgccaagcaaaaaccttagtcatccgtgactaactgaactctattagcatattgacaaggtctattggttcaccctcttcttttctacattaaaatctaatttagtttatttgccatgcttaaatcttgtccatggcctcctattgccccttagggtaatgtcactgtcccttaatgtgattgttaaagttctatccagtctaactcatgccttaccctccaactattaatatatctctttccactcaaaactccagtcaaccactctgaacttcattgtcttcccatttcatttctctcccctttgatccttggcatgtgctattctctttggatgctatattctgaacctacactactccccataaatgtttagttatctccttttcatcagtcgtgttgacttatgtctatctcaggaatacatactctgacccctaaattagccaagctggtcccataatttctacagcacccagcactggctcttttggaaggttccaaatactctattgtaattacttacataatgtgtctcttctaggctagatggtaatgtcctggcacaaattagctattaatttttttttaatgaaaaaaaaatgaaagaaaccatactttctgtaacccaaaatttgaataatgatctgacaaaggatagtttatgaattcattattgtgttatgaaaaggggtcatagacattatgggcaccacgtggtgtagatacaaactaaaggttattggagggaaatttccaatacaattctccaaattcttattatcccatatttagggcagacatacgtactctgcacaccccgtggccagcagcccagtagtgagatgcccactctcacaatgctctacacgttataggattagggagacagggaatgtctatgcaactatacaattatgaacactccctggtcagagaagtgactttgttagagaggggaaacctctggagtcagtgtcagatggtcagttctgttgaggtaactctgaccttttgacatctctctgccaagctaccgaaaggagtagactccagtcccttccagatttgcctttcttcatattgtatttaaatgaaatttttcaggttttttaaaagaatcgttttattttaaatgtgacagatgatgtgcttttaattttcttttttccaattttccaattttttacctgggtaaaatacacatgacataaaatttatcatctcaaccatttttaggtgcatagctcaatggtattaaaatacattcacaatgttgtgcaaccatcaccaccatccatctccaggactcttttatcttgtaaaactaaaaccctgtacccattaaacaactccccattcctccctgcccgcagcccaacagagatatttttaagagtcatattattttacatttaattaatcagctttattttttacaaaacaaaacacataaaaagatgtttcaaaattgtaagagaaaaatatatatagtagtgctgaaaatatacataccacactctcatattttctgtaagtgttctcatctccgaaaccctcctttagttatgcagaaaaaaaaccctaaacttggcaatgaaaggcaagttttaggctctatcaggctgccccacctcttctggataaatattcagtaacttccgtgtttgaacttcccgccagccctgggtcccaccgggctttcgcttccgccccctcttaagggttcacccatgccttttcctccggaagtggcctgcggatatcaccgcacttgcgtgcgggaagcatggctgcacactctgtgtcctttctaacctgcagagaaacgttcttgttcaacaggacagcggtcatcctgtgggatcagcttctaaagtcaacagccggtgaaaattgtgttctttttccacaatgaagcaaactcacctctgcaccctctggcattgcacctcctctgggtctcagcctcaccttccatctctccctcatggtagccgccttcttggcagggtccttccctctcagtttttttaataccttgcactttgcccactgaaggcacctagaaacttttggaaatctcttgtaccacacacaggccgtgggggaacctggagaggtgctttataagacacctcctctccacctagacgagactgtgtggccacctcgtggtgcaggccgacacaaacgaaaatcaggaaataagctctaggatttccccagctttatctagttgattgcaacaggtcataccaggagtgaaagcagatggtaatttggggaggcaaagaaaggtacacataagaagaaggatataattatagagaagtaggaggagaaaagtgaggtacaggggtacagagatctgaaagagtgggagttaggggcatgagaagggaagtcactgattgggactgtaggaggctcactgaagaccccaatttaaactattaacaagtcattatttggtccagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagagggtaaggctgatgatggaatctgccatttgaatggctcagtgtgggagggtctctcctgaagcaggtacagagttaagtagatatgtaaagtcaatagtaaaaggaaaaagtacagagaatgaggatggggtataacaagaggaacaaagagagcaagcatctgttgcatctgaaaagttttgtggaagaaacagacgtgttcacagggacagctgtggcctggggcagcagctctcaaattttttggtctcaggactcctttatgctctcaaaaattattgaggaccctaaggagcttctgtttatgttgtttatgtctatctacatgtacctgattagaaattaaaactaataattttaaaatattaattcatgtaaaagtaacaataataaaccaattgcctgttaacataaatagcattattttatgaaaagtaaatatattttctaaaacaaaaaaaattagtgaaaagagtgacatcattttatgtttgtgcaaatctctttgattgtgagtgagctttataaaaagacagctggattcctacaactgtttctgcattcagttgtgatatgttgctttgattgaaggatagaaagaaaatctggccttacacagatatctagtttaaaagggtgaggtaatttaacagtcttttgagatatctgtggatattcacctttaatactacaccaacactcaacaagtgatagtttcttaaatattagttgtaatgtaaaatttgaaaccatatcaattaacttcatactctgttacaataaaatacattaatccaccttgcattttgaatggaccttctactaatgcaagattttataatagtacagctgtttggaaaatatacatttggaattatacagtgagcttgtatctcaatcacacaagtgttttcttgaggccactgtggtacttcaggatgcaatagaagtgctttatatgtgctcttcagtttttcacatagaatattaagatgtcagatatgtactcaagggtagaaatttaataaaattaataatttttactggctcaccaaaaacattctcaagtgaatcttgcttttatttttattttttttggtacagtgagtaggtggcaataaaggatgcagtgattcctgctgagatttggggacactgctttgatgtgtcttaaggcaccagcagttttatctgccattgctcttgctcaatctgtacaaaggttgaaatagtgaaaaaggcaaataacatcatattatgaaaacaatttgaccttgcaaattttctgaaacggtttgacagaccccctaggggctcacagaccttactttgagagactctggccaaggggttcagatggctgcaccccactgtggatgtctccattggtagagtaaccactgctaaccaactgcggtctgctcctcccctgagtggcagacaggcacagtgtcatgagcagcaccaaatctcttggtagatgcattgttaggagggtaagacctggagcctccaagactcaacttcagagtgtgcaagggccttcctgggtctctgggagattctccatggtgtttcccaaggggcatttactaagatctttcattttccagagatcattgatggcacttcagaaatgaatgaaggaaagaggtcccagaagacgcctagtacaccacgaagggtcacacaaggtaaaacttggagattgctggtctcagagtacagtcaccaggaatctaaattcagagctgtcttacactgaggcaatatttcttaacttttttttttcattattactgtgctagagagcccttctggatttttttttcttaatcaagacccttcccatgatatttactactacaaatatatgtccattttatgtaatgtgtccatatgtatgtatgtatatctgcactatataagatttttctcagcactcaagaatgagtttttccactactggcagcaatatcaccattactgagaatgagtgtcctaagtatattcatggtactatactgaaagtacagcttgtccaaagtgcagcttgatccaacccatggatcaagctttttcctagaattccaatctccatatttctcatgtggcctttctgagaaaattgagaagcgaaaaactcattaaaacacacatgtgacactatgactgagcatgtacaactggtggagttgtgggcatgtgctggtaaaattgtgcatgttaattcacccctcactatcgctaccattattcacatttctggagtaagttgataacactatccttagaggggaaaaaacagctagatattcgtctgtttgctggtgatatggtcattgtcacaaaaatcacagaactctcacatgacaaatgtgattttcaaacaacaaatatctaattattgtcaggaaaaatggattaaattttaccaccttaaaatctaaattatcattttaacagtttctcctatattgcactggcttatctagtagtatttcaacttttctcatggataattttattttattttcacaaccacccttggagaagattgaatgacctattccaatttagcagatgaggaaattaagatatggaaaggattaatggatttttttcaggatcccctgggtaagggctggctgccaccgggttaacaacctggtccccaggaactcttttcaggagccatcgttctccatagaaaggaaggggcagaaagaatactgtcaaacctttgtcaattcactattgcccaaaatagaaaactgcttattcaaaaattactttctcattacttccaagatcctatggataatggaaataaactctctctgggaaaatctcccagggcagagcataagtgtgaagaagaaactatttggtctctgtggtgtggattgatgttaccttactgttattatgccattctaggccataaaagacatccaagccagaaaaagcgttatgctttttaaaatcatgatttcactttttttcaacatagaaaagttcctggacttttctaaaagcagtgtgctgtcaccattaggattatgttgctggcccagcacagtggctcatgcctataatcccagcactttgggaagctgaggtaggtgaatcacttgaggccaggagttcgagaccagcctggccagcatgatgaaaccctgtctctactaaaaatacaaaaactagccaggcgtggtggtgggcgcctgtaatcccagctacatgggaggctgaggaaggagaatcgcttgaacccaggaggcagaggttgcagcgagccaagatcacaccactacactctagcctaggtgacagagtgagactctgtctcaaaaaaaaaaaaaaaaaaaaagaggattatgttgctgtgtgtgacagcaaacctcaccccactaaaaaaaaaaaaaaataataataataataataatagtagctaaagcaagagaggtaggtggtcaagagctggtgtcatacactgtagggtcctgggcttattcttgcttgttgctccatcatcctcagcatgtggctccatcatcctcagcatgtggcatcccctttattgaggtccagccagcatgtctatgttccagctaaagagaaaatggcaaagtcaaagaagggcacacctcctccactgaaggactctaaatgcttccggtcacagatagtaatttgctatcattaataatttgctattgggaggccgaggtgggtggatcacttcaggttggaagttcaagaccagtctggccaacatggtgaaaccccatctctgctaaaaatacaaaaaaaattagctgagcctggtggtgtgcacctgtaatcccagctactcaggaggctgagacaggagaattgcttgaacccaggaggcagaggttgcagtgagccaagatcatgccactgcactccagcctgggcaacagagcaagactccatctcaaaaaagaaaaaaaaattctatcattttattgccaggactggttgcacggccacacctgacttcaaaggaggctgggaaatgtaatctttaatctataagaataaggggctcagaatcaggggctttattactaaagaaaaagggagaccagagaaagaggaacaactagcagtgctcaccctgcccatgtttatggtgggcattatgactgccctcctctagttccaattcttctccccttcccagacacttggaaagctccattatcatcccccttgcaggaggcagctctgctatactagctctggcaaataagccagagagatgggtgtcacttctgggtcacagcatgtaagagcccattgcagctctccacattcttttcccgcctgtggaagtgtgtggaagagggaggcgccagaaggccaaagcagcatgacctaccacatagaggacagcagccctggagggccctacagaggacttccagtcctacagagggtcctattgtcctacagagaacttcatgtgatagagaaatacacttttcaatgttaaaccaccaaaatttggtttcatttgttactgcagcacagcctaccctgtcttgtgtgatacaatattcctaataaaatcttcagtgtagaaaattgtaaatcaggctaggcatggtagctcacacctgtaatcccagcactttgggaggccaacgtgggagaattgcttgagcccaggagtttgaaaccagcttgacaatgtagtaagaccctgtctcaaaacaaagaaaaagaaaattatatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaagcaataccattcaggatataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaattaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtacactagttcaaccattgtggaaatcggtgtggtgattcctcagggatctgggactagaaataccatttgacccagccatcccattaccgggtatatacccaaaggattataaatcatgctgctataaagacacatgcacacgtatgtttattgtggcactattcacaatagcaaagacttggaaccaacccaaatgtccaacaacgatagactggattaagaaaatgtggcatatatacaccatggaatactatgcagccataaaaaatgatgagttcatgtcctttgtagggacatggatgaaactggaaaccatcattctctgcaaactattgcaaggacaaaaaaccaaacactgcatgttctcactcataggtgggaattgaacaatgagagcacatggacacaggaaggggaacatcacactctggggactgttgtggggtgcggggaggagggagggatagcattaggagatatacctaatgctaaatgacgagttaatgggtgcagcataccaacatggcacatgtatacatatgtaacaaacctgcacattgtgcacatgtaccctaaaacttaaaatataataataaaattttaaaaaaaagaaaattataaatcataaagttaaacatctatttaatctgcttcccccactttatttttgtataagtatgcatacatttttctttttatatataagctcatactatatagtctattctataaatcacttttttcattgtgtatcatctctgtatcaatgttatctatttttttaactgcatggcacgttacgtatgattcaccgcaatttgtttaaataatcacctactagtggacagtttatttcttatttttatatgaaaatagaaatcaggtttgtgtgtatttgtatctttgcacacttgtccaataatttccttagaattgattcttaaacacaagcttacttggttaaaatctatatcttaattatacatgttaccaatttgctgtccagaaaacataatgatttatattccctttaacaatatatgagtattcatttcctacatcctcaatgctggatgtaataaaactttttaaatgtttaggtatccttaacatccaaacaatgagtttctttgattagtagtaatatagagatgatttctaaataaatttgtcatcttcatttcctccttgagcatttttaacttatattttttgcttattttcctagattaccattcatcttttgctttatctaataaggatattaaccttctatatgctatgtatatttaaattttgtttttgctttaatagtgtcggggtgttttttgaactgtgaacagtttttttcagtcctgctccttctgtatatttttaattttttaaacattcaaatctgtttatctcataactgtgtaatttctggccctgaattttggctaggaaaccttttaatatccatggtttataacaatctttgtctagtcttgaaaaactgcttattaattttaaaattaataaggcatgccggctcatgcctgtaatcccagcaccttgggaggctgaggcaggaggttcacttgagtccaggagttcaagaccagcctggccaacatggtgaaaccccgtctctactaaaaatacaaaagttagcctgggggtgcatacctgttatgccagctactcaggaggctgaggtgcgataatcacttggacccaggatgtggagattgcagtgagctgagattatgccactgcactccagcctgcataacagaacaagactctgtccccaaaaaattttttaaatgacatatattaaatgttagtcctctagtatattcctgatccatctttattcaatccccaaattcaatttccagctaaaatggagtacttttttcacataggtcacatggttttcttgccttctcaaagtcagggaaaacaggaaaaaaattacttaaaaaagtaatgacattgcaggtttgtagatcaatatttgtagccataaaagatgtgggttttttcttttttagaaaaaaggagaaaagaatatggccaagttcaaaaagaaaacagaaaaaaaaaatgcccaagacataaggaagaaaagtgaaattgttactctcttggtgtttatcaggcccctcacctgaccagctggcatgacctcctctccagccacatgtgcctggagcatagccagccccaaccttgtcccctaggccaccccatcagtagactccccaacaaaggaagagcaaacctaacaccaacttggtttatacctagtcttcttttctcttatcatagggagggaatggggttgaggtggacatgaggcatcagacaattttgagattagaattgtttcctgtctagggtcagagcccagaagaatagacacaagtaacctaaatccccaggcaggattcagactttcagttccaaactggattagatttggagtcatagagtgttcagaactacctcagtcaacccatgcttgcttgcatgcctgcatgcatgtgtctactccagtgcacaaactgtgttacttgcagaataagaaacaaaaaagctgcatttttctggttcctctgcttcatcccacttttctttttctcctctgtattctctccctcttccctttctctgttcctttctttttccctttttctttttttaatttattttgtaaattttttgtatagaccaggtcttgctatgttgtccaggctggtcttgaaatcctggcctcaagtgatcctcttgccctagcctcccaaagttctcggatacaggtgtgagcccctgcacctggcccctttttctttattcttttactcaaaattattcacaaagggcctaagatatgccggtcagtggggattctcttggattctatacctttatgggagccagcctgggaagagatcttgtcccagctcccaaacatgaattaggacatgaggctcactgctttggaaatccctctaatttttctgcttgttcccagcatgcctcaatcttggggtttggcctagaaggaaagtcatatctgcctgcttgcacttcccctccctggcctcttcttcctagttccccaccccactgcctccctaggctggaggaaacatactctctgtcatttgctgagtgttcactaccaatgacttataggaaaacttgacattcagacctccaaagttttcttttgataggtacaggtaatttttggaatttataaattcctctttgctcccaacaaatactgtgcttcaagattttgtctaagcttgccaaaatggccccaactgagcagtggcttctcaattctagcaagcatctgccctccccctgaaacctattgatgtaatagtcagggaaatctttactatttgcaaggatgaaaaatacatgattcctcagcagaaaccttacaagctggaagggattggagtcttatctttagtctccttaaacagaataactctcagccaagaattttgtatctggcaaagctaagttttatgaatgaaggagaaataaagtcatttttagacaaacaaatgctgagggaatttgtcactaccagaccagctttataagaaatgccaaaaggagttctaactcttgaaacaaaagattgatatgcaccagaatacaaactcttgaaagcataaaactcacaaggtctataaaacaataacacaatgaagaaaacaacgtatgtaggtaacaattaacatgatgactgaaacagtacctcacatcttgatattaatgttcaacataaatgggcctaaatgctccacttaaaagatacagattggcagaatggatacaaaatcacaaaccaaatatctgctatcttcaagagactcacttaacacacaaggacccatataaattcaaggtataagggtgaaaaaagatattccatgcaaatggaaaccaaaagtaaacaggagtagcttttctcatatcagataaagcagactttaaagcaacaacagtaaaaaaaggcaaagaaggtcattatataatgataaaaggatcaatctaacaggaagatattacagtcctaaatttagatgtagctaacactggagctcccagattcataagacatttactactagacctaagaaaagagataagacaacaacacaataatagtggggaacttcagtattccactgtcagcaccagagagatcattgagacagaaagtcaaaaaagaaacaatagatgtaaactacactctagaacaaatggacctaatagatatttacagaagattacattcttctcatcagcacatggaacattctccaagatagaccatatgatagccacaaaacaagtctcaataaatttttataaattgaaattatagtttgatgggaataacattgaatctataaattactttgggcagtatggccatttccaagatattgattcttcttatccatgaagatggaatgtttttccatttgtgtcctctcttatttccttgaggagtggtttgtagttctccttgaagaggtccttcccatcctctgttagctgtattcctaggtattttattctctttgtagtgattgtgaatggtagttcatcatgatttggctctctgcttgcctattgttggtgtaaaggcatgcttgtgatttttgcacattgattttgtatcctgagactttgttgaagttgcttatcagttcgagaagtttttgggctgagatgatggggttttctaagtatataatcatgtcatctgcaaacagaaacaacttgacttcctctcttcctatttgaatacgctttatttctttctcttgcctgattgtgctggccagaacttctaatactatgttgaataggaatggtgagagagggcatccttgtcttgtactggttttcaaagggaatgcttccagcttttgcccattttatatgatattggctgtgggtttgtcataaatagctcttattattttgagatatgttccatcaatacctagtttattgagagtttttaacatgaagggatgtagaattttatcaaaggccttttctgcatctatcaagataatcatgtggtttttgtcttggttctgtttatgtgatggattatgcttattgatttgtgtacgttgaaccaaccttgcatctcagagatgaaaccgacttgatcatggtgaataagttttttgatgtgctgctggatttggcttgccattattttattgaggattttcgtattgatgttcatcagggatattggcctgaaattttctttttttttgttgtgtgtcttcccagttttggtatcaggatgatgctggcttcataaaatgagttaaggaggagttccctccttttcaattgtttggaatagtttcagaagtaatggtaccagctcctctttgtatttctggtagaatcagctgtgaatccatctggtcctgggttttgtgttgttggtaggctattaattactgcctcaatttcagagcttgttattggtctattcagggatttaacttcttcctggtttagtcttgatagggtgtatgtgtccaggaatttatccatttcttctagattttctagttcatttgtgtagaggtgtttatagtattctctgatggtagtttgtatttctgtgggatcagtgatgatattcccccttatcatttttattctgtctatttgattcttctctctcttctttattaatatggctagtgatctattttgttaattttttcaaaaaaccagctcctggattcattgattttttgagggttttttgtgtctctatctccttcaatttttctctgatcttacttatttcttgtcttctgctagcttttggattagcttgctcttgcctctctagctcttttaattgtgatgttagggtgtccatttgagatctttctagcttcctgatgtgggcatttagtgctacaagttttcctcttaacactgctttagctgtgtcccagagattctggtatattgtctctacattcttcacagaattagaaaaaaaaactattttaaatttcatatggaatcgaagaagatcccatatagctaggacaatcctaagcaaaaaggataaaacgggatgcatcccactacctgactttgaacaatacgacaaggctacagtaaccaaaacagcacggtactggtaccaaaacagacatatagaccatggagcagaacagagacctcagaaataacacgacacatctacaaccatctgttcttcaacaaacctgacaaaaacaagcaatggcaaaaggattccccatttaataaatggtgccaggaaaactggctatccatatgcagaaaactgaaactggaccccttcctcacatcttatacaaaaaataactgaagatggattaaagacttaaatgtaaaacccaaaaccataaaaaccctagaagaaaactgaagcaatatcattcaagacataggcatgggcaaagtcttcatgataaaaaagccaaaagctattacaacaaaagccaagattgacaaatgggaattaattaaactaaacagctacagcacagcaaaagaaactagaaatagagtgaacaggcaacctacagaatgggagaaaaattttgcaatccacccatctgacaaaggtttaatatccagaatttacaaggaacttaaacatatttacaagaaaaaaacaaacaactccatcaaaaaatgggcaaaggatatgaacagacacttctcaaaaaaaaaaaaatttacgtagccaacaaacatatggaaaaacgctcaacatcactgatcatcagagaattgcaaatcaaaactgcaatgagagaccatctcatgccagtcagaatgacaattattaagaagtcagaaaacaatagatgctggtgaggctgtggagaaataggaatacttttacactgttggtgggagtgtaaattagttcaaccattgtggaagacagtgtggtgattcctcaaggatgtagaaccagaaataccatttgacacagcaatcccattactgggtatatatccaaaggaatataaatcattctactgtaaagacacatgcacatgtatgtttatcgcagcagtatttaccatagcaaagacgtggaaccaacccaaatgctggataaagaatccagcatttagactggataaagaatatgtggtacatatacatcatggaacactatgcagccataaaaagtaataagatcatgtcctttgcaggtacatggatgaagctggaacccatcatcctcagcaaagtaacacaggaacagaaaaccaaacaccgcatgttctcactcataagtgggagttgatcattgagaacacatggacacagagaggggaacaacacacaccagggcctgttggggtgtgggtggtgaggggagggaacttagaggatgggtcaataggtgcagcaagccaccatggcacatgcatacctatgtaagaaacctgcatgttctgcacgtgtgtcccattttggggggttttttagaagaaaaaaattgaaattatattaagtatctcctcagatcacagtggaataaaactagaaatcaactccaaaaggaactttcaaaaccataacaaataaatggaaattaaataatctgctcctgaatgatttatgggttaacactgaaattaagacggaaattagaaaattatttgaaatgaatggtaacagtgacataaattatcaaaacttctaggatacagcaaaagcagtgcttttaagaggaaagttcatagcgctaaatgcctacatcaaaaagtctgaaagatcacaaattgacaacctaatgtcatgcctcaaggaactagagaaacccaaagctagcagaaaaaaagaaagatgagagaagaatgaaataaaattgaaacaaaaaataaaaaagatcaattaaacaaaaagctggttctttgaaaagataaacaaaattgatagaacattagccagagtaaccaaaaaaaaagagagaagtttcaaataaactcaactagaaatgaaactggagacattacaactgacaccacagaaatacaaaagatcattcaggactactatgaacacctctatgcacaaaaactagaaaaatctagaggaaataaataaattcctggagacatacacccctcctagattaaattgggaataaatagaaaccatgaacagaccaataacaaacagtgagattgaatccagcagcccatcaaaaatataatacaccatgatcaagtggatttaatcccagggatttagggatggtttaacacatgcaagtcaataatgtggtacatcacaaaaacagaattaaaaaccatagatcatttcaatagatgcagaaaaaacatttgataaaatccagcatccctttagataaagatcctcaacaaactaggcatagaaggggcttacctcaaagttataaaagtcatatatgacaaacccacagccaatgtgatactaaatgggaaaaaatctaatgcattcccctggagaactggaataagacaaggatgcccactttcaccacttctattcaacatagtactagaagtcctagccagaacaatcagaaaagagaaagaaataaatgacatccaaattggaaaagaaatcaaagtatcactgttccctgattatatgatcatatacctagaaaaccctaaagactccttcagaagactcctagatttgataaatgaatccagtaaagtctcaggttacaaaatcaaatgtacacaaattagcactgctatacacctacagtgaccaagctgagaatcaaagcaagaactcaatcccttttaaaacaacttcaacaaaataaaataaaatacctaggaatatacttatccaaggagatgaaagatttctacagggagaactacaaaacactgctgaaagaaatcatagatgacacaaacatatagaaacacatcccatgttcatggattggaagaatcaatatgaaaatgatcacactgcccaaggcaatctacagattgaatgcaattcttatcaaatatcaacatcatttttcacagaactggaaaaaaaatcttaaaattcatatggaaccaaaaaagagcctgcaaagccaaagcaatcctaagcaaaaagaacaaatctggaggcatcacattaccagacttaaaattatactacaaggctatagttaccaaaacagcatgatactgttataaaagtagatacatcgaccaatggaacagaatagagaactcagaaataaagccaaatacttaaaaccaactgatctttgacaaagcatacaaaaacataaattggggaaatgacaccatatttaataaatggtgctgggaaaactggttagccacatgtaaaagaataaaactggatccctatttcccaccttatacaaaaattaactcaagatggatcaaaaatttaaacctaagacctgaaaccagaaaaattctataagaaaacctaggaaaaactcttctggacattggcctaggcaaagaattcatgactgagaccccaaaagcaaatgcaacaaaaacaaaaataaataaatgggacttaattaaactgaaacgcttcttcgtagcaaaggaaataaacatcagagtaaacagacaacccacagaatgggagaaaatatttgcaaattatgcatccaatgaagaattaatatccagcgtctacaagaaactcaaacattatagaaaaaaatcccacaaaaagtgggcaaatgacattaatagacatatttcaaaagaagatattcaaatggccaagaaacatctgaaaaaatgctcaacatcactaatcatcagggaaatgaagattaaaaccacaatgagataccaccttactcctgcaagaatggccattattaagaagtcaaaaaaaaatagatgttaacatggacgtggtgaaaagggaatgtttatacactgctggtgggagtgcaaattagtacaacctctatggaaaacagtatggagatttcttaaataactaaaagtagatctaccattccatccagcaaccccactactaggtatcaacccaaaggaaaataagtcattatatcaagaagacacctacacacatgtttattgctgcataattcacaattgtaaagatagggaaccaacctcagtgcccattgaccaatgaatgtgtaaagaaaatgtagtatatatacaccatggtgtattactcagccataaaaaaagaatgaaataatgtcttttgcagcaacttaaatggagctggaggccattattctaagtgaggtgatggaatggaaaaccaaatactgtatgttctcacttataggtgggagctaagatattagtactcaaaggcatacagagtgatataacggattatggagactcagaaaggagagggacggaggagggggagtaaaaacctatgtattgggtacaatgtacactactcagacgaagagtgcactaaagtctcagattttgccattatataattcatccatgtaaccaaaaaccacttgtaccccaaaagctattgaaataaaaacaaattaaaaagaaaaatacatttaatattttcaaaactttagtgcctattaaacattcattcagcagtggagtgtaaggtgtgggccaggtatctgtcctaggtcctgggaactcagcagtgagcaagacagacacaaatccctacactagtggagcttgcattctaattgatacacctgtaattactaaacaaaatgaggacttgaaaaagagaaatagaaggaagtattatgagtctggggggaagaaagatacacacaagaaaagagagaattatagagaaatggcaagataactcctgaaagggtaggggctgggaacatgagaagggagctcactaaactattcacaagtctatttggtccaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaaggtaaggctaatgatggaatctgctatttgaatagctcaatgtaggagggcctcttggagcagtacagggtcagatagatatgtaaagtcaatagtagaaggagggagacgtacagaaaagagggacatgaagacagagcacggatctgttgatgtgacagtggttgttggaagaagtgttctcagggtgcagttcaccttggctttgccatgtggatttacatgactactccccagtgtctgctgttttcatttctgttattagagtcaccactactctcttgagtttgggagactcctttctggttctggccaacccagtcttggaagtggcaccaatcctcaaagtggacacatttgcaggattgttttttaatgtttcatttctagaagtgaagttgcttggtcaagtctgcatttttaagttaggacatatttgttgtcaaattgcctaaattgtctgtttatactcccattacatcatacagacaccctttccctccactttcaccaacactagaaataacaagatgtgtctatgatgacggccaaaggtgaagggtgatattccaccggtgtttccctttgaatttcttttcacttggcaggtgatcaaacatgctgtggtagcttgtattacggttctccagtgttccagtgccccacctcctcagaagtctacagccctgcctgtggactcaggaatgcccatgtgataacttagcgaaagaaatgtggacccaagttagagagccactttcaggccaaggctttaagagcccctttgtcttctttctctctgcccaagaccagggatgttctagacagaggctgctctgtctgcagaagccatgagtgtcagtgatgtagggctgagcctcatctaatttatgatgaacaaacagcatgagagagaagtaaacctttgccattgtaaaccagagcttggcaaattttttccaaaaaggaccagaagatgcaactactcgactctgcctttgtagcgtgacagcagccagaggcaaatacgtaaacaaatgggcgtggctgtattccaataaaactttatttacataaacaggcagtaggccaatttggcccttagaccatagtttgctgacacctgtaataaaccactgagatttgggaggatcgtgaattaccacagcattacctagcctatcgttaccaatttacctgttttttaaataaatttgacattggaattttttcttttgagggtcatctgtttgaatttgcccatttttctataagactggccattttttttttgttaaatccgttagggaaattaaccctttgttataattattagtttttctgatttggtttctgtctttgaacttaagaagcttttggttgtggagccatttgcttagttagatagacaaatcagtttacctttagcagtatggtttatgccagagtttctcaatcttggcattattgacattttggactgaataattctttgcttcggaggctgtcgtgtgtgtcatgggatgtttagcgacatctctggcctctacccattagatgccagtagcacctgcttcccagtcctgacaaacaaatagatttccaaacattgccagatatcccctgagagcaaaatcacccagtgttaaccactgctttatgcccattacttcctccttaaaaagcccttcctatgtgatatttataaggccatacagtagcccccctttataagcagttttttgatccatgatttcagttacctgaagtcaactgcagtttgaaaatattaaatggaaagttccagaaataaacaatttataagttaaaaatgatgcgctgttctgagtagcgtgacaaagtcttgcaccatcctgctgtatcccactcggggatgcgaatcatcccttggtccagtgtgtcctgctgtatacgcagcccacccatcagtcacttagtagctgtcttggttatcagattgaagaaacatagtatctacaggggtgggcactacccatggtttcaggcatccactggagggcttgaaacatatgccgtgtggataaggggggactcctgtacatccctttattctagtatttgtagtaaatgtattgacatatattaattagtggaaatttggcttctgtagtatttttagcttttctgcctattaacatgagcttgctgtatttccttagtcaatgctacaaggaagtcctttcataaggactcatatgtaacttgtctctccaaactggtagaaaaacaggaaaaaatgcttgaagattgttaacctatgaggcttataaatctatgtttgtagctataagtgattattaattctgtgtttagaaaagaaaaaggagaaagatatctgttcaagctcaaaaaggagatttcagaaaaatattcaccgaagaggtaagcaagcaagccacagcgcctccccactgggctccccagagccctggcctctgctggaagctccacccgccctctccttcttctctctcccttctcctccaaagttgttctccaccgtcatgggtaccagctgaattgggtgcatcaggagtgctgccagcctaacccacccccttgtgcatggtggccatttccatacttggaaggattctttaacacagagctatacaaagacccaaaaatgattaaggatgatcactaaacctttaagtcaaattctaaaatgaacttctatgtcttccattctaggaattaaaggaaacccttattcaagcacagcctaacagtgttctcattccttttcctgtgttggttgggaccctgggcttgcttcagcctctctgcaccctcggccctctttgcatctctgtcctctccctcccactcctcttcttgcatttatttttcttctgcttttataccttgcttcttcagcatcatttcttgtcaccctctcttccttttttaggcgccagccacactggccctttttattcattatcaaagtataataggtgctacccaaggtggggtccccagactggtgccatctacaagcatgttggttggcaggtctacgagaataaggagcttgtaaaccaactgtgacgctaagcacactgttttcatagcaagattcctcagtggagacagcagtgcattgattctgatcaagcccctgtcgcatcgtaggctggagcactgagtagcactggtgtatgtgcttgcagaaaatggcatgtatcctaagagtacagcttgatggattcacacacacagaaaatgcacccgcacacccagcacgcagctcaagacacaggatgtcaccaacacccataaaccacccctacccgtgtctctagggtcacaccagcctgattcctcacagcataggtcatcagataccgaatgctcccaccttgttcctgctcagggcctcctcacatgggcctcccagctcacccacccaaccccaaagtgaatccccctatcttcctccctttctttgctatacaccctcagacctcaccttttttaaaaatatttattttaagttccaggatacatgtgcaggatgtgcaggcttgttacataggtaaatgtgtgccatggtggtttgctgcacctatcaacccatcccctaggtattaagcccaacatgcattagctatttatcctggtgctctccctcctgctcccctgataggccccagtgtgtgctgttctcctccctgtgtccatgtgttctcattgtttaacccccacttataagtgagaacatgtggtgtttagttttccgttcctgcattagtttgctgaggataatggcttccagctctaatcatgcccctgcaaaggacatgaccttgttcctttttatggctgcatagtattccgtggtgtatatgtaccacatattctttatccagtctataattgatggatatttaggttgagcccatgtctttgctattgtgaatagtgctgcggtgaacatacacatgcaggtatatttataatagaatgatttatattcctttgggtgtatacccagtaatgggattgcttgctgagtcaaatggtatttctggttctaggtctttgaggaattgcttcgaggtctttcacaatggttaaactaatttacattcccaccaatagtataaaagtgttcctatttctccacagccttgccagcatctgttgtttcttaactttttaataatcgccattctgactggcatgagatggtatctcattgtggttttgatttgcagctctctaatgctcagtgatgtggagctttttttcatatctttattggccgcataaatgtcttcttttgagaagtgtctgttcatgtcctttgcccactttttaaaggtgttgtttgtttttttcttgtaaatttgtttaagttccttgtaaattctggatattagacctttgccctcagacctcaccttaaatgtcacttccacagggaagcattctctctcccagcaggtaggggtgggtctccctgacatgcccttgtggagacctgcattttgtcttcatggcacttatcttaactgtgatgaatgatctgtgcacagcctgttcactgcgtgaaagtcacgtgaggtcagtaagtggatgggtcttgtgtgttgctgtatgtccagctccccatgcctcacacagctggtacttcttcaagtatgaataccagtatctgggcctatctgatgcatgtgtgtgagttagaaaaaggtgccccttcctcaattcactacgtcatctgtcagagccaattcttgaaaccaaacccttttctgccttctgctggaagattgttgtactaagcaggtaaactgattctgtttctaatatgaattagagcaccccttaaaggtggagtccttgctcagggcacaacccatacaacttcatgcagtggtcctgataaccatataaatgtgtacattacttcacagttggcaaagcactttgatctacattttgccatttaattaccataataagtgagtgttatcagcccattttacagattcaattaaagggcaaaagacttgaatgagctaaaatcaacctatgtgttccaatttcaagccctttttcctttacactaaaaatgtaaatgaacctagaaagcacctactctcaaacactggtggaggcaggagccccggcaaacgttgacagttgtccctcagcatcagtttcttctcccttctgcactgtctgtaacttctcattaaatgcagagtatctgtgctgttgttgcttgtatgatgtgcagtctcgtggcatttctgatgatgtggaaagagcgctagatactgggtctggcatgtgtaaattccagtgccagctccacctcatgtaatatggtgaccaccggcaattctctctccacatctgaccccaagtccctcatctataaaatgaggacagtcattgccttctctttcttacacattgttatgcggatagatgacacagtgcatctgctgctcttactgtttccttgactatcacttttcctcccaccgccccatctccacccccaatcatcccctccccagacccctcatgtatacatcatagagctcccaaatcactccccaggcctgtggtctttccatgcataatttccaccttgtgctccttcctcatgttctgtaggaattcctggagttggtcttctggattatgaattcgttttttaccatgccgctattcctcatctcgattaggcttttcttcttagttttctccaccttgcttttcctttccctgagctctctgttctctaattgcttgcttttcacagcaggctcctcattgtttgctcatgcttcctaatggggacctaaactcaccgctgctgcagctcacctttcaaacaagccagctgccgttagagagccccaagcatcccccaccgggttcctggggctgcagggttccatccttcaaggcctggttggtaagatgagtaggtgaggctgagccagacttagcactattaggaacaggctgccctcaggcataggacagttggctttggaagtcctcgggtctaaaggccccacctcacttgatggcctgcctccactgggtaaggaagggactgatgtttgtcctcacaactctgcacatcagcttgctacccgtggcccccaaagccaccccctgctccctcatctgcttgtgaatgtgtttgggacatttgtgttccctaaagctatattcaccacagggaattagagaagacatttctgtggagacagagaactgtagaagggaaggtccccagagctgtgctaatctccctcaaggtttgcaatagtggtccagagtcacctggagctctgcctttccctcacattaggaacctgcggcagcaaatttcccactcaaatttgataacagtaatgcacgcttaggtaatccttctagtaagttgcagagccaggattacaagcccctcccacccccacccctccctgccccccagtctggctcccaaggccacgctctcatctgctgttccatatttactgagttgagtctagagacaaatggtggagctggccactccatgcaagagggctggctgttgaaacaaagtttttcccaccgtaagttcccacacccccactaccctccacccccatgcctagccttgctgccagcccctgctcctgtgaggccaggcatcctgtagggttctgtcggggggatcacatcctcacttctcagggtccctcctctctcagtctcactctatctgccttgtgtctttccagagaaatgaatggcttcttcgccgctgatactgttccttcacctttccgtcaatgctcttgttttgccatttgttttcctttagctctttcaataactgtttgaggcaagggagagagttggaccaggtgttctcctagattcattttaggtgtaacatcctctgtaactcaacataagacatggacagccccttcatttctccccagagaaacagcccctgctgtctctctttaatgaattcacccatagtgaggttggaggggaaggcagcaggaattgctgagatttattttaaaccctcttgcaactgcttcccctgaatctaaactctggatttctacccaggggttctgagttgccagactgctccatgagcaactgggaaattagttcaaagctctccagggttttcttttattcatcgaggaagaagcagggaagcaataaaatgaaaagaaacagcaaataattaagactgacaccatcccctcagtgccagccacctcactcacccaagtcttcatttgagtcaggaaataagattataaatgaagatttttttttcctctggcaacatgaatgcaaagaaacatttccatcagcacagagagatcagcaggatgcttatagaatagaagactattcagtgacagccaattcacttgcaaattaagacacattcactgaagatgccctatatgttccactaaaatgttttttttttttgatatagtgttggtggcagtggtggtttgttgcaggccactgtgtacacatagcttatctgtcactcgagatgaaagagttcctgcaaactaaccagagaacgttccccaataccctgtacattattggaattcatggaggggagaattcaaaaggaagatggagtgaagactgaataacacaaaactgttctcttctactttaaggaaaacccaaaagtgacactgtggattttcactgttctaagctccccgtgacctgtggtgaggcgaaagggattttatataagaagaaaatgaaacacggtgagttccttggtcttctgctctttggaatccctagatgaaggactcactagaagggaggaaaatacccgtgtgtgtaattgatcaggaaatggaccctgctagctagactgcagaagaaacgcttcttaggaaggaatttccaaactcttccacatcatggtatttctggcaatcagaccctccactcccacctggaagtcacccatgggccctgctgtactgacagccatgtccttgctgcatgtaggcactacacgaatgcacattctgtcccacccctcaccactcagtcaggctttagggctggcttcagtccaagagaagaggcccgcagactcccctgctactccttccacctcacagaggaagtctctcttgacctggaaaggtagaaggccacaattaggatgaagaggttcagggtgaattcacagaggatgggggtagatccaagaatgggctttttcttacaggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaaggtattataatgacgggacagataggtgacaggtttaaatccttgaaggagaagtggagctttaagagcagaaatgtgaagagctcccgttaggattcaacagcatgatttataaggagttaaatgttcatagaaaaaaaactgtgggtgacaaagttaggagcacatattgttcctgatggtggagaactttaaatgcaagtaaaggagtacaggaactttaaatgccggcaaagggctttgaggtgaagagagatgtaagaacctaaaaagaaactagctgaagacagatgcctgcaaccactcccctgcatcctctacctgacatctactcaaggcccagctcatctggcccccctgcagcatttccaggctgcccagtccgtggtctgtctctccgctgcatgtccacagcacactattcctgtcctgagaacaactagtgtctatgatgacaggacccaacacaaggcctctctcagcaacactcaagaaattatcactaggatgaaatcctaaagattttaatctagagagggagaaatggaaggagaaaggaatggatgggaaaggttaagaaagaagaactagggtcgtgggtttgagtgacaggggaaaaagtgattttatcactaagtgaggtccagaagaaaaactgactgggggagggagctaatttttctttttgacttcttgggtttgagatccagtgtgatgtctgggtacagacattcactaggaagtgggaaggccagtatctacaaaagaaaaacctccagaataacctcattcattgactccttctgtctttcagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagctcatcatgtccatgtgttttagaaaaagatctggatatttggatggctataaaccaaaggtgtcagaaataaaatgctctaagcctaggcaacatagcaagaccccatctctaacaaatttttttttaatcaactaggaatggtggtgtgcacctgtagtcccagctaaggctgaggtaggaggattgcttgagcccaggagttcaagaccagcctgagtgatatagtgagactctgtattgctatacagagcgatgtaatcccagcactttgggagaccaaggtgggtggatcccttgagcccaggagtttgagaccagcctgggcaacaggacaaaaccccttctttacaaaacatacaaaaattagccaggcatggtggcatgcacctgtagtcccagctactcaggaggctgaggtgggaggatcacttgagctctggaggcagaggttgcagtgaggcgagatcatgccactgcactccagctggggcaacagagcaagaccctgtctcagaaaaaaaaaaaaaagaatgctgcagcatgaaaagcaaaagaaaaggcattgaaatagacaggaacagtatatgaaaggacaagaggatcatccatgattgcatactgagtattgctgaatcctccatgcttcttattggtagcaccaggatggaatgacgcctttgaactgagctttgtctctacagggcatccctacagctggaaatggcagtcatctattggctgcactaactccccctcctcaacctcctctacttgcttagatgtgttctccagacacatcagctccactcatgagcttcccgttagttgtgaacttccagcagagacaatggtgcctcccccatcttgccctggaggctggcctgaccaggctggattcattcaaagtttaaggcactggtctcccaatgccatctattatataaatcatctttcccatgctggtctgaaataccctgagaatcaggggtgctcagtgtaacatcataatagcaaaaaattagggacgaacacaagttctatcagtattgcagaataaactgatacagctacagaatggtttttttttaaacttttcttatagaatattagacctttgatataggtatttgtttaaatacatggattcataagtatggagttatccttcaatcaatggaaagccaccaaatggttttgtggtcaggagagcttcaggacacttaatgctagttgtgacgtgtggggaaggaacccattgttgcttatgtgaacgtgtaggtaggtctatgagtgaaaaaatagccaaaagaatcaactgcacttattttgagatgagatcacagggacatatgccttctgtattatacctttatgtacaattggaattactataatgaccatttgttacttttgcaaccagaaaaaaaaaaatctttaaaatccagatcattaattaatagccccaacatggtaataccctctaactctcctaatgccacatgtcagctcataatagccaggggcatgcttgacccagcctctcagtcccaccttccagggccaggttgggagaataagatgaaggtttacctgactgagaatgagccagtgtgggccttgccctcagccccatcatccagtgtcactgctgctcggcagcacgtccgtctgtctccactgcagtctcacttatgtatgtgtacaacaaagagaccgatgctggtactcccaaaatgtgttttgtggttgccctgcagcgtgctgcctccatgacccacacatgatgggcagctggtgtaaagagccacagacttggcctgtgagagcctccgtctccagaagggcttggatgcagccagcagttgccactctatcagcatatagtgtgaggctgaggagaacagcttttggggttttggtttttttttgtatcagaagcccatggccatcatgggtggtccagagatgccaggaggcatgagaggaggttgccaaagcttccacagtgaatgagactcaggagggcactaatgtctgctgtattgcaatttgacagattctagaaccttttgttagaaggggccccattcaaagtgggcttattttgcaagtaacagcgtaaatgggcttacctaaaatctacaaatgaaggatgtgtttccttgaactcaagaggcctgaaggatgctgggaggtttattagaacactgtgagtactcagagggtcaataattattttttgacagtgtcagggatggagcatccctcaactgaccagacaatggccagaaattggtgtggatccctgtactatgcctggggcagtggcccatacttttttgttttagtttaatcccaccatgtggaaacacaaaccccatccttttctatgagttctttgtgagtaatgtcctgagtgtgtcaaatgaatttgctgaaagaagggtgtcttcagggtgatgttacacctgtactcctagagaatgtcagatgcagttcaaatcctgcctgcaaagattgtgtatggtggcagaactgtcgaggtaccccgtggtagccagataacggtctattgtgtcccttcgggggtgaaagcaacctgcagctgagatctgttgaaataggcgctgaacagaacacattagtcaaatctatgcctgcagagtatttaccacttgctaagtggatggagtcagtaatttcaataacattgggccatcacaggtggggtcacaggattcaggttgtagtaattcaccgagaggcaccattcattctttccaagcctaagaacagaccaaattgggctgttaaatggagaaacagtggggataatcaccctttctctaaatagatcttccataatgagtttcaatccttgaaagccgtgttttaattcatattgatcagtattaaatattttaacagagaaggtccatagagttccattttgtaaagccaattgtaagtgccaaaggtaacttaattttaattattttaatgtgttatttactgggtcacagcatccacgcccactgtggaacattttagggccatgttatgttacgaccatggggcagttaggcaaggcaccaggaacaacagttcccatactcctgcacccaaatgccagttatcatcatttcttactttggtcagttagatctattaatagaggcctggtgggctcagcaaatgcgcccagagtggcccagctcaaagcacaagcttgccagcaggcagcagcacagctcaaaacgcagcagaacctgttggcaagccacagccagagaagaaaagtcctggtggcggcggtcaccacccagactctctgcttgttgtgccatttgtcttgcaatttcccccagggaggtggcatcagctccccccatcaaaaattgggtttggatatccactctggcacacacaaaaatgatgtgttctagaaccccacagggtcagcattcgtgggtctccatggtcctagcggtgcccacgttatctgcccttgcagcggaaaaactcggatgaatgcgaggtgtgctgtcaagggggacaacttctctgctgcggtacttgtccacgagtcttccatgaggactgtcacatcccccctgtggaagccaagaggtgagtgggatgcagccccgcctcgggcacacagcactcacctccagatggaaagggcaggacctgtgagcgtcggggccgagggtgtgacgcagagcagtctggtgccagagactctgggcctctctgggtctctgagactgccagtgagcctcttggccccacactgcttctgcccctggaagtgccctttcctagtatgctattccctggacagcagggactcctgtccaaaaggagtaggggacgggaaaagccagcttatgttctgtgcctgttgaggaaagacaggaagcacggcttgtcacacatttcaccatagtctcacctggctgatggaggcctgaggtccctgcaggtgaaagcccagattctgacactcaagcctggcaggcagggttcctttgtgctcccagcagctcagacagggaaaagagagcccacacttaacagtgacaccaccttcctcaggctgcccgcctgccgctaccactgatgcgagggaagggccaatgctggagaccccatgtggggatcttggacactctgggaggtgtcccaccctcatggctgagcccatccttcctgagggaagacagtggcagccacaggaatggtggccatttccaggggctttgccctctgctcaccttgtgtccaacctctcaggatgctgtggagttgcaccttctgtaggatgaagaggtcttcaggaagccaacagtgccatcatgtatctaagaccctggagaggcagatgcagcctcaggaccagctggtgagttggatgcaaaccccaaacctatacttttcccttctcacacgagaagcacaaacaggcacagggtcagggcaatgtaccaaagggagccttcaatgtctccctttaaaggatgacgatttaatgcccaaactcagagtctaaacaaaatcccacacaccctgtgcgccttgggaagcatggctggaatgctgactgggcttggctgccccatccgtgtgcatgtctagacactcgcctggcttcactgtttctaagctgcatttcactttcaagccctcttcacattttacagaaatgtgagttcctcctcttgaaggcctactgtcatccacaaagctccttttttacgggcatcccatttaatgtaagtcacattttacggttctcttgcataaaatgcatttggagaaatttgggggctgatctggcaggtgctgcagtttgctcaggaagctggagaacaggagagaagggcagcgtggcagcagtggagcggggcagcagggattttgctgcacactctggagagggactacctggttcaaactccaccccactgctcacgggctctgggataccgggcaagttgcttctcctcctgtgtatctgtttcatcttctctttaggaagaatgtctttcctactagagattaagagtcacagatgccagctgggctcagcggctcacgcctgtaatcccagcactttgggaggccaaggcgggcagatcacttgaagtcaggagtttgagaccagcttggccaacatggcaaaaccccatctctactaaaaatacaaaattagccaggcatggtggcaggcacctctaatcccagctactcaggaggctgaggcaggagaatcgcttgaacccaggaggcagaggttgcggtgagccaagatcgcaccactgcactccagcctgggtgacaaagcaagactccatctcaaaagaaaaaaaagagtcatagatgccaaactgtgtgggttcccatctcagctctaccactttcttgctgagacatcttgggtaggttccttgacctctccatccctcggtttcctcatctatgaaatgggcattattatttatggtacccataaatgtggagattacatattcatatacttggcttagaatttagtttatctagtgcctagaacaatagctggcttaaagaggtcaaatggtattatcattatgaccctggaaatgaaggcttggattgtatttaagttggatccattccagtgatgacagctgtgctaacgtcacctctggtggctttgtccccaagattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggtaaagagcatttcctgcttcctttttgcgtcttttctactttcccctaatttctgggacagcagaattttgcaagtattacactcagtttcagcctggggagagctcaaacaagacaaggattacagaaaaaaaaccacctcggcattcctggaggcaaggagtgagtggcaaaaagaacagcaagcaggacaggggagggatctctggaacagaagctgaaaaaaaccatgctctgttcccagatcggcagctcgctcccaacgagagcagtaaatggcatccagcctctttgttcaaactggaaggaaaggcagtttatgcctacattgttcttcctgcctcagaaatatgaaaataaataagtaaacaacataaaatcaattaaacttcctggataatcaggcttgcatatttttacacataaatttctcattggactcaaacatctggaattgccttcagatccaatgttggtttcatcctcctttactagggagggacagctggttgagctatcctgcaatcccagacatttgtaactttggtttttcctgatttttatcctcacttgtacagatatttcttgggaggtacctaaggaagattttcatctccacccagcttccttcccttcttccatgccaggagttggcatgttcacaaaccacagattgtaaactggtatccactcatggagctgcagggagaaagggttgaccagagagccactcagtgcctggcatatccgtagtcctggagaacagagggtcatccttcctcagcgagtgggcttccaagaaatgcatttacaaaaattgttaagctattttgcatcatgctcagatttgccatgatcaaaactaacccttcagtctaaatcgcctgtcaggtggaaattaacaaccagctggagtctcatgcttttcaacattttagtagcagcatctccccatccattctgccttactgctgggctcctaaaaaaataagagtgaggctgggcatggtgactcacatctgtaatcccagctttttgggagtccgaggtgagggaatcatctgaggccaggagtttgagaccagcctgagcaacatagcaaggcctcctcaccccgatctctgaaagagaaaaaaatgttttaaaactttgggcatagtggcatgtgcctgtagtttcagcttctcaggagctgaggtgggaggatcacatgagcccaggaattcaaggctgcagtgagccatgacggtgccactgcaccacagcctgggtgacggggaaagaccctgactcaaaaacaaaaacacaaaaaaaagtatgagtgatttgatggctgtaatccttcatccttcaatgtgtttgtttgcttttttctctttcaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatctacactaaaaaaaaaaaaaaaataattaatacttccttaataccatcagataccccatcatagttcacattctccccactgtctcataagtctttttagagttgatttgttcaaatcaggatctaaacaagttccacacactgcatttggctctcctgtccctatgtctcttttaagctataaattgtcatgtatttattgaagaactcagggttttggtcctattacattttttgcaatctggaattttctggttgcattttcttagtggtatagtcctctcttcctctcattttttgtaagctagaagttagatctagaagcttgctttaactcaggttttgaggggtttgttttgatttgggggtttgggggcacatgcaggcttcacaggggaatttagtattattttttatgttaaggttggcagcaggtgcacgtgttatcagcctgatcatctatcacctgatggttttagcaatacctaaatccgtgatatcatcagaggttgcaaaatgatgagattcaggttttttttttacataattattggtcagaattattctgcaaatagcttctctttaacagtattcggttaccttgaaatacaggttgtacaaaaaataggataaatgcttgtttttttatttagcaatgtccaaaataatgaattgatttcccagtatcctctaaaggtaaccagggattttttttatttaattatcttgaacccacatatttaaatatacgtagtatgctacaaaccattgcagttaatacctttattgatgcttgagttgcccactttttctttttttttttttttttttttttttgagacagagtctcactctgtcacccaggctggagtacagtagcgtcatcttgactcactgcaacctcctcctcctgggtgcaagcgattctcctgcctcagcctccgagtagctgggattacaggcatgtgcaagttccccacttttagtgagaaactcctcaatttgcctcctgagttgttttgaaatgaccccagaactctttgatggtgtattagctatctattgctgtgtaacaaatgacctcaaagcttagctgcttaaaaagaaaaaaacattttattgctcactattctgtggatcaagaattcaggcatcatccatgaggatgcttccctttgctccacatggtactggcagaccccattcatacttgcacactgtcacttctgccacaatctattggtgaaagcaagtcacagggacagattcagaaggagggagaatagaccctacctcttgatgcgatgggtggcaaagtcacatttcaaaggagaatgttgcttgggaagaaacattgctgctcccatctttagaagcaatctaccatagttcaccctctggccacagtagttcacatctttcccaaatgcaaaggacactcctctccccacagaagtctcactctctgcagcattggaacaaagtccaggacctccttatctaaatcaggttcagatcagataaagcttcttcgggctgggcacagtggctcacacctgaaatcccagcactttaggaggccgaggcaggtggatcgcttgagtccaggagttcaagaccagcctgggtaacatggcaaaacctcatctctacaaaaaaaaaaaaaaatctttttaattagctgggcaaggtggcacacacctgtagtcccagctactcaggaggctgaggtggaaggatgagcctgggaggcagaggtcgcagtgagccaagaatgcaccactgcactccagcctggacaacagagaccctgcctcaaaaaaaaaaaaaaaaaaaggaaagaaaagaaaagaaataggctcctcaggtatggttcattgggtgcagctccttgggtgcacctcctcttgaactagaggcctgtgagctgaaaaattgtttcttccctgctgccaacagtcagtgatgaaacagggactgaacaactactatagacacttccattcaaacggggaaaaaggaagcagcagtcactcatttatagcaattctgaaatccagtcaagcacatgttgctagttccccctaatcccagggcaggaaattttccttgatacatgatttatatgtatgatacacctctaattcccatcccatcccatcctaccccacaggcttcttccttgtcttcgtcggttctgtattggtgtctcccttctccaacagtattatttactcacttgctcaatccccaggtacaacaataaaagttaacagaatttcaacactcagaccactatgaaaaacaaactaagttgatttctaaatttctgtggagtttatttttgttttatagatttaatataccattgcagagggtatttaatgtaccattgcagaggattttacatttgtatttataaatgagattggtctatagtttttacacactgtcatagtcagatttacggttatcctacctcggtaaaataacttgtaaaattttctaccttttaatatattctggaataatttatagtgttttaaattaaccaaaagtgtgtgacccagagttcactggagagacagtggtgaccacattatctgctttctttatggtttttaggctatgcagatattctgttggtttttgagacagctctgcttttatgtttttctaagaagtcatctatttcatttgtggttaaaagtaatataggtggtctgccaggcgcagtggctcaggcctgtaatcccagcactttgggaggctgaggcgagtggatcgcgaggtcaagagatcgagaccagcctgaccaacatggtgaaaccccgtctctactaaaaatacaaaaattagccaggcgtggtggcgggcgcctgtagtcccagctactcaggaggctgaggcaggagaatcgcttgaacccgggaggtggaggttgcagtgagccgagatcccaccactgcactccagcctgggcaacagagtaagactctgtttcaaaaaaaaaaaaaaaaagttatataggtggtcttatttctgtcatattttaatatttctctttttaatgttttaatgttatttttgtctattttttttcttctgccttctattttggaaggcatcgtaacggcttttagttccaatatttacccataagttttcccaatgcattttgacttatttttttaatgtcaaagtcaaaaataaaatatctgtaatgtgtcacatacttaaggcaatgcgtttatcactttgatacctctcagctcccttattcctgtcttttcactctcttgaaatacagacatgaattagtattaatttttttgcttttactctataatgtttattctattcaattatattatgtcattatttgttagtttcacattatgtaaattatttgtcatgtcctatgtcatataaagtaattcaaaagcaaaaattgaaagtgtgtgttacatgataacctgtatttttgagaacagtattaatgtgtttctgttttcactgtttaagattccctgctggtcttttcttgacacgacttctccatacttcctttttgctctgcctttcagtcaactgaagtgtgtctttaagtaatttgaaaagaattacatggatggtatgttttctgattcaccatatcttagaatgtgttctattgttttcataaattaataacataatatataacttatcataacttctcaccttcaaaattgatttaaactttgttccactgtctttggggattttattctacaactctgaaatctaagtccagccagaattctgcctcctcattagtgtgtggaaaccaatgatatttcccctattatcccaatagttctatatttagttatttttgccaggataggtttcaaatatagtaccttttcattcatcatgcctggcacactgagccctttcgatatacatgcctggttatttttgcagccccattaaaccttactgatccatttgtcctgggctcactttcaagaacatctattatctacaggctatctgctctctgttctccctatttatcattttttaaaaatgtttcaagaagcactcctcgtcttaggccattagtatgaaactgatattaatataattgcaatttgatagtatttaaacctattttttagcatgttaataatgctaattgctatttttaaacaaaagttcaaaggacataaacttttctcaacataatgcttttctcaagacaaaaattgcaaatcattacaacttactaaattgtcctggtctgtgtttctggcttttcattcttagtctccatggaggagtaagaccatcaaaaaccgaggccctgccccataaggaggcagaacctgtccagcaggcccccttcagcctcccagtgaggaactgggagtagagtgtgttggagtttccatttaggtacccagtgtcacagactaatgaacagaaaatgtatagagatttcttttgctcctatttctcagtgttttcacaacagtgtgaactgtgaaatagattgacctcacctatgatccaggaaagggcggaggcagtttgagcactggctcaagaaaagcatataataaagtagaattcccttcattgtatggaaagacaacaaatatggccataaagatggccactcctggtgccattttggagtgaatgctgagttctagagatgatgattttatcagcctagactttagacttccaaatccttctgagaggtacactaaaggttcccattcctagcataagctcaatgcattatgataaaagattcccctccctaccagtttaccagcagccaggattgctgggtaaaaaaatcttatatccattcatgacctaaccctgtcttccgttctcgcattggtaagctgatccaggtctgtctgtctatcatctaatcatggctctgggtttctctgtatcttgggcagggggtggggggtaccctaaagagtcatttatttctttcaagttgagactttcaaacactagcagtttgattgccatgacagccaagacccctattcccggaacactctcttcccttgctcctgtttgttgctgtactgctcccctggttttcaagtgatttctgcctgcgagagcagggtttgggttattctgcttagcccagctggtcctcaccttcccccagactctctgagctgtaggtgcaggatttgccctcctggtcgtttcccactgctcaggcctcatccacgttcagcacgtacctccttagatgttaaaaactcttaatgaacccaccatcagtgatgcccctgcagacaatgccaattgcctctctccagggacccattccagtcctgcacccaggccataataacataggagttaaaaagaaattatttaggcagatagtgagggtaaggaagtcctcgctgaggttttccttttaatgaaaagcagcccccaagtcatttcttttctaacaaaaagcagcctgtaaaattgagctgcagacatagataagcaagctggaagcttgcacgggtgaatgccggcagctgtgccaatgggaaagggctatctgggagccaggcatgtccaacacggtggctccatcttcccttttccttgccaaccacatgtacagtaaggagcagacaacatggtgctgaccaagtagaaaacccatttgcataataataagattagggtggggtggccaacttcctcctgtgctatgtaaatgtcacatgtggtccaaccaatctgtgggccctatgtaaatcagacactgcctcctcaagccagtctataaaatccggtgcattttggcgtgggctggaagacccacttgggcactcctctctctctgcaggagagttattcttttttctctttcttttgcctattaaacctccactctttcttttttttttttttttctgagacagagtctcgctctgtcgcccaggctggagtgcagtggtgcaatcttggctcactacaagctctgcctcccgggttcacgccattctcctgcctcagcctcccaagtagctgggactacaggcgcccaccaccacgcccggctaattttttgtatttttggtagagacggggtttcaccatattagccaggatggtctctatctcctgacctggtgatccacctgcctcatcctcccaaagtgctagcattacaggcgtgagccaccgcgcccggccaaacgtccactcttaatctcactccaggtgtgtccatgttcttgatttccttggcatgagaccacaaacctcaagtattaccccaggtgaacaacactgcttcaatttctcccatctgatccagctgggttccactctttcctgaaccctttcctccccaactggccagggagcctgcatcagctcaggactaccttcaggttatgatgtgggaggttttacatgactccaaaaggctgcaaaaatggaacaacaaaaaaagctttcttatcaggaatgactggaggaattacatgtaaaaatacattcccccctctagctgatagcagaaattccaccttggaagattcattcttagaaactggggagacattgtctcctggtgaagtgcagcctccctcaggagaggtagacttcattggcatcaacatctggagtgggtacatttctcagatgctttccaagctctggtagagccaggccttcagagcaagctcacattctgcaagtagttatgggagtcggtgggcggggtcagtcctggcaggtgccttggactctttgctttcctgccctgagccctgaggaccctgactgcttctctttcgtcccaaagctgctccaatggaactcctcccctcttgaaattaggtgtggggactatgggattcacaactctcctgtcattctatctcttctgtaattgtgacttagaaaaaatgcacagaccgtattcattttagcagtcattcccctatgaagtgacatgtgaaataatgaaatcaagaaggcactgtcttgctctcttcacctctggtctcaactgggccatttgaatctccagaaccatctagaacaaggaagaccacctggcgaagtccctcccagcacaggactccaggcaacctggcaccagtcatccccattggacaagaccagagctcagatgcattggcagaggggacacttttcccctttagcagctactggcgtctgatcatttacagagaggttgggtagaaccctgaggaacccatgatagccactttccagaagacagcccggggcctcaagcaaaaactcaatggtgaggacagtcacccagacctggacacaaggcccaagtatgagcagaaaggggtggttacacgtccaggatgtcagctgatactgaagcatctgacacactgttctgaaacagagtctgttggatgtggagttaaggttttgactcactaaatgctctgccctaggggataaagtggaaatgtccttatttcgcaagggcaacagcgaggtttccagccttcaggcccagcagtggttctccagcttccacaacccagaccttaagcactgtggttgcagcattcagaccccgggccacaactgtgcccagctatcaaggccgggattgaggggagctgactcagctgcccccatgacttggttcagaattgactcacgggcctatgaaagtgctctgggggtacctgtcaaagcttggtcttggccagtgaaagataagcattcaagttaatgggcatatgttagtactcaccagcaggaaaaaactagaggcttcagtgcatcctaggatcctgggggaagaattgtcatgtcctcctaagaaggcagaattggtccaaacaagggacagtgaggagggcagggtaaacaagccactccttgccacctacaagtgccaatttgccctaaattttcccagacagagcccacaggtcagattttgatgtttctgtatctggaccatgacccagtttgtattcatagccaatccctaatctcatcatcatctcagtttccagttcctcaaagaagtttacccttgaccccctaggcctggttctggctctgtggagggctcaggcagagcagaatgcatacagaggctttcccattctcccaggatgggcacaggacctagccctgagagcagcaggcaccctggacttctacaaaagtgtgccataggccaggcacggtggctcaagcctgtaatctcagcactttgggaggaggcgggtggatcacttgaggctaggagttcaagaccagcctggccaagatggtgaaactctactaagaatacagaaattagcccagtgtggtggtgtacacctgtaatcccagctacttgggaggctgaggcaagggaatcgcttgagcctgtggcggggtggcggaggttgcagtgagccgagattgcaccactgcactcctgcctgggcgacaggagactctgtccaccctctccctaccccacaaaaaaaaaaaaaaaaaaaagtgtagcatgctgttcaaccaccagagggcactgtgggcccctccagagacggaaaggaattgagctattaaagctcctgcaaggacaaggaactagcagaaagaagtagtgaaggctttgaaggggaggaagatgctctcagtggctcctatttcatgcagatggaggaaaaccaaccaagagcatgcgccaggtcctctccagatgagactggcaaagacgaagcagcaggcagtcacgtttaggcacatgcttgcgaggatttccttactgtgacaaaaggtcccttctgttgtttgtcacaagtgcaaaacctcacagctagcataatgaaacaactgagatgcactcagtaacgtgggctggaaaaggatccccagtttttcgtttcatagattggaatctggtaggaggcccgcctggggatggccggcagcaggcagagacctggattctagatcctcccatttgcaagaatgtcccaggtgacctcctctcggggatgctagaggatgaggacagggtgaagaagccagcctactgggggaaggggggtctttgggaccaatcaagagtgcttagagaggggtcctctgagatatctggacactgaccgcttcccaatgaattgcctatggcccgctgcttcagaatcacagggagcttgcctaaaatgcagattctgggatgttggctctgggtgggaatctctaggattcaggcccaggaatctgtgtttttaaccagttgaacaagttttctaggtgatttttgtttgtttgttttgttttgttttgccacaattaggtttgagatccactgccctacgactggtcctttatctgacttaaacatttgacaaaggagcaaatctaactaaggtatctgtggtgtgggcagcagtagagcctgcaacttaatcacaagagctgtccttgtcctgtgaggtgacaaccgagagtttattgtttggttgattgcttggtttgtttaattgtaatgttttgtagtttaattgtttatttattaacagctttcagaaacagtaataagaatagaatgtgaagccaactgcagaagaaaaaactaaactgagaagggaactaaataaaaaagcagctgggcagatgagatttgggggtgcagggagcaagcatgtggatggagggaggagattaatattgagccatggtcatgagaacttcagagagagatggatgagtggaggtggcccacacggtattctcttttagtgttaaagtctcaccaatgc

SEQ ID NO: 1739 - DNA, 760 bp, Homo sapiens
aggaaagaaaagaaaaagatgtatctggtcaactccaaaaaggagacataagaaaaaaagcctcccaggagagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagt

SEQ ID NO: 1740 - protein, 223 aa, Homo sapiens
GKKRKRCIWSTPKRRHKKKSLPGEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKSGLLLCPPRINLKRELNSK

SEQ ID NO: 1741 - DNA, 41522 bp, Mus musculus
  misc_feature (1)...(41522): n = A,T,C or G
ttttgttgttgtgttgtgttgtgttttgcttttctgagacagggcttctctgtgtagccttggttgtcccagaacttgttctgtaaaacaaactggtcttgaacttacatctacctgcctctgccctccaaacaccccagtgctgggattaaagacctgttttatttgtttgtttggtttggtttggtttggttttcattctaaagagcacatagttcctaatccttctaatactttcaaatagtgctactatttgattcaattactttgattcaatgatattgattcaaatggctaagcattcaaatatatgagcttttgggggcctttcttattcaaaccaccacattctacagtatgatctccataggctgtaccactcataatgcaaaaatgcatccaatccttcaaaattctccatagtctatcacaatctcaacaaggtttaaaagcccaaagttcaaagtcccttcggagacttgtggcaatcccttaactgcaatccctgtgcaaccaaaatcaaaaaagcagatcacatacttctagcatacagtgcattgaatgtacattggcattccaaatgtggggaaagggagtctagggaggaaaaaatggaccaaagcaagataaaaacccagcagggtaatctccaagttctgtattctccctgtctgatgtcacagtcctctttagacctccatctccttcagctctgttaagtacgacccacttctttctcttgtgctggtcccatgctgggtctgcagctttcctacgtaggtatcccaggactctggtatctccagcatcccggggtgtccaacaatccaggccttgccttcacagcttcacacaatggcttctctgggcctctgtacagggacaccgagggagcttcctcccagagggagattctacaacccctgactctaaagccagacccacctgtcaaaagccgcctcgatctgctgcttgctggagctggaatgtggcttgtttggttcaattacgatcgattgcatggactttccactgttgactttctttgctgcttgggtttttctttcactcctccacacaaaatggaaggtagagattgcacatcagcccagaaagtaaattttttgaaggagcttccaaatgtagaagtttttcaccaaaaaggcctgaattctgggctgaagagatagcttcttgagtaaccgctaactccaggacctcaaggccctgagtttgattcttaaaactcatgggcaagctcaggcatgccctgggggtgtgggcactgtgaaaagtagcttggtccccagttgagctaaggcttgcaactccagagaccctgaagggacagtagaagtttcacctgatcccaggcaccaagcccctgtcactaacagcagccccctatagatttgtgaccatcagtcactgaagcacaataccccaatccctccacacgtagaggacatgacccctccaggttctccagggtttcaagccttagttcaacagggggaccaagctacctttcacagtcccacagtggggttacaatcccagcactggtgagactgcggcaggtggggtcctggggcttgttagcctgcctgcagttccaggatggtgaaagatggtgagaggggaccatggcatctaagggataatgcctgaaattgtcctctaacttccacaggtccacacttgtacaccctgcacccccagtaatctaaatctctggtgaacgttccccaccccccactctctttctttctgtcctgctcatgttaaaaacttcagaagacatgccaatactcggcctgcattccatcccttttaggtacaaatgggctggagcgaagaataacagctgtccctttcactgaagcatgctggtgttatagtcttcccacactcacacacacatctatctggatcatataagaattgagtgtgtcacttccgtgtaaaccacggcttgatgcttggtgttcactgcctgagagatacttaccacatcttcaggagaactccaaactgccatatggacaaggaacataccctattttggaattctccaatgcctagctagtacagttatctaaatatagctgagggccagctgcacaggcctggaaggactgcagctgggaaactggggcagaacaagaggttcacagccagcctgagctatagagtgagactgtctcgacatacaacaaaagcaagccctccccccccccccaatcccagtaatagcaaaaacaataaacaaagcaaaggtttttagagcaccctggctacccctgcataggtttgtcattatgacttaaagttgcaaggtcagatgtcatttttgttttgtttttccagataaggtttctttgtgtagccctggctgtcctggaactctctctgtaaccaggcaggccttgaactcagagatccacctgcctctgccttctcagtgctgggactaatggtgctcgccaccacgcctcgaatgttttgttgtggattttattacatagtcttgattagcctgtggtgatcttatgttattgtggcataagagctggaatcaggggtgtatactactataccaggcccagaggccatttctttcccaaaaactatgtgcgcgagcgtgtgtgtgtgtgtgtgtgtgtgtgtgtgtgtgtgtgtttctgtctgtcttcatattaaagaaaaagtacaaaataacgtgaataatgagaggtagttgctcatatttttttccttcttgtctctcaaccttcgtaaattcctccttccccactgctcttcataacttcctgacacccccaacttggcgattgaacttacaattttattttcattttttaaaagtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatggtagcagatgcctgtggcactagcactcaaggagaggaagaattgctaaagattggaggctagcctggtctacagagcaagttccaggttaggagttcatagtatatctgtctcaaaagccaaaacaaacaaacagataaatgtgattaagtaaaggaaagcatccagagcagaacttctgctatggaagtccttcaactttgcaagagaaaagtagtttttgtttttgtttttgttttgttttgtgatacaggactctctaaatagtcctggctgttttggaactcactatatagatctgggtgttctcaaactcacagagacttgcttgcctctgcttcttaagtgctgccacaacaggtcagttagttcggagctaatttttaattaaatgtctatcaggtttggaaggctcattatacacactctggttaacataaattgaatgtttggtatctggtagacaggtttcttgcttctctccttgattttacaacaaaacaaaactttcgtgaagaataattttctgataggcatccgggtccacagaaagaaattccggtccccgtgcctccgtgacacgtgaccctatgacccaagaagccattttaaggctggcctcatagaggaaactacaactcccagaatgcctgcgctttgcgtcgtgctggcactttcactggcccagccttaaaggcgagcctgtagccgggcgccatctttgacgctggcagtcctgggtttctgcttgttcggctgctgtgaggacggcgggcgaccgcagctaagaaaagagaaagacgtggcagcacgcgggagtcggagacattgtcatcggttcggtaaaggtttctgttctctggtaactagacccattttttgattcccgggtgacttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccccccacatccggtgttcccgaaccgggattcccgggtagccccggaaaagcgactgtttcggacccccggagggggaactgacactaggttgctctcttccgggaatcagtttctttagttagctggccctccctcccgagatcagatcaagtgcctggacccgactttacctcctcgccttcctctctagggtcccactactttggaggttttctaatattccacatacagagtcgaattctggtatcctattcccattccctaccctgattactctcccgcccaagccttcatcctcgaagtcaagagctacagggactcttcgttcttgtaggattggtgagatcgtacgaagaacaccccttagacgcccataatcggtgcggatccccatggggaaggctcgttttgttgacatctaccaggctttggttctgaacccagagaaggcggctgtgcagctagtggtagccatgctttcgtagggtaaacgtgttggtattgaggggaggggagggggcccacggaaaaggaatggaagtggtttaaagcttattttagtttggctgctcatagaatgtcaatttatgagttatttacaggttgtatgtaatgttgcttcagtctaaaaatatgaactcttgatagaaaccgtaaatgaagaatatagcttgttaccttgttttgaaattttatttccagttaatttttcttcagccacctatagttttcaaaatatcagaacagaaagggcacagctagcgcttactgctaatgcctagtatgtggaatctgatttagctggccggaattgactttttaggttgtattggcaagtcagtcttaaatgatgactgttgagtggtgcactaagcttaagtgaaatttcctgaaaatattcccgaagttaagggaaagccagtgttgttgtcgtgtggattcactaaaagtacatattttaagaactgaaggcatttccagcagatgaagttcttgattcggcagcaagaacgtgaacctgcaatttggaagacttaacctttagctgctccagatcccatgacggtgggaaaatgggcctcggttctcttttctataacataaggacactggacgatttgaatttgaaagttacaagaactcctaaagccctgcaagacagagtttgggaatgttctccattgctgtcatttttcctccaaaaataacctggcttggaaatcatcagttgaaagggaatttgactccccatagaaactggaggaaaggtaatacaagtggagagggtcagctgtatttctgccagagtaataaacccactgagaggttctggtccgcattgtggagacataaagagaatgagtgtatgtactctaagtgtaccagtttcctcaatctctcctggcagaagatgcagtacttttggtgatgctgggattctggggtgcgtttccattaattcaaacacagacgaagacgatgtggtagagggaaagatggtggcagaaggagcgaataaagagacaaaattgcctgctaaaaagaaaagaaagaagggtttgcgaattaaggggaaaagacgccgaaaaaaattgattcttgccaaaaagtttagtaaggatttggggtctgggagacctgttgctgatgcccctgcttcgttagcttccggtgcccctgagcaagatgaagaaagtctttttgagggcaacatagaaaagcaaatctatctgcctagtaccagagccaaaacctccattgtgtggcacttctttcatgttgacccccaatatacctggagagcaatttgtaacctgtgtgaaaaaagtgtcagcaggggtaagccaggcagccatcttggtacatctactcttcaaagacatcttcaggcaaggcattctcctcactggaccagggccaacaagtttggagtcactaatggggaggaggactttaccttggatttatcgttgtctcctccttctcctggaagcaatggaagctttgagtatattcctactgattctgtagatgaaaacagaatgggtaagaagcgcgataagtcagcatctgatgccctgagggcaaaaagagggcgctttctcatcaaaagcaacattgtcaagcatgccttaattccaggaacgagagccaagacatctgcagtttggaattttttttatactgaccctcagcacatctcaagagctgtgtgtaacatatgtaaaagaagtgtgagccggggtaggccaggttcccacttaggaacttcaacacttcaacgacatcttcaggccacgcatcccatccattgggctgttgccaacaaagacagtggtgctattggaaacggattagatgagactgaaacagagagcagtgatctcctgaatgatacgatgcctggagagaagtcatcaggcagccaagatttaacagctgaggacctcagtgactctgatacagatgaacccccttgtttagaggttgaaaatagatctgagagtcctattcctgttgcagaccaagataatccggtgcacgcacaagagagagaaacgacgacacattgtgaaaatgcagccgcaaatcaaataagtcaggcagttattcagatgattgtggaggatctgcatccgtacaactatttctcaaccccagcctttcaaaggtttctacagattgtcgctcctgactatagattgccatcagagacttactttttcaccaaagctgtacctcagttatatgattctgttagagaaaaaattttcttaactttagagaatgttcaaagccaaaagatccacctgactgctgacatatggactcatgacccttccactgactatttcattgtgactgtacactgggtctctttggaaactgcatcttctcccagtaatggtgggactcccaattttagaaagtgggcagtactttgtgttacaggtttagccaaagactgtttgataactaacattttacaagaattaaatgaccagattggtctgtggctttctcctaatttccttacccctagcttcattgtttctgacaattcttctaatgtggtacatgcaatcaaaggtggtggctttacccatgtgccatgcttcctgcattgtctaaatatagtgattcaggactttttctgtgagcacaaaagtattgagaatatgttagtggctgctaggaaaacctgccatcattttagccattctgtcaaagcccgccagatactacaagaattccaaaatgatcaccagcttccatggaagaatctgaagcaggatgaaactggccactggatttctaccttttacatgttaaaatggcttttagaacattgctactctgttcaccatagtctgggcagagccagtggagttgtacttacctcccttcagtggactctaatgacatacgtttgtgatattcttaagccatttgaggaggccacccagagagtgagtgtgaagacaacaggattgaatcaggtgctacccctaatccaccatctcctcttttccctgcagagactcagagaagattttcaagtcagaggtattactcaggccctcaatctggtggacagtttatctttgaaacttgaaagtgatgccttactaagtgccatgctcaaatccaagcattgtatcttggctactttgttagatccttgttttaagaacagtttggaggacttttttcctcaaggtgctgatttagaaacttacaaacagatccttgcagaagaggtttgtaattatatggaatcttcgccaggggcctgccagatttcaagttctgaaacatctggccctttagttaggttaggaactgattcgtttacttctataaaagaaggcacctccagtgcaggttctctggatagctcagccgcaggcagtgttgctgttgggagcaaaagctccttgctccccgctgcggtagcagtagtagatgagtacttcaaagagaagtattcagagctctcaggaggtgatgaccctttggtttactggcagaggaaggtgagcatatggccagctttgacccaagttgccattcagtatctgagttgccccatgtgtagttggcaatctgaatgcatgtttaccacaaatagccactttcatccaaagcagatcatgaacatggactttgataatatagaacagctcatatttctgaaaatgaacttggagaatgttaactatgactattctacattgattctgagctgggaccctgaaaataaggctgttcagagcaatgaaaaagaaatactaccttaatttccttttccttgtcctacttaaaatgggcagctttcgctatattactatatcttattgctgttgttactatatgtagtcgtactatttatccttttaaaaaaatggctgggtgtgttcacagtgcctgtagtcctggctatttgagacactgaggctggattatgactttagcacatgagtttgagaccagcccaggcaacatgttaagatcctgccttacaaaaatgaaaaacctgaggaaatccgaaattacagaaagactgaaaactccacagaggcagtgtaacgatgacaaaatgaaggttaactttgaaaatttcacagttgtaactcagtgtaactaacatctatcaaagtgtcatttgtatcacttgagagagagggcagtgttaatgagaaacacagtgaagcgttgaaggacttaggtatttctggttggtagattgagctagtcattgattagagtaaaaacttcttccactgtggaagattgggtttcagttattatttatataaatacagtgattcaggacttctatgagcacaaaggtgtttagaatgtgttagtgactgcattaacatagtctttccctcccctgttttttaatttctttaaaacccctgacacagcttgacagaatgaaaacccacaaaattgtttcatttttagaaattatagttgcctcaccctggtcagtttataatgtcaggttactgggtatgatagaattatcttttatatttaggattgggtctatataaaagggaacattacaaaacaattagaaaatgactttttggtctttgatttgctttttataatatagtaccaaaaacagggattatataggtgcctttaaaataacccattagtaaaaaacattagatgtttgtaaaatcaaaaaacaagcaagcctcgtgaacgtgcagaccccatgtgagtttcccagagaatatttctagagcttgttcatttttttcaagggtgctcctggtccatagcatgatgttcctaactgcagtttggaactgtatttttaactgagataagcagttgaaactttactgtgttaggcatcattgctgaaatgagtgaactgtctcagtggccctgcaggtgccttcccactcggagtctgtttctgtgactgagtgggaggccacagagagctgacttttagtaagtctattagatgtttcagattgaataactaatgtaagatcccaatttttccttttttttcattttagatttggggatattccctgcccaaaaaattcctggaaaattgactagtattaagtgtgagtaaaaggtgtccacttttttttaagtcttgattttagttttgtcttggatagtatttggcaagatttagcctagaaagtctgtagtgtttattacataagaagcaaagtgactttgttactgggctggttttgaaactcatttctgtgtattaaaataacttttttttaaaattttaaattcttaaatggtaaatgcaccattcattgtgaagtgaaattttatctcccccaaatttatccttttaccaactggagtgaagtctttagctctaatcatcagttatcaggaagcctttgcagggccagcattgaatgccatgccagtgatgctctgttgatctaaaggaagaagagtaagcatcctgagcatctctgtgcttcccgtgagcatatctgtgcttcccccgcccgcctgcccacccgagctggttcagaatggctgtaatgctgctctgccttcttcagctcgctgccccactctgtagttactctgtaactatacacttgtacctattttggttaaacactccctgacgatgattgttaaacataccatatacattgacaaatatatgtatctatcaatacatccatctatatggatttcatcttgattttgtgactgggtaaaatttagtagcattaacttcatggtactttggtataagagtaagttcactatttttatattgaacccaaatataaaagcttttatattatattttaaaagaatagttacccaaatgttttatttctatacatttgtgtgtgtataagcctgttagtatatattatatggatattatatacataaaacactttatatttttacatacagtatgcttttattatacagataataaagatgggggaaggtttctgttttttttcttaataggtgaagaaatcttgaagaccagaaattggatcttattgaattttggtggtgtttttacttttttcttttttctttttttcatctttttatttttaaattatattgctcagctatggaagatggattttttttaaattctttgaattttaagttcatctttaaatgaacttttgttgttatttttttatttttttgaggagataactaatgctagctgtctccagtctgacagaggttatacaaatggacttaatcttccaggagttgggagatgttttaaagatgttttaaaaacacatcctgtgtttcaattgtggctgagaggtttccttggcaatgtgaggaagaaaattctttctacctcattattattaattcatggattgagtgttggttcgacctacaggcgtaatagcttggaactgagtgaagacacagatgttcctgttgagagcaaccagctaatgtaagtggggatggggctttatcatgaaaggagtacactgtaatttaaggcatgctagactagtgatgctcaaaagccattgtccacactttatctctcgtaattttttaaataagcttttaatttgggtgcgggggaatagaaactaacatttcttcctggagctaaggtgacattctataattctgtttccttggagaaaaaaaaatcattaattgttactgagtagctccttgtctagataagtggctttattttgtttttgtagtagctatgtagcatgtatttcacgatgtggacgtgccataatgtaatgtattgcccattgggagacattgaggggtttgatatcattaacagaagccctgcattcagtaagttggatgcacacatttgtgttatcttagaaccagtttattcacagaatagttaaaccttactcagaagaacttctaacaatttactgaacaactgaggccttccttatttatggaatctcttgattgtactgtttttagtaaagatagcaactctttggccattttgttgatagatcattctataaaaatgttttctccttattttgttaatggtttttaacttttgtattataggaacggtattttcactcagcatattaaaaaaccaagatttccatatactgtatattcatatacttaatatatgctgcatattcagatgctgtttaaggattacagtcacatgacatagccactctacacatagggaagacctcatcagatggggcttatctttttgctgactgcaattgtgggctctgaatgtgctttactctagtgctctaaggatctgacacttctattatcctggcactttaaggagacttcttctcaagtgactgactttattgttaatttcaaactttcttacaaccaaatttattgcctttttgcattgctgatttgtgtagttgcttatattctgtgtttaaccactttatacttacggtataatcaggtagagcaaaaaaaaaaaactcttccattacttttttctttcagtttgtgtgtgtgtgtgtatgtgtgcatgtttgcatatatatggggcatatgtggaggccccaagattatgttgatttcactggtctagatctcactggttgtgtggagagacagtttggatagatagctcatctctggtgctccttgtaacacttttcagggatagacttgttagataaggactgcctttcccacatagcattttatgtgtgttctggggatccaaactctggccgtaaagcttgcatagtaagcactttagcccctaagccatctccccaattcttctattcttttttttttttttttttaaagatttatttatttatttatatgtaagtacactgtagctgtcttcagacactccagaagagggcatcacatttagttatagatggttgtgagccaccatgtggttgctgggatttgaactctggaccttcagaagagcagtcggcgctcttaaccactgagccatctcgccagccccttctattctcttttaaattgcctttattttttctcaactattgataatgattttacagattcaaattgcagggagaaacttcctttggtattctgaattgaattcaaggtgtttattatttgggtggtgaattaatttccttaatcctttattgtcccagttatgaatgatataggtcttctgttcctggtcactgctcagtttctggttttgtatttaatatggcttttgcatccttcattttcttcatcttttacagcctcactcagaattgttatctgaatgggacaattgtacagttttgggttatcttccttatttatggtcctgctattttcaatactttgtagttagttgttagatttgctagtttgcaagcgtataatttatagacactggattgtttttggtttggttctccccactcccctgaaattgtttttctgtgtagcctgtgtagccctggctgtcttagaactcgttttagagactagactggcctcaactcacagatccacttgcctctgcctcctgagtgctgagaattaaaggtgtgcactctcataccatggattggtttagagtttgtcctgtcttgtatttgtgctcctcagactcctctatgtattagaacattggaatggagccgagcaatgtgaagagtgagtattcctttgttttgagcaagctaatatactgtggatcgcaagtgcatgtgcgtgcttgtgtgtgtgtgtgtgtgtgtgtgtagtagctaacttggagaatatctgcctagtatgtataaagtcatggcttggctccagtaactgcataaaccaagcatgggtcccataccagtgatccttgatcaaccagaaataaatgaactcttagtccctatctcaaaaacaaagggagaggtggaggtaatttactagtagtaatttactagattgtttggcttggaatgtgtggctttgttttgtctttattgaaacagggagtctcttgtagcccgagttggcctcaactcagtatatagctgaggatgacctgtcatttgcctccacctcccagtactggccttacaggcctgtattataccatacttgacttaaaaaaaaaaaaaagatttagaagtacactgtagctatcttcagacacaccagaagagggcatcagatctcattacagatggttgtgagccaccatgtggttgctgggatttgaactcagtaccttcggaagagtagtcagtgctcttaaccactgagccatctctccagcccccattggtttttttgagacagggtttctctgtagccctggctgtcctggaactcactctgtaggccaggctggccttgaactcagaaatccgcttgcctctgcctcccaagtgctgggattaaaggtgtgggccaccactgcccggccgtacttgactttttaaccccccaaggtttctttgtgttgtatgtgtgtgtatgtaccacgtgcacatctgtgtatactcttgaatctgtgcagaggtcagagaagaaccttggatgttggttttggcttcccatcttgtttcagattgggccttgttcacctctgtatgtgaagagactcctgggcttctcttgtctctgcctctacctttaataggagtcctggaattagaggttcctggcactgactggctttactggcttctgggaatctgaatttaggtcttcatgcttttgtgagtgagctccccactcacctgtcttctagcttctacctggccccatttcgaaatgttttgtattttgattcgtttatttagccattatacttttctttttgatgtcatcataagctttctgttttgaagtcttacacaaaggttatttttgttgttttgagacagttgttgtggtttaaatatgcttggcccagggcgtggcactatttatttggaggtgtggccttgttagagtaggtatgtcactgtgggcatgggctttaagatctacatcctagcttcctggaagtctgtcttccgctagcagccttcagatgaaggtgtagaactctcagctttgcctgtaccatgcctgtctagatgctgccatactttacccttgatgataatggtctgaacctctgaacctataagcagccccaattaagagttgccttggtcatagtgtctgttcccagcagtaaaaccctaagacagggtctctctttgtagccctggctggcctggaactcactgaaaccctggctggcctcgaactcagagatccttacctgcctgggcctcctgagttctgggattaaaggtgtgtaccacctgactacttttggtttttgttaatgtaatgtgtttcctaatattaagccactcttggttctgaaataagccttttaggtcattctgtgttactctttttactgtataatatataatagctaatatttagaatattttcattctatcataattttttgtaaaatttttttgagttgagtatgtcttgtgatcccagcaattgggaagcaaagtcaggggagtagcaggtttcgtcagcctgcaaaactgtattaagaccttacctagctgggcagtggtggtgcatacctttaatcccagcacttgggaggcagaggcaggcggatttctgagttcaaggccagcctggtctacagagttccaggacagccagggctacgcagagaaaccctgtctcgaaaaaccaagaaaacaaacaaacaaacaaagatcttacctcaaacaacagcataaatgtttgaaacatcaatgttttatatgtgagttggttttattctttttctacttctaatttttttcttattagaatatttgcttcaatagtgtattttttaagaatccattgagtacattggtggtataccttttgagattatatatattatatatacacatacatatatataatatacatttgtatattatatatacacatacatattagatatatacatgtgtatatataatatgcaaataaataaacattatatatacactatatatatatatattttttaaagacttacatcctgagattttcatgaaatgttttaaaaggctgactctctggttagtctcctttaagatccattgcctggtagctggatttgtagctgagaagtctgagcttcattttgttagtagtctgtcactgagtcaagcacttccccagtgtctctaaaggcaggcagctctgcccctgtcactcctactttacacgggttccagttctgggaattgaattccctgaaattattttcacataatacatccttttgtctcatgttgatttatcttttagttgattgattgattgattgattgattgattgattgatttttcaagggaggtgttttgcctgcatgtcatgtatcacatgtctgatgtctgtggagttagtgatggctgtgagctgctgcagggtgctgggaattgaacccagcttctccagaagagtcttgttctgtgttgacagtcttgggcatgtgctttgattctttttttttttttttttttttaatgtatgagtgctctgctacttacacatctgtaggtagaccagaagagagtatcagatccctttataggtggttgtgagccaccatgtggttgctgggaattgaactcgggtcctctggagtagctagtgctcttaaacccccggggcggctccccagccccttgcttggattcttacagaagcacctttagtgtaattaattctagcagcggtttcattgatgctttttcctctgagcatttcaaacttagttcacaaatgtaggtgtctgtgctttcagcatctgtcccctgtgagcactaaagtatgttgtatagctatgtgtggacatattacagagtctcaggttttgaacttgaaggtttctgggtgttattttcttgttagaagcaaaatggaggtgtactttgttttgtgctgttacttgagtgtttactgtctttttaaccttaaattgtagagttgaaatcatttgataatgggtatatacattttgaagattttgtgacatggttagttgaagactcttgttgctaacttagatcactggcttgaaggctagctttcatcttgatgaacaattcttggattaggaattactttactaatggaagataagattggctttggacttatcatggtaagccagggtttagctggcattcttagaatcttagcgctccccttgcacattcgcatgtgctcttccaggcggtttgcttttgtagcagctttcttgcatattttgtgtgggttcagagaatggtaggtgtgaggattagaatgttagttgagttgccactcttaattctctgggtctgccctgggagacttctttgttcctttgctatcttagtagctaacctaacccacagatctcctcaaagataattcctaatagagtagttacataattgtttcagtaactactctacttaaatagggttcttccattcagggataattatatacttctgatataacatgcttatgaagatatttgagtttttcatttaggtgaaaataacattgctaagtattttacaaataatctgtgttctattctaaaatgcagctcacatgtttagcaatatgtacttagattttatactgaaatatgaaacaagcaccatagaacattgaaaagaacagggcatggctatccttagcaaaaattttatattgcatatgggagcatacagtactcataagtagcttgtttataatgctctgtgtggtaagtgcgtgctaacacaattcaaatctaatttaacagtggtatcattaagcattgggggaaaggttaggagaacttagctggagtactctaatccactgtctcccctttcagggttacattttaaagacgatttctgtggctgagtggtcattggaagagtaagtccttttcaagagtcctcggagctggtctcacctcggaagcagtggcttgttccaggaagccggttttggcctgagaatttacccagtatgcctaatcagggagaagactgctatttttatttctattctacatgcgccaaagtaagactggcatcactaaatctgtggtttcttaaataacattagctaagatttccctgcattctaaactgtttgtatgttgtcttgttcagctgttatatcacctgccaccagtttttagtaaagaatcatgtgttaaaaacacatcactcattttttccctcttcatttatataattataactttcccatgtgccacaaaaccccaaaatgcccatgttgtatagtcatcattctaccacttgggcctctgtagagcacttgcaagcacgagggttgctggattcagcttctgacactgaaaaagaaaagcaagatttaaaaaacattcaagacttcatcagtatttccatttaatatcagcagtttgtacaatagcaatttgtttctgataataaaagtaactttttttttttaaaaaaaaaaagatgtatttcttttatttatacaagtatactgtagctgtcttcagacataccagaaggcggctatgtggttgttgagacttgaactcaggacctctggaggaggagtcagtgcccttaaccactgagccatctctccaccccagatttatttatttatttatttaatatatgagtacactgtagctgtcctcagacacatcagaagagagcattggatagcattacagatggttgtgagccatcatgtagttgctaggatttaaactcaggacttctagaagagccgtcagtgctcttaactgctgagccatctctctgacccctcccccccaaaagtaactattagtcatatattaattatgcttcatcacttgcagcagcctttcaacttctcttttattttctatcaaaagctggaaaatatgtcaggatctgaagccattttgaagatgctttagaggatattttctttcctgagagtccttgtctttttgagccccttagtcagtcatgtcactcagtagtttgaggaggactgggtatgatggcacacgcctttcgtccccagcactggtgaggcggggacaggtgttctctgagtccaggacctgcctgatttacatagtgagtcctaggcgtaccaagagtgcagtgagaacatgtctcaaaaaacaacagcaaagaagtaggttaaggctggggagatggctcagtcagcgagatttgcatgttccatatccagaatccacattttaaaaagccaggcatgatggatggcatgctgttgttctgggctgtagaggaagatcaatccttgagccctggtcagtcaacctaaatctgcatggggagttccaggccagtgagggaccctgtcaaacaaaccacaagaagcaataggttattctagtacagatgtattgcttcagatggctgttattgctgttactgttagatcttgttttctgccctgcaggtctttgcttactagtgtgtttgttaggttcttggacactgttcttatggacatgtgccacagtcctttcctgttttatttacagggtgacagctgcccattccgtcactgtgaagctgcactaggaaatgaaactgtttgcacactatggcaagaaggtcgttgttttcgacaggtgtgcagatttcgtcacatggaaattgacgtaagtttccaatatttgttactataggtatatagaatcattaaaaaatctgaggacagtggctaatgagggtggggtgattcagtaaaagcaattaactgccaagactggtgggggttgggatgcgtgcgtgctgttgcacacatgtggagatcagagaacaccctgacctgtaggagttagctctggctccacaacctgtgtcctggaacttgtgcttgaattttgttgaataccttaacctgctgaggcctcttgctggcccgtgtttctaagttctaaaacagttaggggggctcgagagatggctcagaggttaagagtacctgctgttcgtttcctagcacccatgtggtagctcacaatcatctaactctacttttttttttttttttttaaagatttatttatttattatatgtaagtacattgtagctgtcttcagacactccagaagagggaatcagatctcgttacagatggttgtaagccaccatgtggttgctgggatttgaactctggaccttcggaagagcagtcgggtgctcttacccactgagccatctcaccagcccctaactctacttttaaggctccgatgccctcctagacttccacggacaccagtcacaaatgtggggtacatatatacattcaagaaaaaacatgcatacatagaaaataaaataaatatttttcttctgacccacttaaggataaattactgccatcttatcttctatttcccattacattgagaatttcctacaaacaaggcattttcctacataacagtagcaaacaatgaaaatttaaaatgggaattggtaacacttttgtcctcatgcaggtttgctgctgtctggtcatatcttatagtgaagggacagtcgcgcttacagatgacgcgtggtgtctgatgttttagtctcacaggacagtgtctgtcatgatagttgtagggcaagtgttctgtaacatgattcaatttatttttacattttcattactaaattacaattgtatatgtctcttttttaattgtatgtgtatgtgttggaatgctctgtaccacataggtaggaccagcagaagtcaggagttggatctcttggagccaagttacagatacttgggagccacggtgtgggtgctgggaactgaacctgggttctctgcaagaacagtgaatgcttttaacctttaggccatctcttcagccccctagatgctatctgtttcatgggacatcacaaaagcaacattcttttcattgtacatagataataaagtggcatacaattgcagttttttcattactgctctaacttttttcacagtgtagttacatttaataaaaaatactatgtgtgtttataagtatgtacatgtatgtgtgcatgtgggggtcagagaaggacttcaccagtcacttgttctaccatgtggaccccatagatagaacttgtcatcaggcttgacagcaggtatcctcaccactgagccatttcactgccccagttttagaagttttttaacactctagatactctagatggcccatttcccaccgaacttgattttttcccctggatctatttgtgttagtgtgaattattggttttctgtttttgcttaatgtattatatccattatattccaatttaacgtttaagaggccttcaagctgacttacttatttactgggggggggggcactccttaccactcctcactttttggtcaatagaggttttccaggccttttaatctttgtaattttcttactcctactctagaatctatctagataaagttgtattggtttctttcagtgaagaaaggtagatagacactatgctttggtctgtccctattgcttttcaagtccttagtagagagagaagtgggagatatataaataagcatgcattgctttgggtcttcatattgaaaggcacaaattcacataggtgctttcagctgatcagtaccagggtactgtagtgtaggtttcttttgttactgttttctcaaaagtgagaaccattcatgccctccctccttcttcctttccactttcccttcccttccctctcccctccatgtaccccgttctaatgttacatgaaggtactgcttcatagtgtcaccgtaactccattgtgaagaccccttcctccttgaactgtaccatcctgctgaggacatctcaccctttgaaggtcctgggctctggtactttgtgctaggccactccctatgtgaggtgcttccttactccagttacttcctgctgggtaccagtttctctcagaggaggacgctgtccttctgtgatgctgccccgcactgtccatgaacacaccctcttcactgcgctggagccccttctgcagcaaagctttcctagattcatcctctcaacccttaggaagccctccctgttacagtgccttcccaacccgttatgggcagcgtcttagaatcttggtgtggaccgctttgtatttctctttcaaatgaatatgcaattccttcagagttgattttcagttcagttgttaccgaggagatgaggaaagaaggaagagggtgcctatgtaacctgtctgcttgggcttatgaagctgctccaatctggttcccagtttcctagttttatacctgctttgtgagttgcctactgtgcaagcagtaaggtgctcattaaattgagattctactctgcgacttttgaaagctcatcttctacctttacatgactcctaggaagaatctaagaataggtctctaaaatatcacatctaggagctatcacaagcgtaaagatacacttcacatgacaggacagaagggtgttggggtctgtggagttgttttgggtctatggagtttatggtagtcttgtttaggcttgcttgttcctgtactctttcccctgaagtggaaggtagcaactcactgcaatggtctcccatggaaagccagttagaaactcaccacgcaccatctgtcttatgtaccaaaatcccagactcagatgttcagcatggaccatatccttggtacaaaaagtctaggcacagtgagtctctcctttcccactctgacctttaacttggaggtactctaagagccatgctctcatgtgccaaccaagcaatatcacattctaatatttgtttgtttttttatttgtttgttttgcacagacttatttccctgtgtctgatgagaactaaatgtttacacgttgttctcattgtgcggagctaaatctatcagagctaccactgcagcagtttgtaaagtactagaaaccatgtagatttgctacctgcacactgtggaggggtgggcatcagttaacactaataatgaatttaaggtggacactaattatttagtaaggagggatcagaatatattaaggggaaatgtagagggaacagaacagcaggctaaaaatagaggagagagcagttagcagtcaagagcacttggtggtggtgcagaggctctagcatccacacagcaactcacaactgtcccagctactgtttcaggaggtcccatgctgctttctggattcttctgaactttgcaggcacaaggctggcacgtggtgcatgtacaattcaagcaaaacacacatacacacacacacacaatacataagcctaaaaaaacccttttaaataaaaatagaagaggggaaagatttgtacttatatttgttgtatgtgtatttaaaaactctctggaagtataaaagagacctttaatcatggttgtcgaggtggagtgagctctaaggactctgttcacaacatatccttacagtcttattttcattactgatggattcagtagtcactaatgtgtctgctcaagaaaatgtgtgtgtaagacgtgttgagagagaaacacaccagttccttgatgtgtgtctccagcggaggtggagcgggtgacaaactgctcccatattatagtcaagtgttcttgattgccagctgcttgcttctgtgctcttggttgatcattttgcttttcaaaattagtagcagaaaaagaagagacactgagaaacagggcaacaagtagtgctaaaatgctagacagggtttctaactagagggaagctgtgctgtgctttaccagtaactgttagtaagccttgttcatgctgagtcctgtagtgctgttggttgtgggtttcatattagtacttaagtaagagtcagtcagtgtctccccccccccccctttaatttgcttgcttgcttgccttttgagatagggtctttctgtgtagccctggctgtcctagaacttagtgtgtagaccaggctaacctcaaactccagagatccaaagtctcccaagtactgagatcaaaagtgtgtaccaacacatcctgatagaaactcatgaaacaagtttatgtatgagtgtatgactggctgatgaagctttgtaggtgcagaggataataggaacctggctgtctgtttcccttagaagcattggtgtagtattcacacattcaggggctagggagatgactcactgggtaaattagcatgtgctgtacaagtaaggagacctgcctttgaatgcccagcacccacataaaaagctgggcatggctgcacttagatacaagcgcagtgttgggagcagagacaggagaatccggggagttgactggctggtcagcccagctgaaatcaacttcagcttcagtgagagatcctatctcaagttgtagtaaggtagagagcagtagaagctacctcatggcctgttctggcctccatgcaaatacctgcacgtgtacacattcagttcacattttgtagcaaaggaaaatgagacaggccagacatttggttgtctgtgctcataaggtccttgagtaaagttactgtaatatcttactccatagtctaaactgctatattatcctgcttttcttcaacaaataagggcatttagggctttcaggatgaagaccaggaaggaagaagagctccttctacctctccatacgcctaaacatcacagtcagcagcctctcttgctaaacatgacctcctgtgtcagagtttagaacttcgtttagaaaatcaatcataaaattaatttaggacttacttcgctttttatttgaaaacaatgtgttcttttttacagaaaaaacgaagtgaaattccttgttattgggaaaatcagccagtgggatgtcaaaaactaaactgcgctttccatcacaccagaagccgctatgttgatggactcttcctacctccaagcaaaagtgagattggttttgattgtaaaagagcagttgctattcagtgagcaccttctgttcacacctctgttagtccagtgggagccatactctttctagtatatgatgaggaaacaaaaccttagagaggttaggtgataagtatgcacagagaggaccaaatgtttgtcatgtcacattatattactatagttacttttatttttattttcttactaaaccttttagatgtttttaaaagaaatctaattctccagaccagaggttggcaaattgggtcctctgcctgttctgtaaaatgaagatttactgaatacataccttctgtggctggtttagggttaatagtgcagagtgaactagttgagatagagaccatttgacgtacaaagccaacagcaccagccatctagcccctttgtggagacggggtatgcgctgtagcctgaactggctgagaacttgggatcttcctgctttggtttcctgagtctgggatggttatggttattcaccatggcacctcatggaccgacgagtccagcatgttataagcttgctaaaataaacaattcttaacgaaggcctcctaaaaaaatgtttgtcctgttgttccagggctgaggatcaagcccaggatctcaagcatgctacacaagccctctaccactctgctatagccccagacttaaatcagtcttacctccacggaaatctgtggcttattttcaaagtcccttttaagataatttttatttataatagtggaaggtggctgtgattttagctctcagaaggctaaggcaggaggaatataagtgtgggggccagcctgggttacatagcaaaactaactctctctctctctctctctctnnnnnnnnnnnnnnnnnnnntcataaaggacagggtgtttgttgagcaggggattatagttctgtcttctaaatttatgtctcgttttgtgtgtttagctgtgttacccactgtgcctgagtcacaagaagaagaagtaaagactagccagctcacagttcaacagagcaaattgtctgttcagtctaacccctcccctcagctgcggagtgtaatgaaagtagagagctcagaaaacgttccccagcccccacacatccgcctgttgtaatcaacgctgcagatgatgatgaagatgacgatggtatgttttagctgtaatgaactagacaggaaaaagttaaagctctggacttgttcttattggaagtttgccttccatgtgtgcatgcagatcagttttctgaggagggtgatgaaagcaagacacctgccctgcagccatctcctgacgtccataatggattacgagtggcttctgcccgcaaacctggagtcagtttaaagcaaggtaggaagaggctgtcggatttccagccctagaagtatccctgactgttgtaactccattgacatttagtgcacagccactaagctttagcagatatgctatgctcgtagaatgtgtactttctcgtaagtcatttactcaaagcatacttgaatgagtgcagcaaagtacaaagaaaatggctatagttcctcatgtgcttctccttgggtttctcaggtgaatgtttgaattttggaataaagactcttgaggaaattaaatcaaagaaaatgaaggaaaaatccaagaagcaaggtggtaagtcatcccaggctttggcttgagtacttgcatgtttaccagactcgaatagtaaagagacttctggcaacaagagccaaattcggcaaatacagactcatttctgtggcttgtttgccgtgaaacacagctactggagctctttccatcctcgatgttcagagctgagtctatataacaatttaaaaacctgcttatcttcaaagtgattgatggtgtttttgaaacgttttttctgtgtagccctggctgtcctagaacttactatgtacaccaggctggccttgtgctcatagagatccacctacctctgcttcctgagtgctgggattaaaggcatatgctgccatgctgggttaatatcttgacttatttaactgtaaagaactacagttaagagccgtcttaaggagccagtagagtaaagggcctgctacacaagcctgagaatctgtgttctggcttagaaagaaacccacacagaaagccaggcatggtgatgtgtgctggtaatcctgcttctctgggcaggaggattgctgggtttgctgaccagcctagtctaagcagaccttaggtccttgtaagatatgatctcccgaggaatgaggagagatggcagaatggcagaattgtcctcttccttccatatgtaaacagaacctactaaaagaacatgtatgccattgggtacaagagggttcttaagatctacaaagagttttttgctggcgcttacttgtctcaacccagttaatgtatttcctactctaaggtaataaagagatgtacactaactagagtaaatagttggatctgaggagcctgttcttaaagcttactctgtaggaaccttgttttgaggatgataatattcaagtgggagcacaggcattgccaaggctgatggctaaccatgcttctgccttcacctttactgttagcctcacaggaaagcagaaggctgagtgtttacctaagggaggcagcagtcagtctcatagaggcagactcttgacgtggactagccttccttcccacaggttatttatttgtctgttttcattcagaaggctcctcgggagtttccagtgttttacagcagcctcagcccaatccaggccctgagaaggagaatgttcggactgtggtgaggatggtgactctatccagcaaaccaggtaagcaggaggcaggtctcagaggtgtggccttgggtgtggccttgggtgatgcttttgattactttggagttttaggaggacttgaaacattttgatcagatatgaggttgaaaaattgatacatttgacctgttgttttttaaagagttggaatttttagtcaggtagtctcacatttttatgcatctaatttaacattttctctttgcttcagcaagtttactgttcattttgactaaagaatgttcttacatttttagaatgatagagaaatgtatatctttttactaaattgcttaaaatctaataaattgtcttagttttggttattattgctatgaccaaacaccatgaccaaagcaacttggggatgaatgagtttgatatgcttgcacatcactgctcatcatcaaaggaagtcaggacaggaactcaaacagggcagaaacctggaggcaggagctgatgcagaggccttgtaggagtgctgcttatcggcttgttccttgtggcttgctcagcctgctttcttatagaatctgggaccaccagtccaggaatggcaccatccatagtaggctgggccttcccacatcaatctctgattaagaagaagccttacagtggtggttctcaaccttcctaatgctgaaaccgtttaatacagttcctcatggtgtagtgaccccccccagccataaaattaattttcattagtacttcatacataactctagttttgctactgttatgaatcataatgtaaatatctgatatgacccctgtgaaatgctcactagaccccaccactgccaccaagggaggggttgcaacccacaggttgagaactgttgccctacaggcttgccttcagcctggtcttatggagacattttgttaattgaggcttctccctctccagtgactttagcttgtgtcacatcgacttaaaaatatctagcacaataatataacacaaaagaaattgtacatttaaatgttccatttgaacaacaaacatttggaagaaggcttatgctttctagtgataatgttagataacttttcaaggtacacaggatagtttggctaagaccaaagcctctttccttatgtttggctgctgttaaaatgtcctgctgttgcatgtttactagactactgatgattgtcttgttaaataagactatgacctgactttcagaataactccttagtgggctcataggaatataaagtaatgtcctcaatcaggtaacagtggaaaccctttatttctgccatttcagaagagcccttggttagactgagtctttctgagagactggggaaacgaaaactttcagtgggtgagttagatcttgtgtcgttctgtctatgtgttcgtgcattagcatgctaccttgttgagactcttgtaagcaccatcagtaccgacatgctagtctgtctgcttgtattcttaactaacaacatttgtaaaatttcatgtgtgtgttacacctttcattgaagctacaacagtttaaagtattatgccttaattagattataactaaccttttttattgtaagcctgtgaatggccaagccatgtccaggccgtggctaaccttttagaaggtcctagatttaataattacaggcttgagccagctatggtggcatgcatgtacctttaatctcagcactcgggaggtggaagcaagaggttctttgtgtgttcaagaccagcctggtatttataattcaaaactgcatagagagaccctagtctccaaaaacaaacaaacaaacaaacaaacaaacaaagaacaaataacaaaaaccagttttttattttgtttttatggttttcctaatggttccctatccattactccttcccttttggctaacaaatacagaaaggctgatagtattatagtcagacaacagtctgcattaaacttaatggatcatagaaacaaaagaatcagaacctaggctggagagatggctcagcagttaagaacatggactgctcttcagaggtcctgagttcaattcccagcaaccacttggtggctcacaaccatctgtaaggggatctgatgccctcttctggtgtgtctgaagacagctacagtatactcatgcataaaataaatgaatgttttaaaaaaaaagaataagaaccttagatattttcagttggttagtggagtcctcctccctcctcttcttcttccttctccttccttttatctttcctctcccttcttctactttctctttttaaggcaggatttgatcatttaaccgccatcaccaagtttatttagtggtggatattgaacataaggctctgagagccacagctctaaccannnnnnnnnnnnnnnnnnnnnnnnnnnnnnnnnnnnnnnnnnnnnnnnnnnnnnnnnnnnnnnnnnnnnnnnnnnnntttttttttttttttttttttttttgagacagggtttctctgtgtagccctggctgtcctggaactcactctgtagaccaggctggcctcgaactcagaaatccgcctgcctctgcctcccgagtgctgggattaaaggcgtgcgccaccactgcccggctcttcagagtcttcttaccccaggaaaaattagcactataaattctttactatcttcctaactgaatttactatgaattcagagtttgttggtgttttagttagggtttctattgctgtgatgagacatcataaccaaacagttggaaaggaaagaatttattcatcttacacttccacatcactgttcttcatcgaaggaagttagggcagggacctggaggcaggagctgacgcagagaccatggaggggtgctgcttactgtcttgctcctcatgactaggtcagcctgcttataggacccggggctatcagcccagggatggcactacccgcagtggactgggtccttcctcatcaattagaatttaagaaaattcccttcagcttgatttatggaggcattttctcagatgtggttcctttctttcggataattctagcttgtgtcaagttgacttaacaccatccacacagtcaaaaggacattgctgtctttgagctttagcttcatcccaggcttatgagtcagtgtgtaagtttagtaattgttttttttttttttttttttcaaaattcattcatggtcttgttttgttttgtatactaatttttttctttctgggacattttggttttaacattaagttctaggaagcaggtgggcaaacatcatttaaatgtagaaaactttcagtggttttttttttttgttgttgttgttcatttgtttttttgtttttgtttttggagacagggtttttctgcatagacttggctgtccagagaccagatctcagaactcagagatctgtctgcctctggcccacaagtgctggggttaaaggcatgcaccactgcggcctatccgagaatattttaaattgtctatttttgttttttactttgttgaagatcaaatcttaaaatgagtttctccctatttgtaggtggtgatagtgaccctccattaaagcgaagccttgcacagaggctgggaaaaaaagtggaatcgccagaaactaacattgataaagcaccaaagaaaggtaaggcctttgcttcttacagacatggcctgcctgtttgtagtcataacaggtatggtccccgtttttcgctcaggtgaacgtttactctacttgattctaaattgctaacatttaataaaactaacagttatcaacaaccactggagttcataggttcccgcatgatactgggaaaatgcatggtctcatgggagcactctaaatcaggaattggctagctgaagttagaagtccagtgtttgctagttttaagtcaacttgacacgatctagagttgttttgaaaaggctcaattgagacagatatcatccccaccaaattggcccatgggcgagaaagtggtacttttttttaattgatgatttagttgggaaggcccagaccattgtgagtggtgccaccccagagctggtggtgatacctgatagtgtaagagagcaggtcgaacatgccatgggggtcaagccaggaaatggcactcctcctgggtctctgcatcagctcctgcctccacgttcctgtccccacttccctcagcagtggagggacctgagagttgtaaactggaataaacccttccctccccaagttgttgatggtcatagtgtttgatcacacgagtagaaactaactaaaacaaccagggtttgtattaaagaagacttctgcagagtcagagagccaaggaagcatatcacactccaggatcagagggcggctaaagcatggaattgggaaaggactaatctgttatataagagttagaagagcttgagcttattctagttcagtgacaaactaaatgttattttacagttaccgcaagctggtaagttggctcagctggtaaaagcacttgccacagtctggtgaatgacccgtgtttaatccatacagtgacagtgggggagagaactgacgccaaaggtgtcctctgactcacacaggccttagtgaggcacatgtgcctgtacacacacacacacacacacacacacacacacacacacacacacacacacgtaactaaattaaatgtcagaaaggcctgggtatagtgccacatgcccttaaatcctagcactcacacagaggcaagtgactttctgtgagttggaagccagcttagtctacatagtgagttccaggactgtcagggctatgtagagagaccctgtctcaagtaaacaaaaaacaaaccaaagaattctaagggaaaaaatttttaaaaagggatcaaatggtctgatttgcacttgtatttgcttgtattattgagaaacagtagaagggaaagtgctagctggaatatgacctataaaataacccaaatagggctgcagagatttctcagtggttgagaacacccacttcagacagcacaaagctactgtaactttagcttccagggatctgatgccctcttctggcctctgcaggcacatgtacatacatgatatagacatagaaataaataaaaataaaccttgaaaagatgtaaaatagttcaagtaaatggacatagtggtatagatgagtgtttaaattggggtatttaaggttttacagtgctgtctaaaggcgagacgtcctaggcagatctttcccccactttatgacttaggtgaactgttaatgcccgagagagaagcagatggaggtttttggttttgttttcttgtgtgtagatgttgaggttcaggaactgccgcaaaccatagaatcactgatctcagttaagcaagaatagtttattgaatgtatatcctaatactgatcgatcaggaccacgaaaggagttgtactaatctgtcctccaagtagactttttatatgaaaagccaggttcaaagttttaaagacaagcagtgaagtagtacaatattttaggctaactagacagtgtattatcagccaacttttaagcagattggtcttaagtgaggtaagaggggtgggggatgggtggtgaacaggggaatttaagaccgttgagaaagtagagcataagtaattcagctagaactttgggcttgttagcagctttcctcagggtcagctgtggatgatcacttctgggaagtggagtctggagaacctgaacttcatttcaccatttgagtaaaaggagcttgaatacagaatggctccgttatgttaaaaagagcaggcctccacatgccccccttgagcttattccttagagtcaaatcattgactcttaatttttttctaagaccagtggggaccaacttttatatcagtctttgttggcattttgttattctgacaggtcttgatcagtttgttgacttgagtatttgaaattttgatctcccttaataagtgctgctactcccgtgctggcagaccctgttgtgcccatgtctgttaggaggggcactgttggagctgccctggccgtccgggatcagtgtagatgtcccgggtgttcccacactcagctctctctctagaattatagtttacctcaggcaagggaacaggtaagcgaaggtttcagtgaggataaagggactgataacagagaggcaaaagcaagccaggtgtcctttgaaggtactaaataatatgaggaaattttgcagttaacacctgtagatgaattgttacattacagtgttgaaggtactgagactctgatatcttattcgagcctgcctatatacagatggcttgtctttcaatctctctcagagtcaaggtgggcttatgcccccaagggcatagttggtctatttgtgtacccattttccccatagttaggttttatataaggggggaggaagaactcttggggtagggggagagatgaccaggtttggggagaggcctgtcagccatgtggcagaaacagattgctgaatggttagctcttcctttgaagttgtgttttctaacactttgttgggagcagtgatgtctaagaccctgatattgattgtctggaacctccggatggtgaccatcattccagggttcttaccagatgtgtaaaggcggggtccccaaatcttctcagcatcgcatacatcctcccaggcctcaacagtagagcttctagaaaagtaaacttttctacttctagctcatgaaactttggttaagtaaatgtttccagttggtggcttgtgtgctccaggcaagcagaagttctttgtccggtttccatcgtgtgtcagttacacatcatagctcagcagtgtgctgagcacttgcctaggacgtgtgaggtcctgaggaaaatctacagagcctttacctaatacccatgtctcaattaaattggcagtgtgtgaaagcagtccatgatgtctgaaagagacatgctgtcaccactgcagcccaggggtggccaggctgattggctagttaagcagctgtcctttcctccttcacctctccatgtacatccacatgaagcctcacactgggttaagagctgagctcccctagtgccgcctccaagcagaaaggcttagagcagaggttttgaagtcaaaagattgagaaggagcctgctctttaatgctagttcttagaagattgagactgggagctgaaggctaacctggtctacatagcaagttccaggccagctaaggctacatagtaagaccttgtctcaaagaacaaataaaaagattgagaaaattgtacaatagtaataagtttctgaattcagtaatctttgtacatgtagtcatgcatgcgtgcatgcatgcgtgtgcacaggcacagcatttgcgtggtggtcggagacagctgtgtgagcttggttctctcctcctgacatgggttctgggtcatacttagattgtgaggctttgcccactaaaccaccccactgctctaaagggttgtccctcccccccttttggagtctggaatgttctgaggagcgtataattcatataaattatttctaaggagaaacatttaagaacttgaaggtgttggtttggttgattggctgattggttagtttggttttgtgtatccgtggctgtcctaataaaacttgagctgtatactaggctggcctctggtgagactaagagtgcagtaaggccaccgctgcctgttgagattttttttttctttaattgcattagaagtacagtctaatttataaacattgaaaaggtatttgacctataaaaatgtgttttagctttttaaattttgaaacttttaatagttgaagtttccaaatctctgaaggagtgtgtaggcctgtctgctagcttagtcagggaggaggcaacaggttcttaaacagtcagaagagcaaactccttgccttcttgctgtcacaagagacagctatatcagggtcctttcagcaaaatcttgctagtgtatgcaatggggtcagcgtttggaagctgattataggatggatccccggatatggcagtttctagatgtccatcctcctgatactcttaaaaacaaaagtattttaggctttgtggtccataatctaagtggcagctactaagctctgcatttgtggtgtgaaggcaaccatatgtgagtgtgtaaatgagtgagtgtgtaaatgagtgagtggctgtgtttcaaggaaacagctcacagaagtaggttacagctggatcgggcttgtgggcccgcgcttgcttacactgttttaaatggttggttgactttttgcatcacttacactttcaaatgaatttattttgactcttgtcttcagaggagttttgttctggtcttctgcttttttttccctacagcttaattttttgtaggctgctgtggagttttctaatgaatgtattttgtttgcttgcttgcttgcttagttttgtttctctatttggttttgagatgctggaaatcaagccagggcctgtgtatgctatgccatgcaagtagtcttccagggaggggtgtcctctgcccagtccttaaatatctgccttagagatttctctatgggtcatttttgcttttggtgtttattaacccaggccttgctgttagctctgctgctgagtagaagagtgtttaaccagtcttctagagtgtttaactagtcttctagagtgtttaaccagtcttctagagttagagctacaatgtttacacttgatctactgcaatagattcctctcagaaatgctctaagattgctctaccatggcattattcatttttcattgctagtgtagattaattctagttttaatcaatgtctttatcatttcaatggtttttggtaggaatgagaaacaagtctcccatttcactattgaccatttactttttttgagtgataattttgagattagattgtcattgtgaactgaaagaaaaaaattacaattaatttttttctcagatttatttattttatatgtatgaattgcttttttgtgtgcaggtgcatcacatgtatgcctggtgtatgtagaggtcagagtaggttgttagatactctagaactggagttactgggtggttttgagccaccatgtgggtgctaggaactgaatctgactgtctgcaagagtaacaagtgttcttaaccactgagccatctctccaactctacaatcatttgaaatgagaatgagaatgcgggtatggtagcctcctcacaatctcagtactcataaaggccgagacaagagaactggtgaggttgaggctcccatactccagcaaagatcctaccacagaagacctagccagtcgaagcctgattcttgctttgtcatgagtactttactaaaatatttcaaggatccaaatagcatcaactgttttcaaaaagcagatagtatgtttggagcattaggcagttacaggactctgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactcactggcctttgtcaggctgtataccacccttggcagaagtatgcttgcctaagtgccctgtgcacattttatacacacacgttatgagtgaatggagagctcattgttactttcacttaggatcataatggcgcaggtttcctcactggtaagtgatttttcagccattggcattgtagaaatacaaatctctaggtttgtttcgataagagtttttcttacagttacctacaactgaggatgatggaacatttgatgttcctttggattttttacttgtctgtggagagatcatagatcattaagataatgagagcttaaatatctgtcttccctgaaacagagcgaggtcataaagctggggagatccatgtgaagacactggaagaaattcttcttgaaagagccagtcagaaacgtggagaattgcaaaccaaactgaaggcagaagaaccttcaggagccgatgattctccatcagggacaaaaagttcttcttcagtgcggatcaaaaccttctctgaggtcctggctgaaaagaaacaccggcagcaggaaatggaaagacagaaatccaaaaaggatacaagttgcctcacgctaacagacgacactgaaatgaaaaagacagtgagtctgcccactgttgctgttagcaaaggacaaccagaggagcctgcaggaagagccaggtctatgcaggaggtgcatattaagacgctagaggaaattaagctggagaaggccctgagggtgcagcaaagctctgagagtagtggcaactcccgacctcaagctgaggctgccccagggacaaagaggctgctccgcatcaccaagagagcaggtttgtatagcccctccaaactgtgtcaccgttccagcacagggcagcacctacaggagcctggggaggtctttgagggcttttcattactgggggaactggagtcaccggattcagtagagtaaggtgttgacactatggcggtctgtagttcaacactgtattcctgtaatcttgagattttatggagccagtctcttagctatgaagtttttttccttgtttcttttcattactgtcttagtttcctttctgtgtttttttttttttttttttaaagatttatttatttattatatgtaagtacactgtagctgtcttcagacacaccagaagagggcgtcagatctcgttacggatggttgtgagccaccatgtggttgctgggatttgaactccggacctttggaagagcagtcgggtgctcttacccactgagccacctcaccagcccccctttctgtggtttgatacaacactgatcaaagccagcccgagttggggagtattatatggtttacacttccacatcacaagtgcattcttgaggaagcaaggcaggaactgaagagagcacctgaggcatggtgcttactggtctgctctccgcggcttgctcagtctgtctttttatatagccaagcaccacctgcccaggggtggcactacccaaggtgggctggacactctacgtcaattaccaatcaagaaaatgccccacaggctagtctgtggtttcttagcttcagttccctcttcctagatgaccagccaatgctaaattgacagaaaagctagccaataaaattgtattcgttaagaaaggttttgttgagccgggcatggtggcaggcagatttctgagtttgaggccagcctggctacaaaaagtgagttccaggacagccagggctacacagagaaaccctgtctcgaaaaaccgagagagagagagagagagagagagagagagagagagagagagagagagagagagagagagaggttttagttcagttcatttttccagagcctgcggctttattaaagcaatggtgttttttttaatatgaatacaggtgtaaaagaagagaaaaaatgtggccttgaagacagtggtgaccctcctcagagcagtgtgactaagatggaggctaatgaggtaagtttgttaccttatgtcctaggcagacctcatcgggtgagtgtgcttttagtttagcttatagcgaatttctgtcagtaattccagtggtacattgattgtggttttaattgctttggttcatgcttttgttgtttggttttgggttttttgtttggctggtttgtttttgagatttttggagacaatttctcactatgtatctcaatctgcctggctcagcgagtctcattccttaatgctagattacaacccaggactgtggttaaaattttctgtgaaatttgtattttttgtttggtttggagtcatttttgttgttgttttttgttttttgagatagggtctttgtggccctggctgtcctggaactcactatgtagacctgactggtttctgactcaacacagatttgcctgactctgcctcctgatttctgggattaaaattgtgtaccaccgtacctgtgggagattctcacagttccctgttagttttctttgttcttacagttactttatctgtgtgtgagctggcatgcctggattctttgcaagagcagcaggtgtcttaaccactgagccatctgttaataggagtgactctaaccctcaggcagatgggagctggacagttggtcattttgcagcctgctgcagctttagtaattacttaaggtgtttgtttttactgactataaatattctaatttgtaaatataagctctttttagacatcagatttttttcacagttgtaaataatatcttggcataaaccttagtgtataggcatcttaattatttagtagtcaagtcattagtgtttactgagggttgtagttaaagcctatagaatctgggttttttttaaattaatttcatacattttcagttctattatagagcatatcttctgtgtgttagcaaatagtgagcctcctctttatgctgaatcatgtaatactctacctaacttactcagcactataaatgggagtgtacattttcattctttgattgaacttgtccacagacttcagatgagaccataagtgatcccacaaaacttgcagtcaacagatgtgacactgtcaaagagaaacacacacagagactgcaggagagaggagcatcacaaaaggagaaagcagccttgtcatctgtgcgaggagatgaggcttcttcttatacccgagtggcggggaagccggtgctcactgctgtatcaggcgtcactcggcatctggcaaaacggctccccgtggagtcatcccagaaaggggaggtagaaacctccggaatcggggactcaatactgaatgtgaaatgcgcagcacagactttggagaagaggagtaaaggtgagtggcttgataccgtcatcgtagcacagtgagcggatttcagtaactctggcagcagcagaactgagtctcgtgtatactgaggtcacaccaacaggtactaatacagtgatgagctgcaaatgtgaaatgtaggcagagttcttcttcacaacctaaaattgctgtcttctgccttacatgggctggagatgtagctcagttggtaaagtacttgtctagccagcacaaagcctgggtttcattacagcatataatcccagcccagttgtattagggttgtctagaggaacagaaccagtattgtgaatgtagacagaggaggagctattggattggcttacctgatacagtctgggtggtccaacagtgatctctcacaccggacacaccaacctctgttgaatgcctcagtcctaaccatgtttcagccagccaacatatgatgagggtttaagtttgagttttggccacttgagtcctgtggctggtggaagattctctttcaggatggacttggaactctgg

SEQ ID NO: 1742 - DNA, 1256 bp, Mus musculus
attttagatttggggatattccctgcccaaaaaattcctggaaaattgactagtattaagtgcgtaatagcttggaactgagtgaagacacagatgttcctgttgagagcaaccagctaatggttacattttaaagacgatttctgtggctgagtggtcattggaagagtaagtccttttcaagagtcctcggagctggtctcacctcggaagcagtggcttgttccaggaagccggttttggcctgagaatttacccagtatgcctaatcagggagaagactgctatttttatttctattctacatgcgccaaagtctttgcttactagtgtgtttgttaggttcttggacactgttcttatggacatgtgccacagtcctttcctgttttatttacagggtgacagctgcccattccgtcactgtgaagctgcactaggaaatgaaactgtttgcacactatggcaagaaggtcgttgttttcgacaggtgtgcagatttcgtcacatggaaattgacaaaaaacgaagtgaaattccttgttattgggaaaatcagccagtgggatgtcaaaaactaaactgcgctttccatcacaccagaagccgctatgttgatggactcttcctacctccaagcaaaactgtgttacccactgtgcctgagtcacaagaagaagaagtaaagactagccagctcacagttcaacagagcaaatctgcggagtgtaatgaaagtagagagctcagaaaacgttccccagcccccacacatccgcctgttgtaatcaacgctgcagatgatgatgaagatgacgatgatcagttttctgaggagggtgatgaaagcaagacacctgccctgcagccatctcctgacgtccataatggattacgagtggcttctgcccgcaaacctggagtcagtttaaagcaaggtgaatgtttgaattttggaataaagactcttgaggaaattaaatcaaagaaaatgaaggaaaaatccaagaagcaaggtggttatttatttgtctgttttcattcagaaggctcctcgggagtttccagtgttttacagcagcctcagcccaatccaggccctgagaaggagaatgttcggactgtggtgaggatggtgactctatccagcaaaccaggtggtgatagtgaccctccattaaagcgaagccttgcacagaggctgggaaaaaaagtggaatcgccagaaactaacattgataaagcaccaaagaaag

SEQ ID NO: 1743 - protein, 362 aa, Mus musculus
  VARIANT (1)...(362): Xaa = Any Amino Acid
VLFKSPRSWSHLGSSGLFQEAGFGLRIYPVCLIREKTAIFISILHAPKSLLTSVFVRFLDTVLMDMCHSPFLFYLQGDSCPFRHCEAALGNETVCTLWQEGRCFRQVCRFRHMEIDKKRSEIPCYWENQPVGCQKLNCAFHHTRSRYVDGLFLPPSKTVLPTVPESQEEEVKTSQLTVQQSKSAECNESRELRKRSPAPTHPPVVINAADDDEDDDDQFSEEGDESKTPALQPSPDVHNGLRVASARKPGVSLKQGECLNFGIKTLEEIKSKKMKEKSKKQGGYLFVCFHSEGSSGVSSVLQQPQPNPGPEKENVRTVVRMVTLSSKPGGDSDPPLKRSLAQRLGKKVESPETNIDKAPKKX

SEQ ID NO: 1744 - DNA, 53885 bp, Homo sapiens
  misc_feature (1)...(53885): n = A,T,C or G
ttccatccactttttctgttggaattgcactgtatatatctgcatctaatgccttgtgacttacagtttcagttgccaaaactttaaatggcttaaaaaaagagagagagaaaaccggtttaagatagatagcctctatgtctttgcacacatgctcacctgaaatcttcttaatttcattagttttaaggaatgatctccagttcatctttcagaatgatttaaaaatatttattctgtgaagttccgaattgtttgctcccttctgtactatcacagcaacacctgattttctacacaattctgtagttatttacgtttctttatccacctttgttctttgcaatgctgcatccctagcaaaggcattcagtatatttaatcatatacctgcaattatttactaaatgcctaagattaagcattgtcttcagcactggaaatacagaggtgaacaaaaaagtacctgccttgggtgaaacttgcattttaatgagggagacaaaagaagcacaatgcataatataatgttagctatgacaagcaagtgctaaaaacaaatgggtaaaggaaagagggatgaggtgctattttggatacggtggaaagggaaactttgaggaggcaacctttaaccaaatttgaagcaaaggaataccatgtaaatatctgaggaaaaaaacaaaaggtaaggtttcttgatgtgtctgaagaatgcaaggcagacattgagtctggatctgcgtgaagtaaaactagattgtatgcttaattaacttaaacttcataagtgcttctggtagttcaatacaagtatctttcaattgtaattttcagttttcccaagagtcaatctactcttcagtacatgagactttccccctgttttataagcacaaacatttttgtgatttacaaaacttgttttttaattaagacttggttcataaggagtcttagcaaggatgtggtaatgtactcctgtctcaggtcacattctcagggagcaggcaaaagagacggaagatagttcatactttgtttttgccttttttaacctttttttccttgcaaagctaatagatgctcattatagaaaatttgtaaatgaaatatacaaaggcataaatgaatcacccacgtcatcacccttcagatgtatcacaaagaacgttttggcatacttcttgtctctttttcagtgcatttttctcaatataattgacatcagtttctatttgctaccaagaagtttctttaagagccaaaatcaaatggtttctggatttacttttttcatgtttttcctcctcaactgcatgataaacaagtgctattataagcacaggctgaaaaactaatgatcttcatccttttcatgaagcaattatcattagtataccttcattgtcacagagcttgcatctctgtctaaacataacagatcacagactttaaaagcatcttaattttcagaactattctatccttgattcagttttatatcctaaaaatcttcagatgtatcatcataaagttcaacaaatactcttaggaaaatatattatctgcctgaaaggaaagttcaccccgatggtttcctaccattaatagtgatttatattagacatgacagtactacaaacttaaatttctgagctgtatcagctatggtttatttacttaaaaaatgttcaagatggcaaaagaaaaattgcctctataaaacaaatctcttgactcttgagttaggcttcactttgacaacagttttcttcacagttacctgacatccccatgtagtctgatgaattgtttactttgaaagttgtatttaggagtctatgttgatctaaaaatctttgtggtaactcattcaacaaagcttgagcatctagtttgtgaacggccttgtcctagactatgcaggcagaatataaaaaaaggagtaaaacccgctggcatcacctcttagacgagacctcatattagcactcctgtaaatacagccccactgatagcacaagctggcccactatgccatcttagagatgttataccgtatacttcagaaccattttagttctatgtctttgcaccatgagtactcaagatttgaagttgattttgtttttttcatgtttttcccctaacaattttcaccgttaaaactagtaagaatcacttgccttttgtttttcctttgagtttgtttgctttgagagtactcactttttgtccctttcagctttatcagtagtcagctgtttacatatttaatttatggtttttctactgtcaggaagaagaagggcaccaaggatgaggaaaaggcagtttcttgggttcctactaactttttatctataatttattttcatttctgaaaaagacttatgccacttctatagtctgtatctgaagtagcatcatcttacaaagtgaaacaacactgtacaatataaacatactgctgtgtgtgagcttaagacttatgcactattgcaaacaggtaaactaagaaattagccccttctagtactgattcaatacttttaaaatataatcgtctagtagggattcagtactttaaaaatacaactggttttcactaacttatgatgctggtttcaaaggatatcaatttaacccagggtggtagagccacagggtctggtccaatagcagtgtgtgtgtatctaaatttatcaaagatcctatgtgggggggaagattactctgccccatggagctcctgatgagtataaacattccttccataaaaatcaatcatctgctctttgctatcgacatatccaaaggacaacacgagacactgaggggtacacaaagttctccttctccacctgtcataaaaggctttagactattaccggaaaaacaaggtacgtgtattaaaatagtgaatatcaattgagtggccctctacaatttctgggtaggggaaatcactgaaatggctaaattgataagattttatggagaagaactgacttgaaaaattaaaaacactctagaggtgatccagagtgaacagtctgagcaaaaatatgagacaggattgtggttgatatgttcacaggatgaaatagatggttaaaacagaatccactttaaggacgatggaaggtagattgagcctcattagtgggaggccctgaattataattaagaatgtggatgctatgctataaacgatactgtaagctgttcttaactgcagagaggtaagagaaggggctgcttattttccctggtggagaatactttcacaaactactcccctcaaacatacgaagttgaaaatcacagtagagtgaaatactaaaacagatgataatgtttcatatggattacatttgttacagctaaaaaaaaaagccaattactgctacaaacattgagtaataactgtggtattctgacgaggaaagaacatggtgatgatcagtctgagtggcaagtaagaccagttaggtggtgcaatgagcaggacatgaaatattaactgtaacagctgtgacagcaatagaaagcaggaaaagatcagatgctataaggtaaaaagcatcaaggtgaatggaaaactggcatgaaatgattccagggttcattctttaattcaacaaatatttatccagtgcctaccacgtgccaggtcctagaagctgggactaaagataacagggcaatctttgccttaaacaagttttagtccagaagacgagaaagccagtgccaatgatgaaactcaagtgaggtggatttccaatggacatgttggttttgtttgaaatcagcaaagttgggaagcacccaactaatcactggggattctactgatcaaagactacaacgttttatagtacaatatgaaaaaattacccaaatataggttactcactagcatttaccgagggcacactatggaaaacacgttgctgcaacagaaaaccttgagaacaccaaagttagaataaattaagtaattactggtaatatgaggtgtgaacttcagtgacctaattaggctactgtcaacaccgccactggttcggacagaacaggtaaagcaagtcttctaatatccaccctttcttactgcactcttgaaaagtagtaaagcttggactgtggcaattacctgattagggggtttccccaaaaggtgctgacctgaaaaggaagggacatgctgtggatgtgagttatccatttccttgcgaggacaagtttgaatctcctgataaggaaaattctttcgcaaattccctccctcacaactaagaaaagtacaagaacctggagctcagggcgtacggaactcccaccccagacctccccagggaaacctacagaggttcctggcctgcagggcagttctaaagcgcccagccgccctcgccgggttcgcactgagccagcgccgcggggaggagcccacgcgggccgccaagcctgcccggcgctcctccgtacctgatgctcccttttggaggaaggctcctctttcacctccgtcacaaacacacacggcattttccgctgcacggagcccaagcgcttcatgatgagcccaacaagcagtgcgaatggagggcgtgctttcgagcggcgcccggtccagtcgcggagaagccctgaagcagtcacccgcacggctcaggccacgcacactccgcgcccagccaccgcggctgcgccccaactaccaagcccagcgaggggcgggaacgcccgtccagaagcggcttcctggccgcggcgccttctgggagttgtagtgcagaagctgaggcgcctggtgggttcccacgtgcgtcctccgccccccaccctcggttttaataaccgtgaaaaaaaaaaaaaaaagatgcgtttcccgaacgtgggtacttagcaatacctagtaactaatgattttttgggaaattaaataagatcaaattataagcaatgaacatttcagatgtcgatttaacacagttccaatggaaactgcttgcctgttatctttagttcgtgggggaagcactgtagaagtttagaaatggctagagacatccccagattcccaagcagaatgaaaacttcctttccggtaagactatcagaaaaccctataataaaacacctgggatcaaaaaaagttgtcgtttgaactactccttattgtgcagcatagcatggtcgaaatgattctgatgttcttttcggagtgagtgcgaaatttcagccttagactaatccaaaagtacaggaatacctacaaccagatttcattctcaagtttttcataagaatcttgtttaattaaaggtgagctccaacagcccaaatggcttgagtaatggtagtcaatcaactgcgagctaaaaacagccttaacttactgctcaaaagaatattttgagggtaagtgataagatggacaatgactaaataaaataaatactaaatatttaggaatagtagcctttccatctcattgaatgtagtagttcctagcctgaagttgtaggggaattttgactttactgccatcctttatgggcttggactaggcccaggtctcatttctttgtcttatctgcatgtactcaactgtccagcatgttactgacttagcccttggaaaaattaaacaactatatctcacttagaggtatctaactagtaagggggttctcaaagaataaaacatcttcctttaaaaagttcacagttatattgaatactgacagtgaaaaaaaataaaatttaaaaaaagttcacagttttttgattactggattcagaggggagggaggaagaaagagatttgccatttcaaagtgtttactttcttttctactatctttttctcacaggaaaacacaaaatgttctcccacatcacaccccgcctgcatttatcaaaaaagaaaacacctgatgctggctgtgtgctgttggaaccagaaactttttagcatattatagtcgagtgccagtgacttctttgttctttcagaggcattctaaaaagcggcgtgtttcacgaatctcagagacaacaactttcacaactatcaactgtcacctcccaaactgccacagaaccttttaagtccaacattctgtcatttgtgggaaatactcatcttctaaaacacactctacttattctttgaatagtagttgcaaagctagtcatctctcaggaagcactttctatttccaaaactttggtttcatcagtacctggagcaaagcttctggcagaaacacaaatcctcatcaggggagaggcacaggatcaactcacggttataaactggactcctgctctgacgggtagcagccatcaactttgcccgattctcataattctgaagggtcaccaaggagttgctaccagccactgtacttaaagtggtgtcacaggattacaaaatagaagaaagtctttcttctctgactaatatgttagtgctctagtaagcatcaaagatgaaagacacacaatgtgagcctgctttggccaacacaaagtacttacagaattttcaggcctacttccagccctggagacaaatttcccatcattcttcattacaggagtaatcatcctcatagggctgtaatagcttttttttttttttagatggagtctcgctctatcacccaagctggagtgcagtggctcaatcttggctcactgcaatctccacggcttgggttcaagcgattctcccgcctcagtctcctgagtagctgggattacaggcgtgtgccaccacgcccagctaggttttgtattttttttagtagagacagtgtttcatcatgttggtcaggctggtcttgaacccctgacctcatgatctgcccacctctgcctcccaaagtgctaggattacaggtgtgagccaccacgcctggccgtaacagctttttttttttttaagaccagaatgaaattcccaacagtaaagaatagaactgaagagaataaggaaaagaaaaaaggggctgagggagaaggaaaagaaaagagagtttaaaaaggtagagaaggtaagactccaggcattctaaacactaccaaaatgtacagatctattttatgtgctctgcaatgacaaaaaaaaaaaaaaaaaaaaaaaaaaatcccatgtgagtttgacctgtttttgctgtgtctactggaatgtagctgtttgcacctaacttcaagaagtaaacactttttttcagactttctcctttgtaaaacaggaattctcacaatgactttaatcatgatgttacatgtaacatgcaataatagtgtttggtaagaatatttgaaaacagtccaatgaagctacaagttcgcaggtgtagacagtgtttatctggaggcaaaacccacttaaaatatttcttagggatgtttctcccagtagcttaagtgcttacttcatgggtgctttgttctagagttagaagatagggcaaaacaaaatgtagttatatttttctatgtatctttgccagtattttcaagggtttagccaaatctttattctctacttcatttacctctcacactacctcgtttttttaattatgttcaatttacatttaaaaacttttttctatattttattttattttacatatcagatttttatcctaaaacattgtcttcaaaaagttcccagcagcttagcttgttttacataaccgaagtgggaattcatatttgtcttagtcttttacatttctaattaaacatacatgacaatttaaaaatacgtttttatctagagtaatgtgtgattttcatggcaccttttatgttatttattgatatgacttggctgtgtccccacccaaatctcaacttgaatcatatccaccagaattcctatgtgttgtgggagggacccaggggaagtaattgaatcatgggggtgggtctttcccatgctaatctcatggtagtgaataagtctcacaagatctgatagttttctcaggggtttccacttctgcttcctcctcattttatcttgctgccaccatgtaagaagtgccttttacctcccaccatgattctgaggcctctctagccatgtggaactgtaagtccaattaaacctctttttcttcccagtctttatcagcagtgtgaaagcagactaatacagtaaattggtactagtagagtggggtgttgctgaaaagatacccaaaaatgtggaagtgacttcagaactgggtaacaggcagaggttggaacagtttggagggctcagaagagacaggaaaatgtgagaaagtttgaacctcctagagacttgttgaatggctttgacaaaaatgctgatagtgatatgaacaataaggtccaggctgaggtggtctcagacagagatgaggaacttgttgggaactggagcaaaggtgattctcgttatattttagcaaagagactggcagcattttgcccctgccctagagatttgtggaactttgaacaaagtacctgagagatgatttcaggtatctggtattgctgaatctggaagattgaatgcttagcaaagcattcaaaaggtgacttgggtgctgttaaaagcattccattttaaaagggaaacagagcatgaaagtttagaaatttgcagcctgatgatgcagtagaaaagaaaaacccattttttgaggagaaattcaagccagctgcagaaatttgtataagtagcaaggagcctaatgttgatccccaagaccatggggaaaatgtctccagggtatgtcagagaccttcacggcagcccctcccatcacaggcccagaggcccaggaggaaaaagtggttttatgggctaggcccagggtccccgtgccatctgtagcctagggacttggtgccctgtgtctcagccaatctagccatgactgaaaggggccaacatagagctcgagctgtggcttcagagggtgcaggccccaagccttggcagcttccacattgctgttgagcctgcaggagcacagaaggcaagaattgaggtttggaaacctccacttagatttcagaagatgtatggaaacacctggatgcttaggtaaaagtttgctgcagaagtaaggacctcatggagaacccctgctagggcagtgtggaagggaaatgtgggctggagcccccacacagagtccctcctggggcactgcctagtggagcttttagaagagagccaccatcctccaaaccccagaatggtagctccactgacagcttgtgccatgcacctggaaaagccacagacacttaatgccagcctgtgaaagcagccaggagggaggctgtaccctgcaaagccacagggtcagagtgcccaagaccatgggaacccaccttttgcatccacatgacctggatgtgagacctggagtcaaaggacatcattttggagctttaaaatttgactgccctgctggaattaggacatgcaggggtcctgtaactcctttgttttggccaacttatcccacttgcagtggctttgcccaataccagtatccccattgtatctaggaagtaactagcttgtttttgattttacagactcataggtggaagggatttgccttgtctcagatgagacactggactgtggacttttggattaatactgaaatgagttaagactttgggggactattggaaaggcatgattggttttgaaatgtgaggacatgaagtttggagggacaagtggtggaatgatatggtttggctctgtctccacccaaatatcaacttgaattgtatctcccagaattcccacatgttgtgggagggattcagggggaggtaattgaatcatgggtacgggtttttcccatgctaatctcatgatagtgaataagtctcataagatctgatcagtttatcaggggtttctacctttactttctcctcattttctcttgccaccgcagtgtaagaagtgcctttcacctcctgccatgattctgaggcctccccagccatgtggaactgtaagtccaattaaacctctttttcttcccagttgggtatgcttttatcagcagcatgaaaacggactaatacatttatgaggaatattttttattaatttctgctgggttttaattatttgattaaagatactaagaggaagatataaataactgctgattgaaatgtttcattctggaaatcagagtatttcccttgttttcaacaaattctcaaagccttcaagcactctggaaactttctgctataggaagaagatattcctctttttatgatggatgaaaaataaatggaatatagccacaagatgaataagtagcccaatatattttcaggtacctattaatatatcacaatttgaatatgatttttcccaaatcaatggatagtagagagtacatatttaaataattgtttttattatcttagaatatgagtagctcatttacctatggcaaatttttagtgttattcccaaaacctctatagaaacgaagatttagaaatagctgtttacttgtgaaatacttatcactttctattataaaagtataaactagtttatagtccatattcaaccagaacattgaaagattaaagtatgctattttatttttgctagtcctttgtagttaatatgctaaaactgagtaagggaaatacagtgttcactcaggtaaactgtagtttacctgagtgaacattggcctgcagttacatgtgaggtcatttatgatgagcaaacaatggattaggtaacaatgaggaaaattctagaagtttgagtttgtgtgcttactagcaaccactttcagcgtttctgcaaagctagagaaggtatcttctaatttaaatgtctttaagaattatctattgcgtaatatactgtcaacaggaggtcagttttaaaggaatactactgatagcctgaaagactgtggaaaagaaattatttttcccccttacacactgatagttcttgtatttgcattcctgaaattcatatatatttttcaaaaaaaaaaaaccattggattagcagcaagagagttgaaaatggcagaagttgggaatgactgctatttcttttttaattccacatgcataaaggtaaatattgtacaattgacagtacttcacatgcttaatctttttagtagaatgaagggagatatggcaataacttgtattgctgaacaaaaatttactattttcttgcaagatatcttatatttgtaaaatctggagtaacagcttatcatgtatttttgacatactgaatttctctgaagaaatctgagataatttaaaattattatttgtttgaaactacccttatatataccagttatatgtctatagcttttgaatcttcatgtggcacttttgcctatattatgacaccttgagacattaaattcctaatattaaaacatcataggttacaagatattgttttagttaatatgattccagtcattataattcaaatagttgaattcaggtaagtgtcaaacttagtgtaataaatctgttttcctatttgaaatttattaacccaattactgaattttcctctgtcaaaagtctaagtaataacaaatatttaaatatcattaaaaaagaaaattaatataaacaaattggccacatataaattaaactttataaagttaaatgggaaaaactgagaattcctccaatgtattaggatgtatagatcttagtaaaaccagataaaggtagaaactcaatatttggagctttgtgctcatgcaagaaataatccagtgaaaaagatgatatgtctggtttcaagtgtttcctctctgttaggaaacctgaatggagtcaacctctctgaccacagaaattggattcacttctattacctgttagattaaatgctaggataataaagaataataacagatttcatgtcccaggtgggcagagtgttttgtctatttcactgctgtatccccaagtacttagcacagtggctaatgagtaagttaccagtaaataattaaatgaataaataataataatagctcacaataccttatatcacatcatttttacagctaacctgtaaggaaagtagtttttatttcctgtatacagatgagaaaactgaagcacagagagtatgagttaagtattaactttgtgacaatgggcaagtggtggcgcccagggtttcaaataccagtttattgacttgaaaacccctgcctactaacccgtgctatgagagtatatggatctactttaacaagggggagagagtgaagatggaagtaggagagagataaaagataaagaacaaccatggaacatgtgtcaaaagagggaagaatgttatccacctctcttcccacacaacaggggcttgtagtttttaccaaatgtgcgtttacatttaaaagaacatagaatttttaagaagtaatagcggcccattaaaacaatccacatctacttttgttggcatattaacaagtcagtgagtatatgtataggcaattgtttatctttctaagccaaaggcacaaagcacatatatttaatgtagtatatcataatacaataattaaaattccacaataacataaattttaagctccataaaaacttaacagtatctccatagactgagaaaatagattatctaataaaaggattgattaatagaaatcattttcacaattagaatgtaggtagagattcttaaaaatttcatctggctttcttccaaaagagaaattaagttgttctgtcattgaattgtgatcaaagtgtcactggattcttatatctctattcctagtgaaccatatggattaacgaataacaaaaggtagcattttatcagtgatttgtggcatgttgtactatgtaaccattagactatcttgttgctttctcactaaagttagactaatttgctaaaatttagacttatggcctaaaattgatagtgtatatctttgtgattctagtgtaatctactcatatttcgtttaactaattagcaacctattgttgttgaacactaatgtcaacatattgagctttctacactgtttactttttcttttagggttcccagtgccgattccgacactgtgaagaggcccttggcagtgacactgtgtgctcattatggagagagaggaaatgtttagatccactttgcagatttagacacatggaaatgcaggtagaattacttggcgtcatcatttttgtcaaaaagtatttcccttcaataatgctgaattatactttttcaaaacaatatggaagaaatcattcttccttctactatttgattttaggcattttgcaattttttcaacttaatggaggaacatgttttagaaatacccattccatcttttgaatagcagggcttagaaacactgaaagctggaagacacacatgatcctaaatcagttaactataattgtttttgtgtccttgtgctgtattgtagcacattgtatttgttgtaaatatggcatctaatcattacatttcccccaatctccttttatctagcaaaactgcagcatttcatgcttctgggaaactcagcctcttggttgtgtgaagatcagctgtatcttttatcacagcaaacctcgaaatatcaatggattatttttgccaccaagtagcagtgagtacattttttgaataacatagacttaccatattctaatctggttttggactagcagcatagaatgacacatttaaaaagtatgacaaggtgagcaatgcaatttaatagccaatgggtaatttggaatgattctacatgagacaagagaaagcttagaatgaaccattaagtaactaacaagatgaaatgaacaaagagcaagttaaactttctctatgtgtatctaaaatggattttattcatatgaaaagtaagacagctactgacctcactaaatagaaggaggctgtgtctcagcaaagtatcgcacaactgaagccaagcttagaggtcataccttcactggtggtctctgtgaatgtgcggaaagctatctcgtaggtggagagagcaagggcaggatctgggttacacacttctgtttctagcagaacagctatgtgtgatggttctttctaacactttaattgtggaaaaaatgcaatgccattgctacaaaagccgtggcacaattcagtctaactaaatggtactgagactctaccatgtgatgtaccttaaagttggttctgggaagtggatacagaagacaccacagtgtaaaccagtgaatggtaagaaccttgctgaagaaggttgggctattaggtttccctgatgcttgtaactactctactttccttctatggccaccaagtttctctgatggaatggttttttgtttgtttgtttgtttgttttttgagacggagtctcgctctgtcacccaggctggagtgcagtggtgtgctctcagctcattgcagcctccacctcccgggttcaagcaattctcatgcctcagcctcctgagtagctgggactacaggcacgcaccgccacacccagctaatttttgtatttgcagaaaaatatacaaccatgctggttgggttaaattcatgatcacaaatctcaaatgagcccttactgctgactgccaataacactacatggtactcccccagttcattcctattctcccagactgctttttatacctccttccctctccttaaacctccattgccacctcctctttgatgatgactttatgtcttacgaactgagaaacttttaataagaagagaacttctgcatatttctgtcaccacatccacccacctagtagcattggtacttaacttcttccctgctcttaccatgaatcatccatactcctatctaagcctatccttccacttggtaactagacattgccttctcttgtctactctaagacattgagttaatgattcttccctctttttctacataaacattattcactcttactgaatcatttctatcagtatacaaacatgtatttatttatttatggaattctccattttgatctattctctcacaagctaccaccccatgtttttttcccgttgcaataattctcttcaaagtggttatttattattgctgtcaccaaatccttcccccattctttcttaatcccatgcaaatcaggcttattcactcctttcacctgtcacatacacattattaaatccagtggccaatttccagtccttatgtaacttgaaccacgagcaggatttgacacatttaatcaccccttccttcttgacataattttcctatctagcttgcaggacacattctcttcatttatctttcttttttttctttaacttttattttaggttctggggtacatgtgcaggattgttatataggtaaactgtgtgtcatggagatttggtggacagataatttcatcacctgggtaataagcatactatctgatagatattttttctgatcctctcccttctaccagcctccaccctcaaataggccacagtatctgttgtccctctctttgggttatcatttagctctcacttataagttagaacatgtggcatttggattttgttcctgcattagtttgctaaggatgatggcctccagctccatcaatgttcttgcaaaggacatgatgtcattcttgttttatggcgtgtagtaatccatggcatatatataccacattttccttattcgttctaccattgatgggcatttaggttaatttcatgtctttgctattgtgaatagtgctgtgatgaacatgcaggtacatgtgtctttatggtagaatgatttatattcctgtgtgtatatacccaataatagggttgctgggtcaaatggtaattctcttctaagttcttcaaataattgctacattgctttgcacagtggctggaccaatttacattcctaccagcagtatataagtgttcccttttctctgtaacctcatcagcatctgttattttttgactttttaataaatagccattcttattggtatgaggtggtatttcattatggttttgatttgtggttctgtgatgattagtgatgttgagcattttttcctatgctttggccacatttatgtcttcttttgaaaagcgttcacgtgcttttcccactttttaatgaagatgttagtttttgcttgttaagtcccttataaattctgggatattagaccctttgttgggatatatagtttgcaaatatttttttctcattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctatcttggtgaatttttgtatgtggtataaggtaggggttcagtttccattttctacatatggcaagccagttattccagcatcatttattgaaaggggagtcctctccctgtttcttatttttgtcacctttgtcaaagattagatggttgcaggcatgaggcttttatttctagactttctattctattccattggtctatgtgtgtttttttgtgccagtatcatgctgttttggttaccgtagacctgtagtatagtttgaagttgggtaacatgatgcctccctttttgaactttttgctttaagattgccttggctctttaggctccttttgggttccacattaattttaaaatatatttttctaattctgtgaagaatgttattggtagtttgatagaaataacttcgaatctgtgaatttctttgggcatcattgccattttcatggtgttgattcttcctatccatgagcatggaatgtttttccatttgtttgcatcatctctgctttctttgggcagtgttttgtaattctcattgtaaagatctttcacctctctggttagctgtattcctagatatattattctttttgtggcagttattaatggaattgcattcctgatttgactcttggcttggatgttgttgttgtataggaatgctactgatatttgtatgttaattttgtatcctgaaactttgctgaaattgtttatcagatcaaagcacttttgggcagagattatgaggttttctagatatagaattatgtcatctgcaaacagggataatttgacttccttgattcctatttggatgtcttttctttctttctcttgcctgtttgctctggccaggacttttcaatactatggtgagtaggagtggtgacagagggtatacttgtcttcttccagttttcaagggggaatgcttccagtttttgcttattcagtctgatgtaggctgtgggttttacatagatgggtcttattattttgaagtacgtttcttcaattcctagcttattgagggtttttagcatgaagggatgttgaattttattaaaagccttttctgcatctattgaggtaatcatatctcaatatggtttttacttttagttctgtttatgtagtcagtcacatttattgatttgtatatgttgaaccaaccttgcatcccaaggatatggcatacttgatcatgatggattagctttttgatgtgctgctgaatttgatttgctagtattttgttgaggattttgacatctgtgttcactgagaatattggcctgaaatttttttttttttggttttctttctgccacattttggtatcagaatgatgctggcctcatagaatgagttagggaggagtccttcatcctcaattttttgaaatagtctcagtaggaatggcaccagctcttctttataaatctgatataactcggctatgaatctatctggccctgggttttttttggttggtaggctttttcttacttatacagttatagaactcagtattggtctcttcagggattcagtttcttccttgttcagtcttgggaggttgcatgtgtttaggaatatattcatttcttctaaattttctagtttgtacccatagaggtgtttatagtagtgtctgataggtttttgtatttctgtggggtcagtggtaatgtcccttttgtcttttttttttgaaacagagtctcactctgtcacccagactggaatgcagtggtgcgatcttggctcactgcaacctctggttccagggttcaagtgattctcctccttcagcctcccaagtagctgggataacaggcatgcaccaccatgcctgactaatttttgtatttttagtagagactgggtttcaccatgttggccaggctggtctcgaactcctggcctcaagtgatctgcctgccttggccctcccaaagtgctgggattataggcgtgagccactgaagctggcctccctttgtcatttctaattgtgtttacttggatcttctcttttttttttttgtctttattagtctaggtagcagtctatctttcttattaattttttcaaaaaatcaactcctgggtttgctggtcttttgtatggctttttgtgtctccatttccttcagttcagccctaattttggtaatttcttgtcttctgccagctttagggttggttttctcttacttctctagttcttctagttgtgatgttaagttgttaatttgagatctttctttctgatgtggtcatttagtgctataaacttccctcttaatactgagttagctgtatctcagagaatctggtatgttgtatctgttctcaaaagtttcaaagaatttcttgatttctgccataatttcattgtttacccaaaagtcattcaggagcaggttgtttaatttccatgtaattgtatggtagtgagtgattttcttagtattgattcctatatttattgtgctgtggcctgagggcatggttggtatgatgtattttttttttttaatttgctgagtattgttttatgtccaaatgtatggtcagttttggaggatgtgtcatgtgatgatgagaagaatgtatattctgttgttttggggtggagagttctgtagatgtttattaaatccatttggtcaagttttgagtttaggtccttaatatctttgcttttctgcattgacaatctgtgtaatgctgtcagtggagtgttgaagtctcccactattatggtatgggaatctaagtctttttgtaggtctctaagaacttgctttatggatctgggtgctcctgtgttggatgtgtatatatttaggatagtaaggtcttcttgttgaattgaaccctttaccattgtataatgtgtttatgttttttaatcttgttggtttaagtctttttggcctgaaattaggattgcaacccctgatattttttgttttccatttgcttggtagatttttcacaatttctttattttgagcctatgggtatcattgtataatatgtgcaatgggtgtcttgaagacagcatgttagtgggtcttgcttctttatcgagcttgcaactctgtgccttttaattggtgcatttagctcctttacattcaaggttacattgatatgtgtggatttgatcctgtcatcatgttgttagctggtttgtgtgcacacttgtttgtgtggttactttatagtgtcactggtctgcattcttaagtgtgtttttgtagtgactggtaactgtctttcctttccgtatttagtgtatctttcaggacctcttgtaaggcatgtctggtggtaaaaaattccctcagcacttgcttgtctgaaaaggatcttatttatccttcacttatgcagtttagtttgcctggatgtgatattcttggttggaatttttttttctctaagaatgctgaatgtaggcttccaatcttttctggcttgtagggtttcttctgaaaggttcactgttagcctgatggacttcgctttgtaggtaacctacccttctctccagctgtctttaacattttttttcttttgtttcaaacttggtttctttgtttttcttctaccttcctagtgctttgttatcactctccctggattgttcttcctcttttccccaatctcttacatgtgcagagttagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgattttgaatatgatccacatgtcagtgactcccaaatgtaacaagagactctatttgatctagtgccctgttagctctctgaagttttctaccacactatattagtctgcttttacacttcttttgcactgctgataaagagataccccaagactgggcaatttacaaaagacatacccaagactgggcaatttacaagaaggaagtttaatggacttatagttccacatgtctggggaggcctccaaatcattgaggaaggctaggaggagaaagtcacgtcttacatggatggcagcagcaaagaaagagagtttgtgcagggaaagtcccctttttgaaatcgtcagatctcatgagacttactcactatcacgagaacagcatgggaaatacctgccccatgattcaattacctcccatcgaattcctcccacaacatatgggaattgtgggagttacaattcaagatgagatttgggtggggaaagagccaaaccatatcattccatccctggcccctcccaaatctcatgtcctcacatttaaaaccaatcatgctttcccaacattccccaaaagtcttaactcattttaacattaacttaaaagtccacagtccaaagtctcatctgagacaaggcaagtcccttctgcctgtgatcctgtaaaatcaaaaacaagttagttacttcctacatacaatggggttacaggcattgggtaggtacagccattcgaaatgggagaaactgggcaaaacaaaggggctacaggccctatgcaagtccaaaatccagcagggcagacaaatcttaaagctcaaaatgatctcctttgactccaggtctcacatccaggtcccactgaggcaaaaggtggggtcccatggtcttgggttgctctgcccctgtggctttgcagggtagagcccctgctcctggctgctttcactggctggtgttaagtgtctgtggcttttccaggcacacggtgcaagctgtcagtgaatctacccattctggggtctagaggacagtggccctcttctcacagctccactaagcagtgctccagtagggactttgtgtagcagctctggccccacatttcccttccacactgccctagcagaggttcttcatgagggccctgcccctgcaacaaacttttgcctgggcatccaggcatttccacacgccctctgaaatctaggcagaggttcccaaaccccaattcttaaattctgtgctcttgcagtctcaacaccacatggaagctgtcaaggcttggggtctgcaccctctgaaaccacggcctgagctgtatcttggcccctttcagccgtgattggagtgactgggacacagggcaccaagtccataggctgcacacagcatggggaccctgggcctagcccatgaaaccattttgtcctcctaggtctctgggcctgtgataggaggggctgccaagaaggtccctgacatacattggagacattttccccattatcttggggattaacattcggcttattgttaattatgaaaatttctgcagccagcttgaatttcccctcagaaaataggattttcttttgtatcttattgtcaggctgcaaattttccaaacttttatgctgttttctttttagaactgaatgcctttagcagcacccaagtcacctcttgaatgctttgctgcttagaaatttcttctgccagataccttaaattatctctcttaaattcaaagttccacaaatctctagggaaggggcaaagtgctgccagtctctttgctaaaacttaataagagtcacctttgctccagttcccaacaagttcctcatctctaactgagaatacctcagcctggatttcattgtccatatcattatcagcattttggtcaaagccattcaacaagtatctaggaggttccaaactttcccacatttttctgtgttattctgagcccttcaaactgttccaacctctgcctgttacccagttccaaagttgcttccacatttttgggtatctttccagcagtgctccactctactggcaccagtttactgtattagtctgtttttattctgcagataaagacatgctgcagataaagacatacttgagactgagcaatttacaaaagaaagagatttaatggacttacagttccacatggctggggaggcctcacaatcatggtggaaggcaaggaggagcaagtcacatcttacatgtatggcagcaggcaaagagagagagcttgtgtagggaaactcttgtttttaaaactgtcaggtctcatgagacttattcactatcatgagaacggcacagaaaagacccgcccccatgattcaattacctctcaccaggttccttccatgatatgtgggaatttgggaagttacaattcaagatgagatttgggtagggacatagtcaaactatatcacacacccgtatgcttgcttgctctactcaaatcatactgtatacttgcttttcctagtgcatattagcatgttcctgctttaggggctttgtgcaaaacactcttccctcaatatcttcatggctaattccatcatttcttcacagccttgctaaaatatgttttacataacactattctgaacactgtatttgaaatgtagtcagccttcccaagcatgccttacacacttccaaacttccttgccttgttctactttcttattgccatactccctatgatttctcagatacaatataatttactggtttaatatgtctatttgttgtgtgactcctccctatagaatgaaagtaccataagagcaagaatctttattttgttcactgatgaatctcaagcacctaacatagccacatagtactggctctcacatagtggccagttctactccgggaatccatgaacagcatttatttatgttaaatctgttaactattttcccgctgcttgacacatttctgtactctaggaaaaaggattcaatttccagactgtagataaactaacaagctcagctgaaatatgtattgaactactgcattgcttctttatttggaaatatttcaatacctcagaagtaataatttgattcctggcagacctaatatttcctatgatatttccaggaacttctatctaccaatgcccataataaccaaaactggggccataaatcttttcaccttagacaaagattaaattataaagtaatacctttgtgaatatctacctttatgagtgtcggtaaatgcatatgattaattgataaatttagggtgaggttattacaaaccatttcatagcaaactgtaactggctaagtataggttcatacagagcattgtacaaatgtgtgtaattttgtctcaggttaaaataagataaaatttagatatttaaatgtgcaacctgtgaaactttagggcttctgcttgatgaattgagacctgtcacatagtccatattaagtagatgagttggagccacagcagtgctatctaaatcaccggctgtgttcttccagtatgaggcacttgccaaaggcaatttcctattagatgatttgccattgtatgttgttatctttaagcactaagtgcaattatcaggagtcctacatttttttgtctaggggtataaaactgccagttactctctttgcaatttaaacttcaacctgctagtgaattttaaaaggttttggactcttttaaaatatattttatttacatgtttataaaccatggaattttaaaagacataatctctctggttatcatttctaagtttaaaagcaaatagctgctaaaccaattgagaatgctaagaaaacataattctgttaatatttaccataaaaattccctagacattttctgagtacagttcgtacttttttgcaagcctggtaggcacttattctttctcctatggtatgcactagaagttagtgtaatctcttagacaaacttgttttaaaaaagttcttatattttgctgaagaaaaatttgttccaaacacagtagctagcttgaacatggaaattgctcatctttccttggctagttgccactttattctgtaatgaacaattgaataggatcatttgatttttatttattctaggtcagtgtccagtgacgccttggacaactgatttggccactttaaattaaactttggtcagctttctttagaatgtctagcctctgtgtttattatctgccttttagttaaagttttgaaaagccacttgctaataaattgtttttaaataatttaataaacactttgacttgaatatttcagtcagtacacacacactaatttttgtgcgtgtgtgttttagaaaagaagacaattcataatggttataaggataaaagttcttcagcttagttctttcctctctggggaaggaagagaggggataagaaaatgccatagcacatcaaatggtagcccccgagataatttgtgttggatggcagattctttatcctgactacatactgcttctgttctcatccaaggtccaaagagcatcaaaacatgcaaaaaaataaaggcaggaactcaaatattacttcttcaggcttaacatttgttagtcatgtttaagaactccacatcttgctttttaggacttataaacttgcagtttaattatggcttttaaaaatgaagtggagttataagagattagaaaatcacatacccagtgttttagaataatctgttaagtgtattacgtgtggcagcgctatgctggataattttcgtgcctgattttatttaatcatcataaaaactggccgaatagatacagttaatctcccgattttacagatgaagacaatgaggtccacagaggccagatatcttaggcaagataatacctctcaataagtggcagtttctgaattcaaacatagtgctgtctgactctagaagtatctcagccaggcgcggtggctcacgcctgcaatcccagcactttgggaggccgaggcgggcggatcatgaggtcaggagatcgagaccatcctggctcatacggtgaaacccgtctctactaaaaatacaaaaattagccggacgtagtggcagatgcctgtagtcccagctactcaggaggctgaggcaggagaatggcatgaacctgggaggcagagcttgcagtgagccgaaatcgcgccactgcactccagcctgggcaacagagcgagactctgtctctaaaaaataaataaataataaataaaaattaaaaaaagtatctcacaaaaatcagacgtaacatttaaagtatactccaatgctttttgtcatttgaatgacccatgcatcagacctcctgatctgtcttctgccttctgaggggctaattctattccactctaccccatagacttcttttcaaagctattaaagttttttatattttatagaagactgcctttcccctttaatttacagtattagagtgagatattctagcacttctgagttatgtgtacttccattgaataaggcttcttttctctttctcaatttatatttccctgtcttttctgaaacttgttctcttatatcacgtgaagctcagaagcccggatacccaatctgaagtttgtctcacccacaggctctcagttctggctccacgttagaattacctggggagcttaaaacaacaaccaccaaaaaccaaacagttctcagccaccacctaaaccaccaattaaactgatgcttcattatacttttgttttccccccaactttttaagacattttgtaacttacagaaaatttgcaagaatagttcagtgaacaccagctgtccatgtattcttcacctatcttcaccaattaacattttgtcacatttactttctcttttttctttactgtatttacatatctgcatataaggtataaatatacatttctttatttttgtttttttggaaccatttgggagttagttgcaaatatcctcacacttcattgctaaatacttcagcatgtaccttctaagttcaagagcattctcctatataactgcacatgactatcatatgtagggaatttaacatgatagaatcaacaatgtgtaatattcagtctgtatcaaattttcctaattgtccaataatacttgtaatagcaatgcttcctcaaaatttagtacgtataggaatcacctgacaatcttgtttaaactgctgtctgattcagtatatctgggctggagcctgaggttctgaatttctaataagctcataggttcttgggaccaagtgttgggtagagcagccttaaaattgttagttttattttttttcccccatccaatttacaattaagcatcattcattgcaattggttgtcatgtctctttatttaatctctttttaaaaatctgatgtctctttaaaaaaaatcccaggatttttttttcttccttgtcatatacatgtgtattttttggagacaggatcttgctctgttgcccaggccagagtgcagtggtgtgaacacagctcactgcttccttttcctcctgggcccaagtgatcctctcacctcagcctcctgagtagctgggaccacaggctcatgacgccatgcccgactaattttgtaatttttggtagagatggtatctcaccatattatgtaggccggtctcaactcctggattcaagcaattcactcaccttggcctcccaaagtgctaggattacaggcatgaaccactgcacccttccccatgtcatatacattttaaaagagttcaggttagttgctttgtaggatatcttttaaattggggatttgttcatttatttcctcctaattacttttagattaaacttttgttttgcaaaaatagtacaaagaagatcagtcagttattttaaaatttacacaagtgttgtatagatttgccctaatgccctaaccaaactattccatggaggtgctcttaaagaattagtgaaaagggaagaaaaataatttgcgaagaacctctgctctgtgaattttacaaaaattagcatttcttgtactctttgaaggacaagagaagaacagtgcccaattcctgtgagtctaaatgaaaacaatttgtttagttataaataattcgtttatacaaaaggctcttttaacctatgtgttttgtactgcatgtgtgttctagctatggaggtatttatgggagtaggaaatactgcattatgattgcatttatgacatctgtttaaaaaaaactgaatttgttttgaaaattgacaaagcatagaaagtagatgttcatgtatgaaatgccctggcatgatgcgatatagtagtctctcataagtactcccttgtagagactccgactcccttggtcataaagagtggagtagtgctaaatgttttaactggctcctttcccccaccttgttcccctaccccaaaaaacaaatgggaaaaaatgcaaaacaaaacagctctgttggttcacatttgtcatttgctgtgaagcaaatattttctctacggccaatttcaaactataaatgtgacgtcagtattcttgcaaaattcctgaaaatttgccaattctacgtgcttatctgagcccactccagtatattaccggttttaaggagagaaacccaactcaatttgatttaagggaaaactggaattcttggcttatataattaaagagattagggacagaactgacctcagacccagctggatccgtgtttccttcaccaacccttagttctgagctaggtgtccttctctatgtactacagttactccagaagctccagaactagattttggaagcagaataggcaaatattaagaatagtagctctagctcagattagtttgaaatatcaacctaccacatatttgccactgtaaacatgggcaacttaatgtctctctggcccaatttcttcatctgtatggtagagatagtaatagtacctgcattgggttttagacatttaacagattaatactcaattgtttagaattcttggcaaagagtgagtaatcagtgttatcattatcaattgtttagaattcttggcaaagagtgagtaatcagtgttatcattatcatcatcattctaaattaatctcagaagaagtaagtccttctgcaactaaagcccaattattgaatgtcatctaatggtgtagaaaatgtgctcatccctaatagttgttcaagctaggggatgagctaatctttgggtcccaggggtcatcctcactcacactaagttgattgaaaatgggaaaaaggttattcccttaaaaaaaactctgatacactttacctaagagaaataaaatgattacaggacaagcaaaaataataggtaatcactacataatatataaaaaatatgtctttcagaagaatcatatgaaatatatgtgatcaccccaaagttgatcatagtgacatgaagttatgcttttggtagaaaaatcaaggtgacaaaaattatctatgtgtaaattcatgtaaagtacattatagtagtttcttaaaatgcaaagaccattagtatttgtgatctcataggaaagttgctcaaatcaatgaagatataataatacatgtcaaattcagcacccttttgtttcaaccattgtagagaggtaaacttaaccagtgtctgaagttttactgcattacttggttgtcaagtaatgcacttgaattatttatttcatatttctaattgggtagtttctgttaactatatgtgctctttcccatcctatctctttctccttctgatatgtatttaaacacattaaatagaaaggtgtgatgagcagtggtctttatttttgatgaaatatccactacaacatttttgattaaattttttcattataagtttagttgaaatggtgtaactttcaacattttatcaatattggctttaaaagtaaaaattttctcattataaatgtatctaatgacatcttgccgtaatgattccatttataatcttataaatggaataatcttataatcttattataagattataataattttaatcttataatcttattataagattataataattttaatcttataatcttattataagattataataattttaatcttataatctatttaaaaaatacaagaataataatctcaattacaactaaacaggttctaagacttacatggaagtgcaaagagccagaaatagtcaagagatgcttgaagaagagcaaaataatagaacttgttcaaccagatttcaaggcctatgaagtgatagagattaggacagtctagcactggccacaggataaacaaattggtgagtgggacagagtagatggaaacagacctttccatagatggacacttgatttgttaggtgaacatgataaccactacattatggaaacggattggacacttgatttgtagtaggtagcatggatgagtaatgggtggtcttttcagttaatgagggaaaaatggacttctctctcacacaatagatacaaatcaatttgagtcaattattgatcaaaatgtaaaaggccaatatttgaatacttcaaaagataataaggtcacaaaatattgaccatttcagagaatatgaataaatttggctgcactgaaattaaaatttgtatttatcaaaaacaccataaaaaagtaaaaagataaaccaccaaataagataatatttgcagcatgtgtgcttatgtgactccaaggaaagacctgaagtcaatacttgaatacaaatcaacaagaaaggccagagaacctaatggaataggtttttctgttttaccactattgagattttggactggatagttctttgttgttggaacctatcttatgtattgtagattgtttagcagcatctttagcttctacctactagattctaatagaaatctcctcgttgtaacaaccaaaaatatatccagacattgtcaaatatttcctagtacgtagggagtaaaattgtctctgcttgagaactgctatcatagaacaataaacagaaagcttataaacaggcatttgaaaaggaagaaattaaaatgtaaacaaacaagatgatcagtcttattaatagttagggaaatccaaacagaaagcactttgagatataatatacccatattattggcaaatatcaaaaattctatcaattcttggtgaagacaaagaacattaggaattattgtgcactgtagaaggatatataaacggatacgagtactttggaaaacagcctaacattatcttgtccagttaaaattatgcataacttaggaccaagcaattccacttttgaagcatatatcctagagaaatccattactgtgtacatctggatacatgtattaaatacaagaatgcacgtaacagcagtttgtaatggccaaaggctagaaaccgtcaaatgtgcaacaacagtggaatgcataaataaagtgtggtacattcattcaatactagacagtgatgaaaataggagaaacaggtgagtaaggatgtatttaacagataaaattaaatgaaagaaggcaagaaagaatagatatggcttaactctatttataaaatgttcaaacataagcaaaattaaactttatgtttagggatgcatacttggtagtgagatcataaggacaaacaaaaagtgattacaataggttaggatgaagatacctattgtgggtatggggaaggaaaattgtgtgaatgaagaggatgtttaggaggctattattacatgacttaggtgttggctttgtgatacttgttacaatatatattttatagtttctgtacttttctgtgtatgtgttatatttcacagttttaaataggtaaaaaatgcttaagcaaacaattctttatttaagaattatataaataattctttatattaagaaacaattctttatttccttctgttaaaactattgccacttaggactattcacaatagcaaagacatgggaatcaagctacatgcccaacaatgatagactggataaagaaaatgtggtattaatacatatacaccatagaataccatgcagccataaaaaagaatgagatcatattctttgcagggacacggatggagttggaggccatcatccttagcaaactaatgcagtaacagaaaaacaaatactgcatgttctgacttacaaatgggagctaaatgatgagaaaaatggacacatagaggagaacaacacacactggggtctaccagagggtagagggttggaggagggagaggatcaggaaaaataactaatgagtactaggcttaatacctgggtgatgaaataatttgtacaacaaacccccatggtacaagtttacctatataacaaacctgcacgtgtacccctgaactgaaaagaaaagataaaaaaaaaagctattgctgtttaactttcttcacatatctttaccctaacctaatatttttatgcttgagtttattgatcacctattaaaattaatataacaaaaatatatataaatttaaattttcatttttttaaacgatgataaagttccacttttaaagccatatggtctttaacatgcctttaggattgaattattattacaattatcactggcatttaatttattaaaacaacaattacattacaaatattgataattattgcatatcaaagtacaattatataagaaaattacctcttcattaggtgaattaatgatcaaaattattcttatctgtttataaaacaaaaaaaggtatatattgctgccatggcttgtttgtatttctccaaaatccatgttgaatatgaataggattaaggccttcataaaagaggcttcacacagggcttggccctttttgcccttttgcccttctgccttcttctgtgtgaggacacagcatttatcccctccagagggcacagtaacgaggcaccatcttggaagcagggagtcctcaatagagaccaagcctgccagtgccttgaccttagacttctcaacctccagtactgtgataaataaatttctgttgtttataaattacccagatattttgttacagcagcacaaatggactaagacacttgctaaaaactaatattcagaacgagcaggttgttctaatatttgctaagtcagttacaatatagtaaacattttataaacttaaataagatgaggactcacttcaattagaagatttcacaatattataaaagagatcttaactatctcaattggaagattttatttgaaaattgtatctatgggtttttttctaagatattgtgaacaatttggcaaacttgtaaataattctacttgcatttaaaaaattgtgatgactagattactttcagaatgatgttgcgaagaattccatgaacctgttccctagtgaaataacaattgatttcaatggttgatgaaaattatatgttaaaaatgtttccaagtgttaagaaattgtcctaagggcatacagcaaatgaaatcgtattaattcaataaaatatactaaagccagtaaaaatggcaagtcagttgtattggaaccaccacccactcctttcaccacctctctgtttagtgtgacagaagctctactctgaatggatacagccaagaacacagagctctttctacgtccagcttccagtcaagaactatagtacctttctggggggagaaagctgctaacatttctcatcctctccaattcccaactccatgttgctagagctctatttttcaggcctgaatcttgttttcatccagccccaagcataaagcaaaagttctatcccacgtgcagcaggctaggaataacaggacctcaattacctttgcctcagttggagcatggatagaggtcccatgccaggaggcacaagttgtaaacaccagaaattaccacccctgctttgtgccccaattttaaaacagggcgtcactccaaaagaattaagtgactgtccttgctcttagcattagcactgagattttgtgcaggcagagagtagaaaactctgaagctctcggaaagagaactgaatttatttggaatagaacatagtgtggggaagtttaagattagggacgctctgaaaacaatggtgattggggataagcaattaagaggaggctagtagctccatgagagcagcaaactaaactgtaaaccagctagaagtttaccaaagacaacccggtaaagacacagttaaaaagagttcttttgggccaggcgcggtggctcacgcctgtaatcccagcactttgggaggccgatgtgggcggatcacgaggtcaggagatcgagaccatcccagctaacacggtgaaaccctgtctctactaaaaatacaaaaaattagcggggcgtggtggcgggcgcctgtagtcccaactactagggaggctgaggcaggagaatggcgtgaacccgggaggcggagcttgcagtgagccgagattgcgccactgcactccagcctgggcgactgagcaagactccgtctcaaaaaaaaaaaaaaaaaaaaaaccaaaaaaacaaaaaaacatagtcctttgtcaatctttagtctactacttctgatctattaacagctcctggccttccatttctagttatcccagaaggggatactggaacaccttgcaggtaactactgggcaggcaatttcgcctggtgtttaaaaacatggattctcgcttgaaccggggaggcggagcttgcagtgagccaagatagcgccactgcactccagcctgggcgacagagcgagactccgtctccaaaaaataaataaataaataaaataaataacataaaataaaaagagttcttttgggattggaacaaacttgaaagattgggctcaaagcttagctctgcaaaggagtcaatttacttgggttaaactgtggagcaatttatgccctagtgcattgatgaaaacaatggggcattacaccagcaatgaatggaagctaacatctcagtgtgataccaacagaggtggacagcttaacagagaaaccagggaatggagcaaaatgagccctgctaaagtccgtgttatccctgttaactgtggacatgccaaggctacatcctctgaggaatgacaacagaggctgcatattgtgggagaaaataaattttactaaaatattccaacaaagtcactcaaaaattaaaaagcaaacaacaagcttcaggtttaggatgagaagtcaatattcagagttgctacaatgtattatcacacatgttgagctttcaataaaaattataagacatgcaaagaaacagaaaattataatccacatacagaaataaaggaggcaacagaatgcttatgagaggattgtgatgttcaactatgcattgattttttttttaacttttattttgacttcaggggtacaggtttgtttgtgcaagttggttctaaagataaattgcatgtcctggggtttgatgtacatattatttcgtcacccaggttataagcatagtacctgataggtagtttttcaatcctcaccctcctctcaccctccaccctcaagttggacccagtgtctgttcttcccttgtttgtgtccatgtgtactcaatgttcagctcccacttgtaagtgagaaggtgcagtgttttgttttctattactgtgtcagttcgcttaggataatggcctccagctccgttcatgttgctgcaaaggacattatctcattctcttttatggctatgtagtatttcatggtgtatatgtgccacattttctttatccagtctaccattgttgggcatttaggttgactccatgttctttgctattgtgaatagtgctgtgatgaacatacacatgcatgtgtcttcatggtagactgtatatacccaataatgggattgctgggtcaaatggtatttctgttttaagttctttgagaaattgccaaactgctctccacaatggctgaactaattttacattcccactagcagtgtataagcattcctttttttctgcagccttgccagcatctgctatttttttagctttttaataatagccattctgattagtgtgagatagtatctcattgtggttttgagttgcatttctctaatgattagtgactatgagcattttttcatatgcttgttggctgcgtatatgtcttcttttgaaaagtgttcatgagcagacaatgatttaaagcagtaattataatatgtccaaagacctaaactcctgcataaagaagtaaagaacggtattatgacaacatctcaacaatagagactatcaatgggtaaaaactacgaaaaaaccctaacaaattgaaattttggagttgaacacacaatatctgaaatgggaaaaaaatactataagggatcaagggtagatttgagaactgcaaaagaaagaaccagtagatttgaagataaatcaacggagattatacaatctgaaaaatcaagagaaaaataaatgaaaaaaaagatgaacaaagcctaagagaaatatgaggcattttaccaaaatgtaaggaaagaaaaaataatggctgaaattccccagatttaattaaaaaattaatctgcatatacaagaagctcaacaaactctaagttggatatacacaaatatacctgcagccagacacatcatatgaaaaaagataaataccagtgataaaggcaaattctggagaacaacaagataaaaatgttttattgcatataatagaaccccagtatgattaacagctaccttcccgtcagaaacaatacaggcagtaatcactgtagactgaaagaaaaaaaattgtggcaatcgagaatctttgtccagaaaactagttttaaatgctgtatttcaaaaataaaaaggcaaacaaagacattcaaagaaaacaaaaactgagagaatttgttgccagtttgtctaccttaaaagaaatactaaaggaaaactttcaggtggaaagcaagtgaccctgagtcagtatttcaaatccatatgaagaaacaaagtatgctgataaaggtagttgtgtaagtataaaactatcataagggcatatttcttttccttctataatctgattttaaaattttataaaacaatacatacaattttttttagtctgttacatttagaaatgtaatatatttaataatagccacacaaaagaggcagatggaagcaaaactgtatgatgacaaagaaatgacaccagatagtaacacaaatccataggaacaaatgatgagaattagaaattataaataaaaaggttaatagtctctgtttatagaacaaactataaatacctacttgatctttttcccctcttagctcctttaagaaacatacaattatcttaagtaataattataacaatgtattactgggtttgtcatgtatagaaatgtaatatatgttacaatagtagcacagaaaggaggaagagggcatagagctatataggagtaacctcttatatctatctcactgatgttaaattagtataaaagtgaaatagattctgatgttaagaagcatatagtaagccatagagcaacctaagaaaatattataaaaatgaagaattaaaggaatttaatattatactagaaaatattcatcagtgtaaaagaaagagaaacagcagaacatgaaacatatagaaaacaaagtaaaatagtgtacctaaatccaactatatcaataattatattaaatgtgaatgggtaaaaaattcaatcaaaaggcagagattgtgaaaataaaattaaagataaaactatatgctgtctacagaaaacactttttaaattcaatagcccaaacaagctgaaaataaaagaatggaaaatatataccatgcaaacaattataaacaagaaaataaaagactcgaacaactgtaaagcaactagacctaacagacatcagcaaaacactccatttaacaattgtaaaatacacatttttctctagtgcacaagaaacattttccagtatagatcacattctaggtgataaggtaagcctgaataaatttaaaatgattgaaattgtgctgtgtatgtcttctgaatataatggttttaaaagttgagagaaaaaaattgagacatttacaaatatatggaaattaaatagcacacatgtaaataaccaagaaatcacaagaaaattacaagggtaatcagccaatactttgtgtttagtaaaagtaaaacatagcataccaaaactcatgacatgaagtaaagcagtgcttagaagaatataagttgtaaatgcctatatattttttaaaaatctcgaatagataacctagacttacaccttaagacactggaaaaagaaaagcacattaaacctaaagcaaacagaatgaagcacataataaaaattaaagcaggaattaatgaactagagaatatgaataaagaaaaccaatagagaaaatcagggcaaatcaaaagttggttatttgataaaatcaggaaaattaaaaatctttaacttgactgaccaagaaaaaaagagataggttgaaattactaaaatcagaaataaaaaatgagacatcactcccaatattatgaaaataaaaagaattaaaagggaataatgtggacaactatatttcaacaaattagataacttatataaaatagacaaatttctagaaagacacaaactaccatcactgactctagaaaaaaagaaaaaaattgaatacatctataggaataaagagattgattgggtatttgaaaacattgccacaattaaaatctgggctcagatggctccaatactgaattgtaaccaacatttaaagaaaaattagtactaatttgtcataaattcttccaaaaaaaaaaaaagatgatgcaacactttccaactcatgtctatgagatgttctaagacatcagacgaaaactgcagaccaaacttttcctatgaatatagacactgaaaaatactcaacaaaattcgattacactaaatctgacagctttaaaatgggattatattccataactaagtgagattaactcagaaacaaggttggtttaacttcccaaaatcaatttctgtaataataataataataataatatacccacaataatataataaagagcaaaagacacatgatcatcttaacagatgaataaaaaacagttgataaaaatttgacacacatacgttataaaaaatattccacaagctagaaacagaagaaaacttcttcaacctgataaagaatatatatgaaaaatccacagctgatagcatacttgatgaaatactgaaagctttacccctaagattgggaagaagacaaggttgttcattcttgtcatttgcagtcaagacagggaaattgttgcaacatcatcagctaaaaggcttctgtattggaaagaaagagcaacattatctctatttgcatatggcatgatcttttatttagaaaattctagaaatctaaaaattattagaaataaatttagcaacattgcaggatacaatattaatatacagtaatggattgtgtttctttacagtagcagtgaacaaactgaaagtgaaatgagaaaaatcccacttacaatagcatcaaagaggaaaaaatatttaggaattaatttaacataagatgtgcaaagtttatattcgaaaactacaaaagattgttgaaagaaattaaagaaaaccttgaaaaacagagatatccttgttcatagactgactttgtggttggtatgccagtattctccaaattgatccacaggtttaatgtagaatttatcaaaatcccaatggacctatttgcagaaattgagaagctgattctaaaatttatatggaaatttaagggacccagaatagtgaaaaaaaatcaggaaaatggaaaccaaatttggaggacttacacttcctgatttcaaaatctacaagttactacaaaactgaagtaatcaagactatatggactagcataaaaattgatctatatgtcattgagacaggattgtaagaccagaaataaacttttatatcaatcagtttatgctcaattgattttcaacaagggcatatagatcattcaatggggaaaagaatagtattttcgacaaatggtgctaagacaactagatagtcacatgcaaagtaattaagtagcacaactgcatcacatcataaacaaaaattaactcaaaatggatcaaagaacaatattccattttggaacattggatcactttaaaaaggaaatccacacccattaacggttacctctcatttctttccaatgaaacattggatcactccaaaaaacaaactcacattcattaacagttactcctcatttttttccaattcccaaaacctacacagtcactactttacttcttgtttctataaatatatctatttttgatattttgtataaatggaatcatataatatattattttttgtgaatgactttttcctcttagcatgttttcaaaattcatccatgctctcacatgcaacagtactttattactttttatagccagatagcactccattctatggatatgccacattttatttatccatttatcagacaatggaaatttaggttgtttccactttttgactattataaataatgttgatataaacatttgtgtacaaatgattacatttgtataatatagacatatattttcacacctcttggtatgtagctaaaaatggaatagatgggacatgtgatgactccatatttaaccttttgaggaactgcctaattgttttctaaagtagctgcagcatttttcattcccaactgcagtgtacaaagattctagtttcttcacatccttgacaacacttgttattgtctttttagtaaagaaattaatcattgtaatcgttgtagtatgaagtgatatctcatttggttttgtttgtttttgtttttgttttgaaacagagtcttgctctgttgctgaggctagagtgcagtggcatgatctcggctaaatgcagccttaacctctcaggcttaagtgatgcttccacctcagcctcctgagtagctgggactacaggtgtgcgccatcacacttggctaatttttgtatttttttgtggagatagggtttagccatgttgcccaggctggatcttatttattctttctgtgtcaccttggggttctgagtgtttcttcattatctggctgagagggctgggaactgctttccagcaaaatctgggacttgttggcaggtgttatcatggctcacccccatgtgccagggggctggctacttttcattgactgctttttcttttggtgtcatatctaaaaaacttttcatgacctaagggttcttctatgagttttatagtgtcagatctttcattttgttcttacatccactttgcatgaatttttgtttctaatgtgatgaagttgtgcaacttaattactttgcatgtggcaatctagtcgtcccggcaacatttgttgaaaatactattttttcccccattgaatggtctatgtaccctttttgaaaatcagctgagcataaattgattcatataaagatttagttctggtcttgcagtcctattccaatgatacatcgatctacttttatttttatgctagtccagatagtcttgattactttagttttgtagtaatgtccatataaattttagaatcagcttctcaatttttgcaaataagtccattgggattttgataagagttgtatcatacctatagattaattcggaaaatattgccataccaaatacaaatcagtccataaacaaggatatctttccatttcaacatttctttaacttctttcaacaatatttttattttattgaaataagataaaaatctttttcaatatatatattttcagaatctttttcagaatataaattttgcacatcttatgttaaaattaattcctaaatacttttttctctttgatgctattgtaagtgggattatttttcatttcattttcagtttaatcattgctagtgtgtagaaacacaatccattaatgtattattattgtacacattttaaaataatatatagttaattaggagggcaatgattgattgttacatctacttatcatcacatatatcttgaacagactgaaatgttgcattttctctgcagatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatggttagtagaacttttttcaggtttacaatacacattcaaaaacctcacattttctacatatgtgtttaactgtaaaggtttatgatgtaatatataaggcagattttgctgagaaaataactataattgtattaaactaatttaattcattatgttctaatttgctacatatttatgatcttttggattggaaagtttttgttgtacgatagctgggagacagatctgatgcttaagtatatttaggtgcttcatatacaccatggaatactatgcagtcataaaaaggatgagttcatgtcctttgcagggacatggatgaagctggaaaccatcattctcagcaaactaacacaagaatggaaaaccaaacaccacatgttctcactcataggtgggagttgaacaatgagaacacatggacacagggaggggaatgtcacacactagggcctgttgtggggtggagggccaggggagggataacatcaggagtgatacctaatgtagatgacgggttgatgggtgcagcaaaccaccatggcatgtgtttacctatgtaacaaacctgcacgttctgtacatgtatcccagaacttaaagtaaaatgtatatctatataaatgtatatatatagatatttatatatctacagatgcttatagagatactaataagctatgttttttatatatgtttctaaaacattgatgcacaagtgtatctgtttatctacatatgtattaataatatatcagtttcacatttaatcctggaagttatagagatctatgtagtagttaataatctataaatcactgtcatctgcattattctaagtcatcctcacaagagtatgaacaggcttaggacccatgtcttttgcattttagttcatcctttgcctcccatatcaacccagcacagtggtgccagaaagtgtgtatatacaagataaacatgaagaaaaactctcgatctgtctttgtgctggaatatgtccttctatggactacgggacaccatagtttctgtgcttaggagtacactgagctatttattactatttctgtgtgctgcagctccatgtctctcatgcctacatcaacctcgaaataaacatacaccatctcaacattgagtctgtacattcagcgtctcatttcaaagtacataatacatagccctttgttttctcttgacattgttttgaatacttaaaatgtagcaatttgaaacatgtactagtatgtaaaattattgattttagaaatataaaaaagtaatctatccatgagaacagtatttggggttttcctttctggtttataaattttcagattaattggctttgggacaatttaatttaaaaaatctatatcctatagatgcttctagtttatggacaaagacccctgaagaaattgaagaaaaaagagcaataaaggagatgtgttataaatctggtaagaaatcaaacatttttgtattttctaatacttgatgtgataaatatactaaccattacttttcttatggttgattaggggaatactacagatttcatactcctccagatattttgtcatcaaaaagcatgacacctacagcagaaaaacagttagaaaagcctttggaaaatggcagtgaattgcaagaaggtaagaaatgaaaaggcagcattcatagtgatctataacatatacttggtgtgatagactgaattatttagtatgatgtacagaagaataaagtgataaataatacatcgtaattgagcactagaagaaagtgtttgtattggatgacccaaagctgctattaatgggattatgttatcctagagaggtgacagaatgaatagacttcattaacacgtaatgacactacacactccatggggtaatgctgtaaataatttgcttttaccattttatttgtctttgaaataaatccccctgccaaagaggtctagatttttctttctgaatagaaaagtaagactagcccaagaagaacaaaagagagatcacagaatgacactagtggcagaacagagattatttggtcattgaatgaaagtcttctgtggaccagactatttcagaggccatgctggagaacaaatcgaaggctctgctttttatggcgcttacctttggagaatctgatttactgtggatgaacatctgcaatatgttgtgcaagtctgttttgtagcgaactattcaaacgtggcgataggtggcagcaacacaccatcagacggagaagagcccgcaaaccttgggaaccatatagggaaggacagattgcaggccagcactgctcagagaagaaaaaacaaaaggaaacaaaaacaaaagaagaaaacaagttagcaatgaacattaaaaagggcagattataaagacaattatatgtacttttgctttatattatgctttaaaaggctgtttatttttaaatagttttggttaattcctatatacccttcacctagatttccttcaaacgttagcattttaccacatttgaattttcactctctctaaatatacacattgttattataatcttctgaattgttcgagagaataagttacagacatgatacctctttgcttttacattaactgtagtataaatataaaaatcagaaaataaccactgatagaatatcatttataaccttcttttcccacaaattttaccaattatgccattaatgtgctttatagtaaaataaattttttcccctagtctaggatccaatccagaatcacacattgcattaggttgtcatgtctcttttattttgcttttaatagtttattttagaagaaaattatccagaaatgcatggggaaagctgagagtattatttaattatcagtgtagttagcattttgtagtcaatagtgactctaatactttttatctgattgttcatggtgaacagataaaatcaaaagtaatattacaaaattccttatatgagaaacatatcaaactagatatattatgtatatacaatagtgttagattgcttacaatttttaattgccattgaataaataatccaaataggagaatatacttgcttacttctttgttgacacagaatttaaaactcatgtatttattaatttattgtttatcagatcactgtgcaaacaatacttgcattaactttaaagcttttttactttcatcatgcattctatcataaatttcttatttaagcatctaataatttctggggtgacttttttttcttcttatttctaggagatagtcttacagttccgacaaaacttagccaatatgaaaggcaaggtgaaataaaaacatcattgcatgggaaaccaaagactgacattgctgcttttgaaaatggaggtgagttaatttattactgattgaccctgaatatatcaccacataataaatgagtctgaattttatcttttacaactaattttctttttttgtccatgtcatgtttaacacaagagtttggaggtatatcacaaaatcagttgctttcagagaccaaaatctctgccaaataccttgtgcgaatttgtgttcagtgtataagacattccatttttcatattttaatgagaaacctgtgtgtgtgtgtgcatgtatgtgtgtgtgtgtgtgtctgtgtgtaggctcaactccagactataatgaattcaggtgttatgtatgtgctgtaatatactataacagagctataaatgaaggaggcacttaataaatcatttgattaagtctactttttatttatctacttatttatttatttatttatttatttatgagatggaagtctcactttgtcacctaggctggagtgcagtggtgcgatctcggctcactgcaacctccatctcccgagttcaagctattctcctgcctcagcctcctaagtagctggcactacaggtgcgtgccaccacacccggctaatttttgtatttttagtagagacggggtttcaccatgttggtcaggctggcctcaaactccttacctcaggtgatttgcccgccttggcctcccaaagtgctgggattacaggcacgagccaccgagcccagtggacttaaagtctactttaaaggagctatattcaaatatatatcatttgtcatcacattctaactgtgtattatagcttaaatattttggaactgctttttagcataaacatgttggaaaatctgtcctttgactgaaaattccaagcgtttgttttgaaaatatatagagattttgtggggaggttgaaaggtgtggctgatgggaagaatgtgtgtgaagagtaggaaggaggttgagagcaggtatcagtaagtaccagtatctcttaggcatattggtgatactttctgctgtcctggtgtcagccattttcttctgtgtgccccccactgccctttttttttggtgctaaggtaatttgattattttttctcctttcttacatctgcagcagttttagtctagctgttttagtctagctgtaattgttttagtctagctgtaattgtttggttgccttgaagcaataagttttagctacaaattagaaacactggcagtctctcctaacggagttcccactgtctatttaacctatataagtgggatccacttaacccgagcagttctaatcgaacagtttgttgaaatatcattaaatcagatagcttttttggttaataaaaggttatttttaaccattgatagactaatggtttcatataaaaataaactttccttcacgttgtaacattaataatatattacctactttgttgggagttagaaaatgtgagaatgtcattatactgtcattagcctaatattaataatattgttagagtaatgaactagttgaaaaaccatactaaaagaatatttaaaaaattccattatctggtatactaagttctggtatagtcaagcttattgattttccaggcatcataatgttctctgtgtcactagataaaataatcttctgggtatgtgtatatgatagatatatctaaacatatttaggctcctgcattcataagacatctttgaaatgaagatgatcaaaactgaaattataattaatgaattagtattcatttcaagaaaaatacttgaggcattgtcttgtcttaatattattttaatgtgttattgcactttaataaagttcacagatctgaagtgaatagcttgttaaaattttacttgtgtatgtatcaatataaccatatttatggtactccagatggctctttctctccaagtcaatagtcttctcccagtggtaaccagtactctggtcgctattactataggctaattttgcattttttgacctttatataagtggaaatatacagtttgaactcttagtttggattcttttacttaatgctctttgtattagactgatccatgatgttgattgtagcagtaaatctctatagatagatagatatataccacatatatacacacatatctacatgtaagacatatactgtatatgtgtacatatatatgaaaacaaacgtgggcatttctctctctatgtatatagtatatatatacacacagttgatacacacacaaacacacacacaattgattcttgttattcctggttgctatatataaagctgacatgaacactgaattagcaaacactgaaccattgctcctcggggaactatgtacacacacacatatacctacatctcacacagattataatcttaaatcgtagaaattactcatcctggtatattctgttttccttattttacaaaagagaaaacaaagttcagaagtcttaagtgactctcttgaggttgcctcactaacaagcctcagaactgggactcaaaccccttccacctctccccagagccagagcttcttccaccatgctgtgctgccctctcctgtctccagccattctctgatcatctctgtatgaactgaaatgagaatgctgagcactgccattgttagacctcagctaggaatgtgcgggtccagcaactcaaaattttcaccactctgcgtacgtttgcaaacaacaaacaaacataaaaacaatgcatgaaagcaccatgagtattgatattgggatttgacagacaatatttccagtttgggactattattaacattcttgtacatgtcttctaaaggccatatgcacaccttttctttgagattagcttgctctgtatccttacccacaattagtattttcagtcctttaactttagcctttctggtgagtggctagtggtacatcattgtagttttaatttgtatttccttgatgactcataatgttagcaccttttcataaacttattggccattttgactttctcttttgtctggtgcatttttaagtctctagcccatttaaaatatttttttcttattgacttctctagataaatctggatactttctgacaacctactgtcctgttcactaattctcttcctctctgctctttaatccgtattttaaattctaaatttctatttgaccttcttattgattttctacttaaattctccatcagttctctattttgataatgttcttgttattttttgcaacttcctgtttgattacgcttggatatctttcattttcctcaggtttttgctcaattgtcctgtcttactatgccttctaatattttatttgatgctgaacaatatggataaaaattacatagtgtatgaatgatgttatttctccacagagaaacttttctcctggcaggcagctagactatcagcagaccaccttgattctgtgaaggactagctttgggctttattagggatgatgccgtagatgatacattatttttcctttctttgaaggtatagtccttattcctcggacaagacccttacccctaaagcattgctttactgggttatcaactgagacatgggatgttcaccaagatacctctactctggcaaagctcgaatgccaaattttacctcccaagcagtatgtagatgctgaaatctctgaccagtttttagcctcccagatgcagtttttgcttatttcctagggttccacactgtacctgaaaagtatgggagtcagataacagtttaaagggagttttatgcctatttcagaggaacttctttgttgttcttcttttttcatttccccctcaatttcaaaccaattagatagtcccagactttcggctctttctttttcacctccttggtgtcgctttctgcttgttatttccttacatgatgaattagacatgctttcagggaaaaatccgtagtaagtgtggagcgtaactccttcagggaaaaaagccagggtgaatgtgaacatacaattgactttgtgtccttccattgctctcaggcattgcagtcacatgcattgggttgttttccaatcagtttgttttggtattttatagttgtttttgggatgaaagttattctaataaaagccattttggtcatggtagaaaccaaaaatctttttgacatttttatcactggttttgtgtaagctccttgaggctaggaactgtgtataatcaatcactatagataaatctctgtagtagaatgcctggcacattatgtgcactcagtaaatacttgtagaataaaggatgatatgttcaaatgcattgaatgactgggtgaatgtagacatgtttataaaatttacagttaactggaggttaatctgttggaacaatgagccaaatcttacagggtaacttcaagcaatgataaacatacattcttacatttaggtacaaaacattaaatagtggcttttctttaatttgggaaaaacccagtatgatggcgtttttgaggggaaaatagagtgagtttttttggccacaatgttttacaacaatttaggcgtgtgttttcactaccaaatagcgatggtaaagtcacattggattattagaggcagtatagaaagatagttaaatgtgatttaaagtactcagtaaagggtcagattcctagaaaattactccatgaatggcaagtattattttactagttctgctgatttctccacagcttagttcacatttgggtgtcattttaaaataaggttatttgaaacaaatatgttaagaaaaggtaatgtatggtgaagaattttggaattttgtatgtaacatttaaagcaactatggatatttatcctggaaaatagaagttcttggggaaatatggaaactgctttaatatatctgaagatgttatatggaagataaattacatttactctgagtatctctaaagggtgggactaaagattattatacattaaggaaaattttgttgactctgaattttcttgcaattatctatatgtaagtttacatactgcatattcatatacatatatattaatactcatgtattaatctaagcatataaatgtatggagatggatatggtatcactgagaagtgtccaaagaaaggtgaacaaaaggggtattgtagaaaatgttcctgtattgaaagctagtttgtatcactttctgccattgttgccactgacagtaaggttttgtcataggaggtgactgttatgttccacagagggtcatatttcttggagtcgatgaaagtgaagctttaactgaagagaaagaaatcaccatatcaaaatgttcaaatactaaaggtaatgaatattatataattttgattcatttgtaatttggctaggcaagttaaagacaagcttgcttgttataaaaaccaatagaggaatggtaataaatcaaaatatacactgaataggagtcaagagctctaaggttccagtcctggctctgcccctaactgtatgaccatttttttgttttcttacctgaaaaatagcctgttggactgtataatttctagtattgctagttctaaagttactggttctcttaaatggcaataccaagtcctttaatttataatatcagtataaatgaattttgttagaaaacgttgtttgtgaacattgtgaagagtttaatctcaaaaagacttttgtattttataattgttgctaacactagtctgtgaataatcaagagatatgataaaatacatcctctatagttttacactgcccttaactgtacttaaaaatccaccagctgttatctctctgctgagtgcctctcagtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1745 - DNA, 572 bp, Homo sapiens
gtgtaagaagtgcctttcacctcctgccatgattctgaggcctccccagccatgtggaactggttcccagtgccgattccgacactgtgaagaggcccttggcagtgacactgtgtgctcattatggagagagaggaaatgtttagatccactttgcagatttagacacatggaaatgcagcaaaactgcagcatttcatgcttctgggaaactcagcctcttggttgtgtgaagatcagctgtatcttttatcacagcaaacctcgaaatatcaatggattatttttgccaccaagtagcaatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatggggaatactacagatttcatactcctccagatattttgtcatcaaaaagcatgacacctacagcagaaaaacagttagaaaagcctttggaaaatggcagtgaattgcaagaag

SEQ ID NO: 1746 - protein, 191 aa, Homo sapiens
  VARIANT (1)...(191): Xaa = Any Amino Acid
CKKCLSPPAMILRPPQPCGTGSQCRFRHCEEALGSDTVCSLWRERKCLDPLCRFRHMEMQQNCSISCFWETQPLGCVKISCIFYHSKPRNINGLFLPPSSNITLQKEIQEGIPLQSQSQEPLKPQENISRPIHHPLVLKTNFEEEEEVDEQNGEYYRFHTPPDILSSKSMTPTAEKQLEKPLENGSELQEX

SEQ ID NO: 1747 - DNA, 80321 bp, Mus musculus
  misc_feature (1)...(80321): n = A,T,C or G
acacacacacacacacacacacacacacacacacacacacacacacaaagacacagagaaaccttgtctcaaccccacaccccaacacacacacacacacacacacacacacacacacacacacacacacacacacacacacacacacaaagacactcaaagatataagacttgctaaggtggcccaaaagagaacgtcagtgccagcgatgtacacgtacactcatattttccacaccataccatcttagcagaattcacttagatcgcagcgagggagctgctctgctacgtacgaaaccccgacccagaagcaggtcgtctacgaatggtttagcgccaggttccacacgaacgtgcgttcaacgtgacgggcgagagggcggccccctttccggccgcaccccgtttcccaagacgaacggctctccgcaccggaccccggtcccgacgcccggcggggggagaccccgcgccgccgcggggacgacgcggggaccccgccgagcggggacggacggggacccggctatccggggccaaccgaggctccttcggcgctgccgtatcgttccgcctgggcgggattctgacttagaggcgttcagtcataatcccacagatggtagcttcgccccattggctcctcagccaagcacatacaccaaatgtatttcactcatgcagtggcacctcttgttttgggagggacttaagtggccatgacaataccaaaactaggcaggtcaattatctatggacttgtcctttttttttttttttttttttttttttggtttttcgagacagggtttctctgtgcagccctggctgtcctggaactcactctagaccaggctggcctcgaactcagaaatccgccgcctctgcctcccgagggctgggattaaaggcgtggccaccattgcccggctgggacttgtcttttcacaagacggtccagaggcgtcacactgtgatgtgacagatagggacatgtggagtattgacaagcaacatgccaggacgtctcgtccgagaagccaggcacacatcctctttgtggctggagagtgaaggaagcacacaatgagcattgcatcgcctgtgtgtgtgtgtgtaccgcctgtgtgtgcatcacctgtgggtgtgtgcatcgcctgtgtgtgtgcatcttgtagctttggaaagcttagtgcgagacacaaggccagtctttgctaggcagcgatctgctctaactgaaggatgaggatgtattattagagagttggctagaacagggcaactgggttgggttgtagctcagtgatagagtacttgtctagcatgtgtgaggtcctgagttcaatccccagaactaccaaaacaaataacttgttcttcgtgtagttcctgaggactgcccaggactgttgatttctctttaaacttggatgtggtgagctctctcctgacaccacacttcagcagctttattgactctggtaccctaacccatctgatagatgttatagggacccattttctagaataaattgtatgtatgtgcgtgtgcatgtgtgtggtagagattgggggggggaatagaaacaccctctttcagaaggggcctgtaacattctgtagcttcatttgcctatctggtaaatgggctcattataccataaggccagtgatctgttatgggagtctcagaaacgaagtgccctgcctggccctgcactccctgttccttatctttgagtaactggctaaggcagggattgcagttcacacctgtaactccagcacttagaaagcagaggcacaagactcaccacaagtttaaggctaccctggcttaaggccagccagggctacataaacagatcgtttctcaaagtcttaaacaaaagaaaacaaagaaaaagaatgtacccgagtccctgatcaagctgacttaacacatagactgctggccgcatgtaggctttcatgtgcggttactgattttcatcccaggagaaaatgtagtgttgagagttttgcaaagcagatactgagcattcactgttctgtaagggaagtggtgggaaaggccagctccggcgaagagcagcccagctagcaattaagggttttcccgcatcacagctagccggctgctgagacggaggggtgagctttcttggtgatggaggatcgcctgtttcctggtgattctcagagaacacttgtctgctgagtgctgtcacttcattctcctactcccgcctccctgctcctgtcgttagttaaaaccccacgtaactagaggagcgctgtgggaagcctctcaattctcccacctggttagtgcagcaggcatcttcagatacacgatggatctagacttgtggctaaggttagctttcggtgtggggtcattagcactttgagtcaggaagcttcctagcgctgtctgataatctgtggagcaagctgcgttctttctgtccccagttctggggtggaagttctgtggttttgtgggaaatttgtactccttaattctgtgcttcaatttctttgggaaactttctgaaatagaaatgtttgctaccactatcatgtattttgggcttatggactatttaaataaaattaatcttaaaatttttactgctaagcattagcactcattataagacttattttgctctaatgtaaaattagttatactaagcaatgccctgtctttagtgtatatgtgtgtgtgcatgatgcatgtgtgcgtgctgtgtgtgtgtatgtgtgtgtattttatatatatatttttttctccacacagctatgcaaccatattgctaatagaaaaaagtgtcagtatgttggcaactgttcctttgctcatagtccagaggagcgggaagtgtggacttacatgaaggataacaaaagtaagttcgtgctctctgtccttgatacccttagcacagcatgcagcgtgcacatttcagctgcagctctagtggtgctgctgctgctgctgcttgcggggagcataaccacggcttccttggtgtggaagctgactggtgctgtgcatttgcttaggccacacttggtgtgagtctgtactatgcatcctgcatagaataggtaagtagcctccttaaaagttgtcccgtgtgacagctcggctcccctaggactccagacaagatcagttgtggccatcaggtagatgggagtttgacagctgcttcagacaacagttcacttttgaatctaaatagttttacttcagattttttgtttgttttggtttttttctttctttttctaacagatgtatttattttatgtatatgagtacactgtagctgtcttcagacacaccagaagatgcattgggtcccattacagatggttgtgagccaccatatagttgctgggaattgaactcaggacctctggaagagcagtcagtgctcttaactgctgagccatctctctagcctttgttttgtttttcaagacagggtttctctatgtagctcttgctgtcctggaactcaacctgtagaccaggctgaccgaaaattcagagatccacctgcctcggtccccccccaccccccggagtacttggagtaaagatgtgcaccacatttgttttgaaggtgtagcaacaggcaggcagtccatgtgcttatgtggatttgaatggcatttcgtagtttgctgaacacggttcctttttcttcagtacatgatatagagcaattttatgaactctggctgaagaaccaaaaaactgaaaaaagtgatgagacagccagtcactgtagcaaagaaaacgggaagcagatccatatgccaacagactatgctgaagtcactgtaagtcactgctcacacgcctgcttcagggcttactcccttctccaaagcttgactgtctctgcagcctgtctctgtctgctgtcttttttcttctgtgcttttttgccattagcttaagtctccttgtgctgaaatgatcttgcttaagtcttaattttaaaaccataaagaagctaggttgggaagtagcccagttggtagagctgttgtttaacatgcatacaactctgggtttaatctccagtaccgcataagctggatgtggtggtgcacgcttttaatcccagcactcttgggagttccagactgtagggccagaaatcgaaggtcatctttggatgcctgcaaattggaagccatcctgggttatatgagaacctatctcaaaagccaaaagtgacacgaggagatatacacctttcagctcatcacttgggaagcagaggcaggtgatctcttgagttcaaagccagcctcttatagcaacttttaggtcagctaaggctccacagtgagacctttgtaaaaagtaaagaaaacatgaatggcttgagcccatcactcctagttatatgatgttaatgtgctttgtctgtaaaataagcactgtagataaagttgaaagtatgtctgttctttccagaggaaccagatccacttggcgtatttctctatgctaagtttatatacatcagtgatgtggttctcctcttcttcccccctttaaatgaaaggcagaggttcactctgtagcccaggctgatcttgaatttgagcaatcatctttacttagcctccagagcactgggattatagatgtgagctaccatacctggccattattatgtggctattgttcgtttgtagtcagcctggcatattgagcacccggcagttttgtgtgtgtgtgtgtgtgtgtgtgtgtgtgtgtgtgtgtgtgtgtgtgttcgtgttctctgtgggtgtgtgggtgtgtttgtgtttgcatgcgcatgcgtgttcctgccacttgtttcctgttttcaaccctgcatcttacccatgtccaccaccactgcaggactgtctgtcctggtcttgtgtgtgtgctcaggacacatgtgagtatggatgttttatgtgtatctctgtctttgcagggccagcatctttactttctgggtgcctgatgcaaatctagtgttgttgagagactcacttgtgtagaattgctgctggttattctagagctggcctgctctgaccttgtgctgctcctgcttttcctcagggtgttaattctgcccagaatacttaactgcctttcaaatgacctagtttgtacagcagcttctctggatgagcactacttagcttcttgtgctttggcttctgtccccatactgtagttggtcctgtactgatactatgtctggttttggattatatgtcccttgcctggcttccccagagtgaagcctggactaatctcaggcagcagtgagaggtccaggctctcaggcagcacatctccctgcactcttaggtggacttccactgctggatgtgtgggaagaactgtaacagtgagaagcaatggcaagaccacatctcctctgagaagcacaaggagaaggttttccacactgaggatgaccagtactgctggcagcaccgcttccccactgggtacttcagtatttgtgagaggtgtgtaggcccctgagggttccctgtggagagggctgagcccatggcccttccatggtctttttatctgcagctagagtaggaagtgggtggtagcctggtgctgtgacctggcaggcgctggggcccccaggaagggtatccaggtgcacctgcccacactttcaccacctttggagtttcagagctctggcatgtctttgctcataatcaatgctcagaaaattagtggcttttaagttatattttctatataaacttagaatatagcattgggttggagggatggcttagcagcaggagtggttgggttggggagtggggggaggggataggggatttttggaggggaaactaggaaaggggataacatttgaaatgtaaataaagggaatatctaataaaaaaaaagaatatagcattgggttggagggatggcttagcagtcaggagcacctgctgctttttgagaggccccagatctgcttcttattacacatatcaagtggcttacagctacctgtaacttcagttccaagggatgagacatgatctttcagtctcatacatactcaggcatattcatatacatataaaataaaaaacaagtactaggtggtggtggcacacacctttagtcccatcattctggagacagagtcaggcagatctctgagttcaaggctaacctggtctacagagtgagttccaggatagccagggatgcacagagaaaccctgtcttgaagaaaaaaaaaaccctccctcaaaattactgtttgtatttacttactaaatttagagcctctgacttggggacacaatcagagttatgggatgcataaggcccaatatcacaagaaaacaaaaataaagaatcttgttggataattttaaatatcataaaatccttaaaatatttttctttttacataccttgcccccaaactgaggcagggaagatgatccagcaggtttgagcactacttactggacaggcatgaggacctgagttcaagcctccaaaatccatgtgaaaagccagacatgtttgcctataggaagggcagggacagagggcggttggagcttagatcccagcagcctcacttagtttgggtgaggtactctttaagggaatcaggtggagagcaatgtagccgggcacccagtgacctcctttatgtccaacacttctcactgagctaggcccccagcccttgcaggacttgctgacggacaaacacttttaaatagttcatagtactaattccctgttgtgtatattgtgtccatagaagatttatgtcccgggcttacgtttcctaagtgggtctgggatgcagctctgtggttaggaacatgtacttagtaggcaggaggccctctgttttatccccagcagcaaaaagagagagggaaaatgccaactttatgactgcagaagatgtatgcagatcagacacacagctggaggagaatgtgttttcaagagtcatgaccctatttctaattgcatcatatactcctaacaggtatataaatggctcctgcacagaaggaagcagctgtaaatttgcacatggaaatgctgaacttcatgaatgggaagaaagaagaaaggccctacagatgaaattcaagaaagcacggaaagatcacttaattgccccaaatgataatgactttggaaaatatagttttttgtttaaagatttaaagtaatatgctggcttttatgtaacccaatcagagcactgaccagaaaaattgcaagtgttgagaggcacacagcagaagagctgcagatttctgcttgattggcatctatcgttcctcctgagcagcaacccacagtagataggaaaaaggctgtttgacaggcctggctaagctcttgcggagccactggcatcagatggcgaagggacttgctgccaggttgctgtctgttggacagaagctcggatgaggtgtgctggggaaggggtaaggttgaggatgactctgaggtcagagccacagcagtgagtgtaatgcacagtgggatcggagtacatgatggatgaaattccttatgtgttttagtggaatgaagttatttaatataataaagtctgctacttatctgtatgtaggttgctaaaaaggattttcttaactcagatttttaagccaaataaccatttagcactagtgtctgttaaatgggtttttctgtatttgtctgtctcactgtggcaagggaaccgatgatgatcatgcacatcaatatttggaaaataatcaattgacacaaattttatttcttggtcttttgctgtttaaataatgatttttgaaagattcaacttgtactgctggtattgtgtagtgtatggaccaatattgcttgtaataaaagatcttacatagagatgactttcatagttttggtgtggtcctttctccttcaggagttattggaactgggttttagagaggttttgtttgctttttggtgtgtggggtgctggggcttaagcctagcaccttgtctgtgttaagtggacactgtgcctttgaacatagaaatagctatgaacaagacacatagaaaagctcgtctccctgcagccctgatagctttcagaggcagggagcagcaaggagggaggaaagcagcagggcagtggttggtgggccagggtgctcagcatgctgcctgtgaggcaggggctccacgaagaaccagtctgttagttgcctgatcagaatcacttcctcaggacgaagctcaagaggtaggatgctgagaagcctaggaaagagtttgggcaaactgcaggttgttaaggtgagtagtgtgtggggtgggggtgggagatgggggtcacctccaggactctggtgatagtatggaaaactaatactaactggcacatgttaggacttggttatctccattgggtggttttgttaaaataatcttacaattttatgtgtacaacattataaccagtgcccatggaggtccgatcccctagcactagagctataaacttttatgagcctcgtgtggatgctgggaattgaacactggtcttctagaacaaccagtgctcttttaatcactgagcaatctctccagccccacataggaaacatttgatctagattattttgccctccctaccaactttacaaaaagattttatttttaattatatgtgtgtgtaccttggaggacatcagattacctgaagtatgaggtagttcactacctgtaatttagaaccaaacttgggttttctgcaacagcagtattcttactactgagccttgtctccagccccaaccaaaactttattttgaaatagggccttgctaaatttcatagtctggccttgaaaactctatgcagtcctggtacaagtggtcctctggttttctcgagtggttgggaccacagttgtgtgccactaagcctggtttaaaaaattatacacaactcatataaacctaattttgggaggaaaaatgaagataattcaccctgtatcttaggctggccttgcattcttattgcttggaggcgtgaggcagacaatgtcctgactccaatactttccaaactttaatcacgtctgctatgtttctgtggatttgcccatcaagcatgggtcatagaaatgggattacacaatatacatccatccttttacttagagctgggttcttttgttgaatgtaattaccacttatcagtacttgtctcaaggtttctactgttgtaataaacacatgaacaaaagctacttggggagggaagggtttgttttggttacactttaccatcattgaaggaagtcaaggtagaatcctgcaagcagaaactgaagcagaaggcatgcagcgttattactaccccattacagagcagcccggtctccgttttattactgtgtcctccagtccttctcgcctctgcacgaggcctccccgccccactttctgaaaagcagagataacaaactgcacccatgtcctgaagggtctgtcaacagtgttgacgcactagcgacaatctgagccctaacagtacccggaagggccgaccaacggaaggactcgctaaggagacaccaccaactagcttccggacgcgaggatgtagcgtcagcgcagtgaatgaaggacaaggtctagcttgagtgactgcaagcctgcgcagagtcgctacaagagaggcgggaccggtggaaggctgacgcggccgcgagtgctgcgagcacccgcgcagactccatgggctcgagggcgtggcccccaaagggcgtggcttcgcgggaagccggcattcgcgcaggctccgagtcggagggcggggcatctctgaagtgtggctgacgtggagagtccgggttagtgagcgccgctggctgcgaggtccgggagtgacgtgcggggccgggtccccgggcccgaggtggcggcagcgacggtataaagccggccacggggagcatgtaatgtcggaatgcggaggccgcggcggcggcggcgggaacaacagcgaggacgccgaggacgagggtggcggccccaagggctcaggctccctcagccctgccggggcggcggcgtccttggagggccggatccgccgcggcttgcgcggcgcctcgcttatggcgcgccagcggccagagctgctgtgcggggccgtggctctcggctgcgccctgctcttcgccctcaagttcacttgcaggtgaggctgccgggactcaggctccgcggccagagctatgccaccccggctgcgcggggccagctcggggcctccggggtcgagggttgtttgtcttcctcggggaagtcgagcctgaccttgcctgcgaccacaggcttgaccttcccggcggccgcggtcccccactctcctagttcggcgtggaggcgtttccagggtgctgctctatatcaattatgtaccgagggcgtttggccctgtttctgagctgcttctcacctgttggggtctctcggggtgcacatgtcaattcttgctcaggctataatgctcagttttaattcattccattttccttaatgcttgcagtgtgatgattcacaagccatttaggggtcttagtcgcttttgggaatccaggcaagcctttgatatactgacagtgcacgtttgtactgagcacccgttaatgctgaagacaaaaatccccgttccctggagttctcattgaagtgatgatatacaataaacaaacacttcagagaccttaataagtgctatgcagggaatagaaggatgaggttgggtagggcagaaagggccttcataggaaaatggcattagccacttacacaaggaaaggaaggggcagaggtggaagagctggggtaagagctattacaaaacagttaagtgcaaagatctggagtctgagcaagcttggtctttttgtgaaacttggaaaaggcctgagtaggctggagtttaggaagaatggaagctaatgtgcatcttttcagaaaattgtgtagatagatacaaagtttatatttcaattatactccttgcctcagatcatcagtatatcatttgacattgcagtttataaaatctgttatcacttgacatatcctcttggcacttctgtccagagggagatttatgtgggcacagattgagtgtaatgaacacaatatgagatccctgaggtcaagatgggccaaaaattaggagttttagggggaagagactcgtttttttagtgtttgcaatgtgttaggtgctatgctaaagtgtttaaagccaactaaaagtgtttgtcaccacacctggcctggagtttgaatcttgagcaactagactggtactgtctttataaggaaaatacagaaagtattttacaaggtggaatgttgcaacctgtcatttggattcatattaacagtccttttcccacgtcaaggaattgatttacttcagtttgcccagctgtgaaaacagtgctcagtgtttgatctgagacacgtgacttggtgggtgacctctgagagaagattgaagagtttaaatcagtctgaggagctgtcaggatgagctcctcaactgcttttggctgggagagagagcctgcagcctcacttcctcaagcatctttctatggtgctggcaatgggacagcccttttaataaactcatatgaatttttaaggactttgtttgataggatggtgttaagatattatggtacaactgaccctgacatctttgttgctctttccttaagatctttaataaggacagaggcttcaggaagaatatatcaggtctgtttttcaaatttaattttattcatagtacaactctgaaataaatgactgccctcctcagtgttgagtgcttagcttagttcagagtaggtggtctataagaaggtgaatttggagttgaaccacagtgagttactgtgggtgttcagggcctctgatctttgcccacttctgtttatgggcactcagtctccatgaatccattctgctttcttttctgtgtttgtttattaggagtaaagtggcattgtgtatagttgcctttaggagggagatttaaggtatagatttcatttcaatcgaatttacaagctagcagtatggcttagtgggcaaagcacttaactgcacaagcctgacaatgtgagtttcatcttcgagctcacggtggaagcagagaacagattcaggttatctttgacttccatgggaatgcctgcactcacacacatgtgcacaggcagtaaacaatagctttttctttttttttctcctaagacagggtttctctgtgtaatcctggctgtcctggaactcactgtgtagaccaagctggccttatactcaagagatccacctgcctctgcatccctgagtgctgggattgaaggcctgggccaccacacctggccatcttttttgtttttaaacatgcctttatttttcactaccaattcttgtttttgtttgtgctacacaaacttaagagttgtaggaagtctctgatttacatgtaatttttgaaaaatgtaaagcaaaacttgagagattgatgaaaagggtctgtggtagagcagagggccgtgtttctctttcctggctgtttagtttttgtttggtttgtgttttatctgacttttaactttaagaactcctctgcacctgtaaacaaataataagttgatgtcacctggatttatccccagattgcattattttatgctaagcgtgcaggttttctttttgtttctttttgggcctaggcctcatgtagtccaaggtgatttcagactcctgatcctactgccttctccactcaagtgctttcattacaggtgtgtataaccatgcttggctttaaataaaacaaaaaccaaaaaaccaaacaaacactgaattatgtgtgtatgtctaaatgcgcatctgtgtgggtttgtgcacatgagtgcaagtacccacagatcccagaggcattggatgccccagaacctgagtcacaggtggctctgggcacacaggtgctgggaagcaagcttggtactgctcttgtaggtactctcctaactgctgagttttttttttttttttttttttccattttttattaggtatttaactcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttggctactttctctagctcctccattgggagccctatgatccatccattagctgactgtgagcatccacttatgtgtttgctaggccccggcatagtctcacaagagacagctacatctgggtcctttcaataaactgctgagctcttaacagtcccctgactttgtatttgagtctcactttaacccaggctggcctggagcttattgtcctgtctagctgtctgaatgctggaattataaatgtgtgccatcatgctcaatttaacttgcatttgaatggtaggaaaataattccaccaatgaacaacctttagaatctcttcagaacacatttcnnnnnnnnnnnnnnnnnnnnacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttggctactttctctagctcctccattgggagccctatgatccatccattagctgactgtgagcatccacaggtggctctgggcacacaggtgctgggaagcaagcttggtactgctcttgtaggtactctcctaactgctgagctcttaacagtcccctgactttgtatttgagtttcactttaacccaggctggcctggagcttattgtccaggctagctgtctgaatgctggaattataaatgtgtgccatcatgctcaatttaacttgcatttgaatggtaggaaaataattccaccaatgaacaacctttagaatctcttcagaacacatttcctcacctctgtgtacagttatctgcttgtctgtcattcaggcctcacttaagagatacttggttaccacctcatcagaagctgccatgtccccgaattatagctctatactgagttctcccacaacaatggccattttgtgtaacttttattgctgattgtttatgtacctgtttctttgccatcttcctcctctaggaagaaagctcttggcagcagcctctgcctgtgtctgagccatagagcagttactcaggcagtttgtctttgtaggtattttgttccctcttctaaaaaggatggaagtatccacactttggtcttccttctgcctgagcttcatgtggtctgtgaattgtgtcttgggtattccgagcttttggattaatatccacttatcagtgagtgcatgtgtattcttttgtgactgggttacctcactcaggatgatattttctagttccatccatttacctaagaatttcatgaagtcattgggttttttttgttttgttttgttttcgaggcagggtttctctgtgtagccatggctgtcctggaactcactctgtagaccaggctggcctcgaactcagaaatccacctgcctctgcctcccaagtgctaggattaaaggcgtgcaccaccaccgcctggcgaagtcattgtttttaatagctgagtagtactccattgtgtaaaagtaccacattttctgtatgcattcccctgttgaagggcatctgggttctttccagcttctggctattataaataaggctgctatgaacatagtggagcatgtatccttgttatatgttggaacatctttttggtatatgcccaggaatggcatagctgggtcctcaggtagtactatgttcaattttctgaggaaccgtcagactgatttccagagtggttttaccagcttgcaatcccaccagcaatggaggagtgttcctctttttttacatcctccccagcatctgctttcacctgagtttttgatcttagccattctgacagatttgaggtggaatctcagggttgttttgatttgcatttccctgatgactaaggatgttgaacatttctttaggtgcttctcagccatttggtattcctcagttgagaattctttgtttagctctgtaccccatttttaatagggttctttagttctctggagtccagcttcttgagttctttgtatatattggatattagccttctatcagatgtaggggtggtaaagatcttagcagtcatttcttagttgaatggcttaatctttttaaattgtgattattgatacagttgttttcatttgtaccttctgcgttttattttttctttgctcctttactttcttttggtgtaatgtattgttttagggcactgtggcagggctttatgctctagcattgtatccatgtgcctgatgggagaattgtagcctctctgactgtggggaacctttccagttaaggctcttactatattcttcatctttcttatcacggattagtattagtgtgtagaattctatgttctagttgcttttccctgaatgctctggatagatataggtcaactccccttaataaattatgttttctaaaagttgagtcacctgtaaatgtctcctataggaactgtactcatggtgctgtatacggtttcctcagacttgtgagcaatagagcagtagcagcagtgcctggagatcagtggcttttgttgactgtcgggctacaatgttgaaattttgggttgtgagcggtgagaccgtggagcgtgtcattatttactgcttccctaacccacacctgcagggacaatgcccagcatctgtactgtcccagccaggtgttgccttagcatggtgtattggtttctgttcagggcggtgacttgcaagctcttaatttcttactcaaaagaggcctttaaaaaaagtcttctctcttcttccgtacaaaagtgtaatggaagaaaataagtaagtggagaaattgtttgtgtttactcttttttagtcgagcaaaagacgtgataataccagcaaagccgcctgtcagctttttctcctcgagatctccggtccttgacctcttccaggggcagctggactatgctgaccatgtccgccaggattctgaggtggtggtgctgttcttctatgccccgtggtgtggccagtccatcgctgccagggcagaaattgagcaggcagccagccggctttctgatcaggtaatgtgtgctttcacccaagcggtgactgtcaagtctatattagagaagatggcctctcagagaaatgatgccagactggccgtgatatccaggcaaactccggggccttgtcaggtgcaaagcttgtgaagaaacaggaacaagaatcctggcatgaggtcaagtggcaagagtaagcttcagttctgtagcttcaggagatgtgtgcttgcccaggataccaggttgtgggatacagtgctgaagatagtagagaccaagaaccccagctctctcatgtccagcttatgtggcttgtaagccttttatgttgtaagtggcacacaggccatggtgaatgtgtggagttagcagacagcttgaaggagtcggtactcctctactatgtagccaactacttaaatgtttatacaggaaaaattcatgaataaaaagactaaatgttgccaggtgtggtgacacacacttttaatcccagcacttaggaggctaaggcaggcagacccctgagttgcaggtcagccacatctacaaagtgagttctaggacagtgaaggctacacagagaaaccctgtccaaacaaacaaacaaacaaacaaaaaaacaaacaaacaaaaaaactgattgaaggtacttcccaccaagcctgatgacctgagttaaaatctttggggtcagttctctcctgcctttctgtgggttttagggattaaacacaagtcaccaagcttttgtggcaagtgcctttacctgctgatccatttcactggtcccttggtaatataaagtgtgtgtgtgtgtgtgtgtgtgtgtgtgtgtgtgtgtatgtatgtatatatatatatatgtatatatgtgtgtgtgtttatatatgtatacatacatatatatgtgtgtgtatatatatatatatatgtatgtatgtatgtatgtatgtatgtatatatatatatatataaaaattttatgtgtatgggtgtgttgtctgtatgtaccacatatgtgcctggtgcattaggaggtcagaagagggtaccttctctcctgtaactggagctacatattggtggttgtgatctaccatgtgggtgctgggaactgaacccccacttttgaaagggcagcagtgctcttaaatgctgagccaattaccagccccagttaatttttgaggtagtgtttcttgtggtgaactctggtcttgagttcctgatacttctgcctcatcctcctgaggattagaggtgtgtaccatggcacacaaacctgaaaataactattttgtggtgccttcttttctgcatgtgaggcaacttatattttaaaacttctctatgcatatgatttcagagtaatgtagtcttagttttttaattgtaacaggtgggaacatggaaaagtaatctatagctaaatcctagatattttagttgttagtacacaggcaaagcattatgctttatgtagagccactgtgaatggagcagttacagatgtagaactgtggtaagaagtgatgagctgatggctcagatcccacagggacttactttataactggatccacaataggaagcagctcgtgggagagcccctaactaaatagagagatttctgtctcagtttatacagtagtctcattcctcagaatttccctgaacccttggattcacatgtaagatgggcttagaatctggatttggattgtaacagagcagacttttcctggtaaaaagtgctaggtaggtatttcaaactactactaccccgtgggatgacagggtgactttggcataatcaaagcagatttgagccttgcaggacttctctcaggaccttgttctccatgcatagtagctttgcgtaaccattgtagcaagtaaaaatagctccatagattcccaaggccgcgctgttgtagaaccataatctgagctaacttggacggagaaccctgagctgcagaagtcattcagaactcattctcagttgtttttctagaaataacaaatatttttaaatgatggctaggtgtcctatccagttctgcaaagccttttaagctattttatacctcaaggtataccaataataaggaactgtattccttacacagttcacatttcctgagaggaatctcaacattgggaggtagtgacaggagggttggagttcaatgccttcatcatctatatggtgagtttgaggctagcctgaactacatgagaccttgtctcaaaagaaagactatgtgaatgcatttgtgtgtgtgtgtgtgtgtattatgtgtgtgtgtaatgttcctgatacttctgcctcatcctcctgaggattagaggtgtgtaccatggcacacaaacctgaaaataactattttgtggtgccttcttttctgcatgtgaggcaacttacatttcatacataacacacacacataatacacacacacacagctgacaagatggcttagtaactaaaggttctttgtgtcaagcctgatgatctgaaaatgaaaagtaatatatcacatcattatgtcttatcaacttttcaggaaggaaatgggaattctaagggagccctgggcaagcactcagtatataagcataaaaagagcaccgctttcctagtcactcccctgttcttcagaatctggagagcaaaggtctgtctccaagtaggaagcacagagtttggaaactgtctcatcttaaggttaacttagtttgtaactgtttaagcaaagtgtgctgattagtgggatagtaacacagtattcctctgagccccaccatgctcatttcacagcagttcttcaaactggtgttttaactttggctttcttaagcagagtctctggtttgtaaaggcttagcagtctgctaacgtactggagttacagatgagggcttgtgccacccgcagtgatccaacctgttcatttcaggtccttctaaattgagaacttatagttctatgtacatagcagggaaaagagtgaatttatttttagaaaaagatagaactcatttgagccatattagtcaaattagcaagatggtatattgtgccttttgctttgttatgtttttttccaagacagggtttctctgtgtaagaagtcttggctcttctgggactgagtctggccttacacttacagagatccacctgcctctgccttctgagatgagctaccatgcccagctaatcatgccctatttttaagtaaagaaaatgagacttcaatgggtgaagattgttgctttagaaatgtccctagaagtggactctcgggggccagagagaccaatcagtggttagggagattgctgttcttccagaggacctgagtttggttctcaaaacccacatcagggacgtcacaattgcctgtgctgacctccaggaaaatgcacatgcacataacatacatttacagatataagtatataaatacaacttttaaaaaatggcctctaaaaactcagaagagtttgagcatttgtactgtatttgtgggcagaaagcatgtcaaggtggctttatgtttgctgacttcatattattttcttcatatcctcttgaaaaactttaaaatgtgttttaattttgtgtatgtatgtttccctgtgccacacgaatgctcagtgctcatagaagctgtagggcactgggtctctaggaaccggagttgcagatgattgtgagctgccatgggtgccagaaaccaaaccgaatcctctgggaatgctgggaatcatctctccaggcctagcaccccagccttcctgggtttcggttgtgggagctggttcattcctgttgtgggagccagggatggaactcagacccttaggcttgcccactggatcatctcactgaccctgaataacttatgaaaaacttgacacataccccaaaagtctgtgactgttgtcttgcttattttgtaatgtgatgtacccctctatagtcaggaagtcctccatagaggtagctctgctgctgagctcaggtcacagaaacatttggttgtgacacttgagaggtaataatggtgtcaggagggcagcggcaagaaagctgcaaattgctctaccctagttctaggacctcttgtacccaaaccagacaatcctgatccttcaggactacttcagtgtagggacacttgttctgactctttattaacagattgggaaactttcctctaaatactcaatatctacttgtaaatgtgtatttaactgatgtttctactttctagagctttctttttactttttaaaacatggcctaaatgttatctttattattttttaaaatagtcattgggctagagagattgctcagtgggtaaaggcatttgctaccaagcctaaggacctgagttcaattcctaggacgacgcgatgaaaagacaggttgtcctctgacctctaagagcatgctgtggtgtgtgtgtgtgtgtgtgtgtgtgtgtgtgtgtgtgtgtgtatgtgtgtgtgtgtgtgtgtgtgtgtgtgtggtgtgactcaacctaaggtctttcaaaggttaggcaagtgccctaatactgaacaacactactgactctcacctaaaatattcccttcagctgggcatgatggtgtatgcctttaatcctagaactctggaggctgaggcaggtagatttctaagagttcaagaccaacccagtcttcatactaagctccaggccagccaaggctatatagtgagatcctgtctcaataaataaataataaaatagaattaaaatcaaatcctttcaaagtactgctcatccattttaacattaaaaacaaatgattttcctcttgtgacaggcgcgaagagtcctaggtgaactatggagaagggtttgtctttctttgaaatttatgtatttatttttaagacggttttcatatatagccctggctggcttggaatttgctttgtagacctggcttgtttcaaacttcatgatctgtctccttttgcctcacaagtcctggggttaaaagcacgcatggttatttttcattaaaagaaaaaaggaaggatttattactattttattcagactgactgactgactgactgttttgcctgtgcatatgtctgtccaccacatgcctggagaaagcactggatcaccctgggggtggagctacaggacttataaatagtttcaaatcaccatattggtactgggaatcaaatccatgtcctttggaagagcagccagtgctcttctgagacagctctccatttcctatttttttatttttgcaattcattctgtagaccaggctagcctgtatataactcatggtaattcacctgcttcagctctctcactgccctcaccccactctaccctgccccttattcccatgcccagagttgggatcacaagcatgaactaccactgagcaattttatttagttgtaactatcaccttagaaagcttgaagcagggtttatttgtttcttgtttaataccttctgttctagcacggggaagtagttctgtttctacaattgtgagttttggtaactgttgagttgctattcatagtcatatgaaacctgttttgcctctgcaggtgttgtttgtggcaataaactgttggtggaaccaggggaaatgcagaaaacagaagcatttcttctattttcctgtgatacatctgtatcatcggaggtaagggcttgtgtttccagtcccacttgtattcatcagttgatcagggaacttttttatccaaaatgattagtcaatgtggaaaattaagaaaatgcagataggcaaaaataagtttaaaaaaagtaagggagtttgatgattacattagccatgtgcaacctggctgttttgattgtccttttctataaatatatatgtctgccctctagttgtaagcctgagatgtgatcggaaagaacgtaatattatttctgaaattgttcttctgtgaacataagtatgtttacatcagtgtatgtatgctacacactgtttttaaaagatgaattactccattgtatggctgtacattttagctactcaaaactgttagctacacaatacagaagtataccctgttccttagcctgttaacctgatagtgtagcatgctcaagataatagcttttgctaggcatggtgcctatgccagtaagctaagcttcttgggaggctgaggcaagaggattatttgaggccaacctggacaacttagtctcaaccagatagctgggaatattaatttagtaataatgggatttcctaacatgatcttgggcttcttccctagcctcgcaatgaggaggaggggatacagaaccatttctttcagttaagaagaaaattactagtattaattactactagtaatactcaagtgacagaggatggaaatccgcaagtttcatgattattttattttattgtttccagttgtattcattttgcctaaagagtcaagctacctgtggtttttattttagactattttgttcttgtttttttaatctttatttttagttatatgtatctgtgtgtgtctgtgtggtatgagcacatataaatgcagaatgtcatagcccttcgagctggagttacagacaattgtgagctcccaggcatggttgctggaaaccaaactctcgtcctttgcaagagcagttacatcctcttaactgtagagccatctctcttaggcccaagatttattttattatctatttatttattctttatgtgtgtgtgcttaatatatgtatgtatatgaactatatgcataccagaacttgaggcaatcgaaaggaaaacatcatatctggaactgtagctacaggggattctgagccatcaaattggtgctgggaatcaaatccaagttctctggaagaatagacaatgctcttaaccactgagccatctctccagcccatccatccatccatccatccattcgttcattcatttgtttgtttaatttgtgaaggggtgacaggaccttactatttatttatttatttgttggtttgattgtttgtgagtagtgacaggatctcaccatgtaatcctggctagcttggaactcaccatatcagccaaggttgtctggaacttggaaagattggctggcttttgttccctagtgctgaggttaaaggcatttgcagtcaagccttcctttgttggctaaggggtctcatgctgtagcctagcctggcctagaacgtagtggtcctgccttaatcgctcacaggagctgggaaaatgggcatctgccaccacattggctttaagctagtcgcttctgctgtgtatatgttaatgtttgcttttgcaggtgtactgagaccctactgtggatgttacgaggtatttgaaaaagctggtgtggggctatttatgtagagacagggtttctctgtgtagcctggctgtccaggagctcactatgtttaaccaggttgaatttggattgagagagctcagtctgcctcttccttcccagtgctgggattaaaggcttgtgccaccccatccagtttattcatcttaatctttgaggtggtctcattctgtatcccaggctagccttgaactgataatcttccaaccttagcctttagagcagaagatggcatttaggctgcagtcagtgtgattggtttaaagtccatgaaaggccaatgggtaaaaacttgattagtgagagctttattttcaggggttcctttctccttctcatgtacctacctcctgggcctcattagtagggattcacagtaatcattgacaaactgttagtgacagactgactctctatcctttttcttctcagttccacacctctggcataaactgttgtacattgtagtgttttcctaaacaactgatttatttaggcaagactacattttccactttatatgaagtgcctgtggaatcaaaggaacaagctagcttctcttggtaaccatttagattggtttcaaatctccccactctgcttcttattcagtaggttcttcctctgctttaaaggctcaagtggggattcttaaatataaggtacagtcccagtgaccctctcaggcctagttcctactttatagaggtcaggagaaagcagtgtactgaagcaggtgatgcatttaccctgctaaggtccctgtgttactccttggctttgaacagtggggtggttaaaattttgcacactgccagaggtggattcaagttgatgtgacattaaaatgagcattcccttgaattgagataaaggtcattttgagaggccaagaatacacattagctgtttgtgttcccagattctatagattttagaatcaacagtccaagccaggtgttttgcttcatgcctttaaactgagaactctgaaggctgaagcaggaggattgctgtgagtctaaagctagtctgagctactgtcttaaggtttgtaaagagacaccatgaccacatcaactcttataaacaggaagcatttaattggggctggtttacaggttcagagatttagttcattattgtctgggcagaagtatggtagcgtacaggcaggcaaggtgctagagaaggaactgagaatttggatccacaggtagcaggaagagaatacctcctccaaaaaagccacaactactccaaggtcacacatcctaatagtagcactccctatggccccaggggggctttttttaaaaacaaaaacaaaaacaccgcagctactatgtggaattctgttttaaatggagggtacctatccgagtgccctgttttctgcactggggctttgaaatgcccacaattcatcttagctgctttacttactgaagtctgttcagatgcctttctgctcacgtgtgctggtacagcagtgctgaggcatagaacctccccagatacctgttcatgttctgggagtctctgcctcagttttatatgtgatgtgcatgattgctcctgggcactcctgtcactcacaagcctttcctgcttacagtgctcacactcccactgaggctcacagctgagcagatgctgctgtttgtgtattttgttgctgctgttgctcatatttactgtaatgcttttatctttgagctacttaaactaacagcgttctgctttgtgggctaggttttggggtgtgtattgatgccatcccaaagctgatgaaatagagtttggaacatggggatggcttctcgccacctgttagtgaccaggagctctagatcagctcatcctacactgatggctacagtttgggattcaacacttgtatatctgcatcttgagatcttgttgccttttacaattcactaggacactttactaggaaaactcagcaaagcctaaggccttgaatagatgagatttctacatggattggcctttttgctggacaaaatctgttattagatgcgttcttgattttttttttaaatctaactcattgattcattgatccatttattcattcgtagtatatttgatacaagttctaatgtagcccaggctggcctcaagtttaatacagatacagatacagatacagatacagatacagatacagatacagatacacatacagatacagatacacatacagatatatgtagccagtctttgctactttgtgagttcctctttttccccactctttattcccctggttccacccctaacatggaagagaaacaaggataaaagggagtgaggaaataggaaaactcctgagtctaacttctttccttttgttctttgaccacaactactaaccaacctcaaccagcctccctaaagagccaacaactatcaaccctgcctctcggaggtcctagcactgtgtgccctctggatagttcccagaattccaagcataacataatcgcagaaatgatctgcagatggcaaaaccatgcttctgctagagcatgaggcaagtcacggtcagctgctgagaggacagtgcaaagcattcccatattcctactcctggaattaaaatgaagcccattcttataatctgtgtttgttaaagaaacacaaactccagaattgtcattacagatatagatttagatactgttatagatacagtgtagctataaatatatccaaggatcaccttgaactcctctacctgggaatgctgggattaaagatgtacactatcaaacttggccttttttttttctttaaattaaaatttgttggcaattaataggtttggtgatgatgttggttactgcaaattttttttaattaatatttttcatctatgtagttctggctgtcctgtaactcactatgtagttcaggttgacctgaaactatccacctggctatgcctcccaagtgctgggattaaaggtgtatagcactgtgcccagccacttgagttgatggtgcccttatttctgtctcccagccatgcttgtagaatgctgtgcttgcttctgttcctttgttgttgtatcctgcagtgttcactgaagaacttgtttatctcatgtgtttgagtttttataactatgttacaccatcatgagtacagcatgtttgaaattctttcctgagctctgtgcattgctgctgttaacagtaaacttaatgtctgtagagaaaagaatggttgcagaattgctgaatttcacatgtccctgccccctgtcattcagtaacatttgtgtatattgtaggccattgagagagactagagagacttttgatgagtctgtgaggatactgaagcagccaggtgaaaatctgattagtttaagaggatccccgtgttactgtttcatagctggaccagattcctgtgcatcccaagcatagccaaaagggaccaggaggaggatcgtttatacacctcctggctttatccttgccattttgttctgtggtaataacacttgaagcaggtgtcaggttcacttagttagtgatcctttgtctgagtacctttaggaatattagtaattactttttaataggcaaagggtcaactggccagtgttcattatttcacagcttcatgtaaaaggaatctgtctgtacatgctgagtattatagcaaagatcctggaattctttagtatgtggctagtttccaaggccagccacctttttctttttactagaaatattatgggaactaatttttcttttggcgaacaggagagtttaatttgcagctggattaagattgatctcatagaagtgcttgtatcttccctgcctaaaatgctgattctctgtttacctcctgagcaaagcaggttgcttgcctctgaaccagctgctaaagtgaagctgtcttcattgtatggtgttgatggcttttgttacacgttacaggtttaatgcatggtgtattgtttttattttggtgctagttttggaccaatcgaatacaaaggccccatgagtgctgtttacattgagaagtttgtccgccgggcgatgaagccgcttctctacatcccgtctcaatcagcattgctagactttctctccagctatgaggtacctgtctttcttatcgcctgctcccaaggcttttcacttgctagaactggattgtttgtattaagtgagttttagtttactttgttttattttggtgtatattaattaattgtacaagatagtaggttttttttttgtttttttgttttttttttttccaagacagggttcctctgtatagccctggctgtcctggaactcactctgtagaccaggctggcctcgaactcagaaatccgcctgcctctgcctcctaagtgctgggatcaaaggcgtgcgccaccactgcccggcaatagtaggtttcattatgacatttttatacttttaaaaagtctcctggattttagcaattaaaaaacttacattggtggctggagagctggtttagagattaagagcacatactgtcctttctaagaccccagtttaattccccacacccattaggtgacttgaaactgactgtaactctagtttcgggagatctcatactccagttaagagctccctgagattctaattttaaggacagctggctaagtgagcattaaaaggccagactacttgcaaaatcttatctctgttttgtttggagattttaaacagatgttgttcttgtctcacagttgactaggatatggaattagttcatagtttctatgcagctactctaagaatattctgtggccttataatattgcacaatgaggacctggcttttcttgtcagttttagtttagcttttgactccgtggttaagaacacttgtgcctttcctacataactcaggttcaattctagcacctacatcagttggctcacagctgcctgtgccttcagttctagggtatttgaagccctcttctggcttccatgagcatgcccacacatacacataaataaataataaaataattgttaaaggttgatttcgtatgtatgggtgttttgtgtgcttgtatgccggtgcaccaaatatcccggtgtccacagaaggatgaagaggatgttgggctgccctaggactagagtcacagatagcagcactgtgtagatgctaggagtttaacccagattgtctggaagagcagccagtgtgcttaactgttgggactaaactttgatcttttttgcaagagtagcaagttaactggagctagctctccagcccctacaacaaatctttatttaaaacaaaacaaaaaaccaaaataacaacaacaaaaaccctggaaatatactcctttctgattatttaagtccttttggtttttggttttttgagacagggtttctctgggtagtcctggctgtcctggaactctctatagtcaaggcctttttaaatagaaaatattttagcttactaatattgctttttttccagtggccctgttgccagcttcaatacctcttaaattattgttattttaagattttattctcttgggttgctgggtggggtagtgcatgcctttaatcctagtacttgggagacagaggcaggtagagtgtgttcgaggccaacctgttctacattgtgaatttaggccagcaaagcatacatattttaagaacaaaaacctaatccttaatttgcattatcttttaaaataacttaaaaattcatttatttaaatttatttatttatttatttatttatttatcttttgagacagggtcatcctgactagcctagaactcacaacgtagactaggnnnnnnnnnnnnnnnnnnnngtgtgcaccaccacatttaggttaaaatagtttttagaaaaaaatatttttgtcgtgtgtatgtttgtgagtctgatgtcacttgtttataagtgcctttggaggccagaagagggcactggatgccctggaactagagcttcagcaccatgtgggtatagggactaaacttgattttttttgcaagagtatcaagtgctcttagctgctaagccatcttctctccagtatctgagttttcttctttgaggtagggatctcatgagtcccagctcaaccttgagctccgagcacagttgagtctgatctagggccagtgaccccattcctcacctcctgagttgtttggggacttgagatgagggcagtgttttgttttgttttgtttttttaaagatttatttattattacacagaagtatactgtagctgtctttgaacacaccagaagagggcaccagatctcattacgggtggttgtgagccactatgtggttgctgggatttgaactcaggaccttcagaagaacagtcagtgctcttaaccgctgagccatctctccagccccctttgtttttgttttgagggggtcttggaagtagggttaatagttagtccaagctgacctcagaccctcagcagtcttacagcctcagtgctcctatagattggcagttagcacctgagccactggaggtagttctccaaactagtgaaaaacctgatgtcaggtttaagtcaaagcttaactctgctactgcctaactctatggccttgggctgatgatttagtctccttattctcatttataaagcagaagtaatctagataagacaaatctctaagcagtggggagggcagaggcagactgatctgcatagtgagactctcagaaaacagaaaaacaagtaaaaattaagtaaaaaaaaaaaaaaaaagaaatcgttggacttggtggtgcacacctttgatcccagcacttgggatgcagaggcaggcggatttctgagttcaaggccagcctgatctacaaagtgagttccaggacagccagggctatgcagagaaaccctgtctcgaaaaaccaagaaagaaggaaagaaaggaaggaaggaaggaaggaaggaaggaaggaaggaaggaagacagaggaagaaagaaagaaagagagagagaagaaaagaaagaagggaagggaaaagagaagagaagagaagagaagaaaaaaatttaaacaaatcttatcagtaaaaatattttgaggaaaattctggatgttagtattgcaataaagacttaaatgttataatgataatattgaaataccttattcatgaggatttttttttaataattaagagataaaaagtgatctgcagaggtcaacagctgccgtccttcagtcttgccctattggcatgtttgtagagtactttgcccaattttgtcttatttgggtcttcgctcatcttctaaaagggaaaggaaaagagaaatgggagaggagctacaaaataacagcacatagcataaagcttcagcaatctacatatgtggcaaagacgatctcctctactcctgagaaggcgtgagaggcagctctgtcatttttcagctttggttttgttgtttattttgaggcagggtttaagtctagcccagactggcttcaaacttgctgtgtaacaaaagatgactttgaatttatggatccttctgcctccacctctgtggttctgggcttatagggcaggcatcaacacacctaatatatgttgggctggacattatcccaaggcttcctgaaccttaggcaagcactctgccaactaaattacatctttacccctctgctgcattgatttttttttcttttaaaatatattatatttaaaactgggcagtggtggtcaatgcccttattcccagtacttgggaggcagaggcaggtgaatctctttgagttcaaggctttcgtggtctacctactgtgttccaggccaccctggggtctcaaaaaaaccaaaacaacaaaaaaaatccatgtgtatggttttgtgtgtgtgtgtgtgtgtgtgtgtgtgagagagagagagagagagagagagagagagagagagacagacagacagacagacagacagacacagagaaagagaggggtgagaggtggtggtgtcagtgtcacacaggtagaaacttgcaacatgcacatatggctgtccaaggccatctttggaaatgagtcctcttcctccatcatgaatttaaaggatgaaaccaagggcgggagttttgtggactaaatgctttcttgagcctgttgttggctcattctgcttcatttcttacagagggcacatgtcataggtaaagggcttagctgacttctctaaatatttggctagacaatccctctggtactcttgccttcagtggtgtttaaaggttagaaagagttttcagaaggttcacatatttctggtcaaggaagtattattttgtctcatgtttttgagatgatggtctgtgttgcccagactggctctgaagatcctccttcctcagcctctctaataactaggaccacacaagaaagtagtaactcggagatgttacaagtcctttttagtgtccacacttcagtcttcattcttcttgagtttcatgtgtttagcaaattgtatcttatatcttgggtatcctaggtttggggctaatatccacttttcagtgagtacatattgtgtgagttcctttgtgaatgtgttacctcactcaggatgatgccctccaggtccagggacactatgcccctccttagaattgggaacaaaacacccatggaaggagttacagagacaaaatttggagctgagatgaaaggatggaccatgtagagactgccatatccagggatccaccccataatcagcatccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctagagaaagaacccaaggagctaaagggatctgcaaccctataggtggaacaacattatgaactaaccagtaccccggagctcttgactctagctgcatatgtatcaaaagatggcctagtcggccatcactggagaggcccattggacacgcaaactttatatgccccagtacaggggaacgccagggccaaaaagggggagtgggtgggtaggggagtgggggtgggtgggtatgggggactttttggtatagcattggaaatgtaaatgagctaaatacctaataaaaaataaaataaaaaaaaaaacaagtcctttttatttattgcttcagtgttgctagtgtatctgtaccaaagagagaaaggtgtacaaattcttggtgttttctcttgcatccttagtatttgcatttcagtgataccgtctaagtgttggcatggccctcctgtgtggttcaccagtgtggaacccacttatgtagagtgatgtacctcagtaatttagtcttctttgaagcagtaaacaaatgagtgttagccagaggggacttgaattttaaagacttctgttgtcttgaacataacctgctttctcctagaagctatgaatgacatttgtgtgtttgtgacatctttgttagacttttaaaaaaaattatgtgtatgagtgttttgccttcatgaatatctgtgtaccatgtacatgcaattcttgtgcatgccagagaaggtgttggtctcacagggctggaaatataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccttctttttttttatgacaaagattcagaaggtgttggctttttaatttggctataattttatttgtttttatgaaagacaaaagacaaggccatggctatcagtgcatattaaagcaacagtttgctatttctggttactgagtcaggatttattatgcagaatgggagtgacctatgtatgataatcacaaaactgagattgtaggatcttagaattttcttcctagatatgcactagcataatgctaacttgaacctcatgtgtgtagctaggaactgcagtgaactttcccaggggcacaatagaggaagatgagagcttcaagtaagtcatgtccatacaagcatattagactgtgcttcttccagttcctcctgctgtagctcagacagctcttcttgccgacttgtttatagacaggcagatgtggtcagacagaatgtgggtcctagttattttaatggtcttgaagttgattgaaaaaggagtaagacagtaagtaagatgaaatttccacaggttttatgtcttctaattttaatggggttttgttgttggttttgttttgattttttttttaaggtattgtctcttcggtgttggtagcttccctatcaaatgctttatttttaaatcacatctgatttaaatcatctgatttttaccttgcaacctacctaccaaatgccaataaatagtactgttatttagaacttttatcttatatttgtgccaaaatagttcctaaacctttttgtgaatttctgtaatttacttaagatgaattatttagcacatatctattaatttagtcttatgataaactaagttgttttaaaattaagcaggatgtaaaaaggcctaggaatcttggagggagcgggttaagtagggtgttgataaattgttaggtgagagaaaacctgagatttttgccggaaaaacttcaatgcccagcttctaatatcatagtgcttttattcacaagtctgtctgagtgttgagcaagtatgcagcatttctgtcagttcatagtttatactgctgtgactaagaaggctttattatgagttaaaatcaaggcagaatggttttaagtgccggtaagtaaacgtgcatgaagggggctggagagatggccaagagggtaaaagcacaggctgctcttcagagtgctctggttccattctctgtgtccagctggtgattctcaactgttggtacctccagttccagggcatctgatcccttcaggcaccaggcatacatgtagttcacatgcatgcatataggcactcacagacatatatgtcagaaaagaaaattgtggaaaaaggggggaaatctttaaagaaacacatcaaggtaattgctaattaggccactagagggtgtgtgctatctgccaaaatctactctagttgaaaatggtgcctgcatccctaacagctgtgttgcaggaggtatgaggatttgctgacctaaacagctactaagagtctacatcgtggccaggggtggtggcgcacacaagaagaacaaagaccaaagtgtggacactttgccccttcttagaattaggaacaaaacacccatggaaggagttacagagacaaagttggagctgagacgaaaggatggaccatctagagactgccatatctggggatccatcccataatcagcctccaaacgctgacaccattgcatacactagcaagcgtttgctgaaaggaccctgatatagctgtctcttgtgagactatgccggggcctggcaaacacagaagtggatgctcacagtcagctattggatggatcacagggcccccaatggaggaggtagagaaagtaaccaaggagctaaatggatctgcaaccctataggtggaacaacaatatgagctaaccagtaccccccggagctcatgtctctagctgcatatgtatcagaagatggcctagttggccatcagtggaaagagaggcccattggtcgtgcaaactttatctgcctcagtacaggggaacgccagggccaagaagtgggagtgggtgggtgggggagcgtgtgggggacttttgggatagcattggaaatgtaaatgaaataaatacctaattaaaaaaaaagaaaaaaaaagaaatatgtgtagctaatttatgttattttttaaataatgacatagcttctgttgaagagacattgcaagtttggtgaactgtagattttgctttacctacagcatgaccagagttgtttcattattttgaagtattaatattaggttatgttatcaagcataccagttctcacaactcagtacagactgccacagaattgtatcttagctagcacttaggatagactatacctgttacaatttattttaaatttttttatttttagttatgtgcatttggaatggcatacacacataaatacaggtgctttcagaggccagaagaaggtgttggaggccctggagcctgagttacaggcagttgtaaagtgcccagcgtgggtgctgggaactgagctcagttccactgcaagaacagtgtattctcttaactgctgagctgactttgccatctcacaggttgtgttttaaataggtagtattttagagtttattcaacttttaatcacctcatacagtgtgaagcttcagttcttcattgctttgacagtgaagaatgaaatgatttttgctgtgttcgccattgtagtgtttggtgagtttccttgctcagactacttactcgacagtttcaatgtcagttcctctgaagacagaggttccttcatccagacagtatgtgctgcagcagtagaactgggagtgtagacatgagttagagggtttgcctactacacacaaaagccctggctttgatcccaccactgtcaaaaactaaaacttgctgcagtgagaataaactttatacgtacatgctttcaaagggcactgcaaatagtccaggagtttttcattttcaaagatttagtgtggaagctggtaaagactgttcagtgggtaaaggcacttgtccccaagcctgacaatctgaatttgatctgtgctcatatatcagagagaactgactcctctctaagtattgtcttctgaccccaaatgtcaccacagcatgtagacactcactcatatgtaatcaataattgccattagaaagaaaagatttagttgagatttcccttgaatcagagcttgtattctgcatatgttcattttatacatatgtaattgcatgcactcatggatatagataacatacctatgtcataatacacaaccatttccatgaacctctctaaggtaatgtgatgtgggaggagagataaaattcacatggaacatttacttattaatatttggaactattttactccattggctttggcttaggagagtgatcagaaattaaagaagtttaaatgagtcgttgtaatagtttttatttttggacagcattaacagttcctagaatttctgaaaggttgtcttatgttcatgataggaaagcttattctgttgtggaatggctggaaatccttaagaaggtaaatgtgctctggtgtaactctattataggctggcttgtttaaggagttctgaaggagtaggacaaaaacaaaaacaaaaacaaaccattagttgccagtgtttgcttttgtactggggctggtgttgcatgggagagtgtgtccttacccatgtaggaggtgctgggttccatctccagtactgcaaatgacatgaaacaacagcttccttatttcttcagtttgagaataggctatttgctagatttttttctggatgttaggattaaacatttcatcttagggtttggttttgttttccagaggaagactagttgacttaattgaatctagagagttaaccaaatagtttagcttgaaaagaagaatcttcagtatagaccagaaacgtcctctttcgtgcagcatactattgggagggatgttgggggacccggtggattttctgttgtctgaaacagtttcctgcaagccaggctggcctcaaactcatacataataacttggaactggggctggagagatggctcagaggctaagagcactgactgctcttccagaggttctgagttcaattcctagcaaccacatggtggctcactgacccatgctaccatctcgccagtaaaacgcacgcaggccactcggatccttctgcagtacagctttaatacatctcgagagatagatgatcagcttcaggagaggagacccagagagcagaaacccttcccttttataggctgcgaaaaaaacggttggagatgtgcaccactgggattggctgcccactatcagtcagttaacgccacgagaaaggcagggctcgggtaatggaacgataccctgacgcctgcgcacattttactacgagcaagggatgtcagcgccatcttgtaacagcgactgtgagggcggctactcacatctcccccttttcttttattttagaagcaacaggccacccagtactgagagtggagatagaggtcaaatccccagtgtgcaagcataggggccttacacaaaacctcctcccaggctcgtcacccggaggggttttggtccgctcccgtgtcgtttttcctgggggaaggacacttggacactcaaccttcgtcagcgccatctaggcgactgtgagggtggctcctcacagctcacaaccatctgtaatgagatccaataccctcttctggtgtgtctgaagattgacaatgtactcattcatatacataaaataaataaatctttttttaaaacggcaatgtggaactctttatctcttgtttttaccaccatgctgggccttttctttgcttattaattttatttttactcttttttatttttttgtgagaaggtctcactgtgtaaccctggctggtcttcaaactcactatgtagaacaggctggcatactgtctgccttctgaaggctggaattatgggcttgagccaccatgactggttatcattggttttaaatattatcaacatatgaaatttctgtgtcaaatttttgaatccatttttccctaagtatctgtctttctagttacctataagagcatggtgctgagggcaccagagctaaagggctcatctgtatcagactaatgcctataagtaagcttttccttcactgttaccatgtgaagaattagcactgcttccagtaagaaaccattgcttgcatgatcaccacaaggccatatatttagctcctggagcctgggcttgagcttaagtcttctgactatagctctatcattcatccctcaaggatctctaactgctagggtctttaggcagatgtgattgtcacagaaccaaaccagacaggggtgctgtgacacctcaaagacagcaagcaaagcagatgtatggtagggaacagctaattgttttggcatatggaagggctattctgtgctaagcttacaggagtagattaagcagatggattgagtttgaggatagtggaggagggccagagtttctttgtagctaacctgaccagagaaggccttgccattcagtggtattggatgtggagaaaaagaagggaccaggttacaggtgaggccaaatataacctgatttctaccaaagggagaaagtgattttagagaggaagtgactgatagtgaaacccaagaaagatacaaatacaatgatgttactggtctaatataaccagagtactggttaatactgatacaatatacccagaactacaaagaatgagaatctgaacctgtggggtttgctgccagggctctgtgctgccaattgtggtgggaaggtccgcttagggttgggggaacccagtgggaaggctgctgcactcctttccctcaccccaggatctggctgaatggagaggaagttcaccacagcccacacacagccctcctcaggtggtcagatttagaaatgaaatgtggcagtatattcaccatccattcctggcatcacaagattttctatacttaagataacagctattcatcattcagctgacagtgcctatgtcaccaactgtactcttgcccctgcagcctggagtactcggatactttgaattcagcggttcaccccagcctcctggttacttgaccttcttcacctcagcactgcattcgttaaagaaaggtaaaacgaatgtgtattaagacattggcacattaagcagagatgtactgatttttatatgttttggcatatagtatctttatgattatattttctaatttgctagattccttttctcaatgtatttttaatgaatattaactctcgtttaacttcgattaataaagcattgtactgtaccaggtattttcttgctgggcatggtggtgcatgcctttaatcctagcacttaggagacagaggcaggtggatctctgtgggctccaggccagtttgctgtacatagggagaccatgcctaaaaataaataaattaataaaataatcaggtctattgtttattagatgtagcatattattatatagagtttgaccctctggcgccaaaccatgttctaagttttgtttggactgttgttatgttttatgtgaagtgacaggttttgatctgactcagtgcttacctggtcaatagttgagtatgctgtgccatataactcagggcctttccttcacagggtggtttccaaaggtcacaggtatgccacagaacatcatgagcctgcatcagtctcactccacatctgtgtgctactcccatatcctcttcctctttccatattgctttgtgttctctcaaggtcatggccgagtctgtcttgtcagttctgttggatacatccatctacacacttgtctctgattcttttgttaccatggtggtgcttcactcacatctggactagacagtgggcacttagctgtttttagtctctgccctcctcttcccatgatacttttctaactttacaaatgttagtcctttctagaaggcagaagagccctgagactgttagactcttattcatcccttagggtccagctcaaataccaatgtccaatgagccccattcctgaacctaaactgttccttgttgtttctccctagtaattatggatacctttatgaatgtaattataaaataatttgttgaatgtctttttaaacttaaatttctaggggtgggagcatgagtttttttctagtggctgggtatttgccaagtgagtgatctctttaaatgctgttacacattatcccaatagatcaaccatctattttttttttaactgggtattagattatttcaggcttaaaaacttacaatagagccgggcgtggtggcacatgcctttaatcccagcactcgggaggcagaggcaggcggatttctgagttcgagcccagcctggtctaccaagtgagttccaggacagccagggctatacagagaaaccctgtctcgaaaaaccaaaaaaaaaaaaaaaaacaaaaaccaaaaaaaaaacaaaacttacaatagtacatcattattatatcaaacaattatatgactgactactttactgtgcattgttttggggttttatgcacagagaattgactctgggagatactaagggggaaggtgacctgttgtataagtgtgtcctgtcgtcttatgccctttcactgagctacatccccaaccctcctcactgattttattttgagacaaggtctcactaagttgtccaggctggctttgaacttgcagttggtctactgtggctgccacagaggtaagattgcagagctgtatcattaggtttagctccaagtttgaattctaaaagtaaaatacaacttaaataagtttagaagcacacatttaaagctcttcatgaaagaacataaataaagttgtatttgaaagggaacccagtaatccctgaaatgaaggcagcatttaattcttcagctgaagggctattttgggatcatgaaagattgttttttgttttgattgcttatattctgttatgccaccttagtaagtcatttattttaaactgctttttcatttgcagtttttcagaaggaaaagcctttccagatacaagacggtagccttccttccctccctttctttccttcaagctagatgagaacaaaacagggataaatgacatgggggggggggggttggtggcatttacagtctgagctacttagtgagctgaggcagggggactcatttgagactagtcctagaaaacagcaagacccacattccagtacaaaaatgataaaacagaaactgggagaaaggtatagctggtagagcctcccctctaggatgctcagggccctgggttctttctccatatcacagaagcaaaccacacaaagccaagatgaacatgcttggtaattcccccgcaccctgccatctctgatgacctgtgtggttggacttaccttttctctctcctcctacagtgcttctagccaggtcttagaatcctgctgcatacagtgttaggagctgagattcccacttgctcatcctaagtgactaagttcccacttacacttaatgaaccgttttcttaagaagaagacacgtttggagttatttttaacttaatctgtataccctgaaggagaacctgagatgagtcttaccctgagcatctggatttgccctcccttttctcttgctgactctaggacttattgtccttattgttaataataggtcacataagagaaacgtgtgcatgctctttttaaaatttatttattttttatatatgtgagtacactgtcactgtcttcagacacaccagaagatggcattggatcccattacagatggctgtgagccaccatgctgttgctaggaattgaactcaggacccctggaagagcagtcagtgctcttaactgctgagccatctctctagctcaaggtgatcatttttatagacataaatatgatgaatatatggctttctaagctgttactacttggtaaagtgtagatagatcctacttcccctagttcttgtgaagttttttttatatacatccatgccttccggtggattagggttgggattatgttaaatatgggaatgggtttgaagtcagttcataggctcatacttaccttccctttctcacgcatagcatggttattcatttagttacagcttcttttggttcttcagtgtaggtcttagtgggttctcattaatgcttggtcatttccaagtatttaactgtgggcctgtacctggtgcttctaggacctaaagaaaaacagccttatccagacagcagagtcttgttcttagagccattcagtgtcaacagtctttattattcttttgcttaaagaaatgtgccagctggtaggggtgcgcacctttaacccatgcactcaggaggccagcctgatctatagcatgagttctaggacaaccagggctacacagagaaaccctgtctcaaaaaaccaaaggaagaaacataatagttggtgatggtggctcatgattataatcctataattctagaggtggaggcaggaggtttcctgtgaattaagaccagcttagatttcagaaggagaccttgtctttaaaaagaaaaagatgaaaatttagtagtgggcttaatggcttacatgtattttcttttttttcatcttaaaggagctttgtcctagtagcctttgaaggacacttcagctctaaaatgccgagatccttctacagtaattataggcctgtgaagcaagagtgcttctcatgtctttaaagggttgtcttgagggaaagaaacacctcatgtggatgacttgattagcacatagtacagcctaaaataggtggaagagggcttgtaagcccatgttcagactggccaccttctcagagggtggaaaggaaggagtttaaaggggactgtttgagcacttcacactgctttgggatctgatgaacaggactgctgctgtgagagtgtatattttcctgtcatggagatgcgtgacaacagctatttagctctgtagtgtatgttcttctaaaataatatatctggaactgcatcttgcttttcctctttttccagctcacaagagaggattctctgtgtttagtggtgtcttgacaaacactgacatgtgtttatggtctccaaatgccagatttctttctacacaattgttttagtctttatgtgaagaatcataaaaatatataaacctcaaagttaacatttctaggggaacatacaaatattgcggtagtttatacatagcgaacatttctgcaatgtgtccttttttgctgggggatggtattttgaggcagggttctctgtgtagcctcactggcctagaactcactctgtagaccaggctggcctcaatctcagagatccacttgcctctgcctcctgagtgctgagattaaattgtatgccactacctaccacttgcctactctgccctctctctctctctcccctttttttttaaggattttcatttgataggcatgtctaacattggagtatgaagtcgtcatcataagtgcactgaggaaggagtccccaactacagtgggacagttgttatcctcttttagcataatcttattttcctttttccaatttatctaaaaccctgaagaagaaaaagagagaaaaccagaagttaatgagaataaaataagggctatttccaggccacactggtttgcctattgaaaggtcacagttaaccaatgtaaagaagtttaaaaaaaaaatgcccagaagagaaatttccctagaggtaaatcatgtttcaatcgtgccgattaaatacatgtagcttaatctgctgatacttagttatggagtagaccaggacatccttatcactaggtgtctgcatcattttctcttgacccagtgttcctctttgttcagaccctgagagattagctcatacagagctctcctggaggtctaagagtcctgccttgttcagccctggcttgtttgttctttggggatcctggggtacagtactcccagaacaccaggtgctataggtgtctgaggcaattaaattgtatcagctcagtttctagttagaatgtctatctctttctgaagaagtggggaggaaatgtcatctttgatggtaattttcacaacgtttgaggaatgaggaagtttaggagatactgtcttgtgtcctggctgtcctaaaactcactctgtagatcaagcaggcctggaacttagagatccacttgcctctgcctcccaagtgctgggattaaaggtctgagctgccatgcctggtcttctattctgttttctaatgaatgaggctattcttactcttcctttagcatttgaattgatgtagttcatggctcagaagaggtatgttctctttaatataaaattggttttgatatttcatactgactttaagggaaatggtactaaaaaaaacagactgaggtgagagcgttcagaaaccccctaacagaattctgatgcgagcatgagagtccagattgacctggagggaaacctcagggaatttcacctccttcattctccttgcatccttagagagcaaaagtggtgggtaagctgggcagtggttgcacatgcctttcatcccagcacttgggaggcagaggcaggcttatttctgagttccaggacagccagggctacacaaagaaaccctgtctcagaaaaaaaaaaaagtggtgggtcttgacaaatgtgtgtgcaaggaacaggaaaagtgactaaagctgtccctaggttacatgggaattggggtgatgtagtctgttagtggcaaagagccccaaccttctaacaaatggccagaaggtgagattgagaactcaaagcaagatagctgaccactgaaaacccatcagactttgtggacacaccagtgccttctgttgttccctttgtgcagtgttcatggaacatgtcctatcttatagtgtgcctaagagtggctcagtgagctctaaggacacagggtccatgcctcagctcttacaacaggacagttagtctgagtgttttcctgttccctcctagagagagtaaatggccacagttcaggctctggtcacctttatctgattagctattggcacatgcagctgtttccttgcccagatgttcttttaagagcttgtcacatttatagtcacttttgctaccatttgctgctttgtggttactggggatctaaagctggctaaggaaaaggctaataaatagactgtatgagacctataagaattagttgagaggcctgaagagatgactcagtatttcagtaagtgagcatactgctcttgcaggcaatctaggatcatatctcagtatccatgatagggactcacagctgcttataactgtagctcttggtgcatgtacccagatacatatagaaacagatttttctaatcttttttcttttattaaagatttatttatgtatttatatgagtactatgtgcatgtacacctgaatgctagtagagggcatcaggtccccgttatagatggttgtgagccaccatgtagttgctgagaactgaattcaggatctgagttctgattgtgctcttaaccattgagccatctttccaggtcccctttttttctgatcttaaaaaagtaatagaatgtgacttttctcatgttagatttatttggggttgggggttcaagacagggtttctctgtataaccctgactatcttggaactaggtctgtaaaccaggctggcctaaactcagacctacttgcctctgcctacattaaaagcatgcactaccacacctggctcttggtagatttttcttggagggggaaagggaggagagaatatgagccttaatttattttaaattctttaacatattcgaagttgttttgttttgtatttttccattagaccctctcatggagcctaggttaacctcaaactcccatcatagctaaagatgaccatgaactcctgatcgttgtacctcctattacatctggctttcataattcttaattaaaatattggagcctcattgcttttagaacaaaaggatccattttataagtgacaaagaggacatgtgtaagacgtgccagtgcctgctttaacatggtgcactcacattattcttagactgtaaactgtaatccaaatattaattattgcacaagatcgcaaacttgatgtacttctttctggaaaatttccaccatgttcacaagtttcagagttgcagtgtgttaggctgtgctttgtgcagacaacctgcttcattcatgctggtgcagttaaattgctgttgagtggccccattcagcctccaggcaggctgtcactttttattcttctgctgcagcatatcatgctggagacaccctttcctgtgcagtgtcacataggctctggaaacttcaactgtagcttaggtgctgccttttttttttttcctgatatttttatcatctgaacttaatgtgtcgaaccatttaaaagaaagtggctcattggtaagagtgtctgctagcatgtggaagacccagggtccatccataggactgtaacacacatctctccctgcttttttccctctcttcagcctcttctgtaggaacctggtgccttctgtggagactgacagttggggagaaggtctgaatgctgggtatactctttggtggcttccagccattcttagttcaaggtctcagcagatagaaccaggaaacacatgcatttatacctatatgtgaaagcatccatgtattatcttaaagatttatttatttattttatgtatgtgagtacactgtagctgtcttagacacatcagaaggggccatcagatcccattacagatggttatgaaccaccatgtagttgctgggaattgaactcaggacctctggaagaacagccagtgttcttaaccgctgagccatctctccagccccacatccatacttttatatcctatacataggtgaaaatgaaaagctagcttatacagttatctctgattccaggctgacacaatagtattcattttagccttcttctcctacagtgtaacttcttaccccagtactaaaaatcctggttcccatgatggcaatatacatgggtaaaaaggtgtgttagtagttcaggactgccagttacatagcctcgtgggaagcatttttaatgagattcatggacttagcccagttctcttgacccttagttttacagttctgcagttactggggttcattgtctccctaccctcactgtgatgcactgacttgcagttggattttttgctagtgattgctttctatagtatcttccccaccattttccttgcatgactgtggctctgagtcagatgcccaggtacatgcagcctccccacaaaccactattttgctttctagtctattctttctgtgtttctcttgagtcactttaagtcgtcaggtttgtgtttaggattgttcacctagagaggcatcccactgttccagtcagctgctcctcacctgatggttaaggctggcagtgctggaagtgggacttgggattgaagaaaacgttttccatttttgagacaggatcttattatgaaacagcttaagctggcctggactcactctgtagaccaggctggcctcagactcacagacactcacagacacctgtctgtctctgcctacaatgctaggattaaaggtgtgtgtaccacagtgccaggctttgaaggtgatgcctttatgtgttgaatttgttcagatttgtatattggctacttggtaagctgaaatttaactgatcttatttaacatctacagtaaggaaggagagtgggaaaggacgaagtgttccctacactatcttctacatcccccttcaacactgaactttattttataattgttcaaactttatagtatgcatggtccctgaaaaataaggaggactgagcagggaaagctaacaacctggattctgtccccagaacttccctttactctctacagtcatgctatggcagatgcacacacagcagactaaagcctatttaggtattcatctatctatctatctatctatctatctacctacctacctacctacctacctatttttagtgatgaaaacatcacatgggtggatgtgaccctctttgtgccccaacaccaaactaaactttactctcctttcagattcttcttgctctgtttgaggcatgtctccatattttgtccaactcagtcttaagctcttcctaggctcaagcattcctcttcctcagtcttcagaatatctgggactatatgtggtatgcctcttcaccctctttcaggttctttatagatttctactcccctgtgcccattaggaaagaatactgttttccaagcatgagagatgttgttttaaaccttaaacagaagttgtactgtgttggaggtgtttctgttcttctcctttctttttctccttctctgtctgtctccctccctccctcctcccttcttccccctctttttctccctccctctctcctccccctctctgtttgctaagacatggtttctctgtgtaacagtgctggctgccctgaaacttgctttgtagaccagactggcctcgaactcaaagagatccactttcctctgactcctgagtgctgggactaaaggtgtgcgccaccatgcctgatgtgctgtcccttctttgttgctagcaggccacaaacttctgttgtcaagtgtcgaactttacgatctctgcttgtgttatttcagggcccccggtgttctcctggtcattgatactctatattccccatgccttacatttcaggctcagtttgaaggtcaaaagtggtattattttgctttcctcagagtgagattgggtactttttgatgtaatgattatccaggtccattccctttctgtggtgtgcacatttcaatcattttttttattgtcaatttgtgtgagttgtttgtatatgctagattcactcatttcacatatagttagtggcatgcgatgctgctcagttggtagagtgcttgcctaacatgcataaaaccctgggtttgctccccagcaccctataaactgcttgtggggacacattcctttaatcaagtattgggaaggtggaggcaggagggtcagaagtttagagtcgtcttcatccaactagggtagcagcaataaataagaacttaaattcctaagaggaatttggataaagtaagatgtaaataaatgaataagacaacataggtacttacaggtaccatcaaagtaagaagaaagtcccgccatctccccaaaacttccctcccctgaatacttgatactaggcaggtagtgggggaaagtgagcgcacaatgagtaaggcgaggagctggatgtgctcagagacagcagcgtgtgcctccccagagataggcttgtgtgagcaaggaaaacagggtggctaggcggacagtcagatagctgcaggtggatgtcatgtggcagtctcctcaccccggctgactgcgagggaagggtctagcttctgcaactgctccttccagggccaggccaggttagcaagcaacagccgtgctctcggggctggtgcattaggactggatcagtgggtttgtgttgttgtaaggcctgggccctctcttatttaataaaggaacattttctgtttcagattacctaggaacagtgcgatttggggttatcacagataaacaccttgcgagactggtatccttagtgcactctggaagtgtgtatttacatagacatttcaacacatcacttgtaagtattttaaaatcacatttgtattagcgcagcggttcttaaccttagtaggtcacagactcaattaagaactggatgaaatgtatgagcctctccctcggaaagaacatgtgatttcatgtacaaattgagaattcctgtaagcccactctagaacctagtcctgattaagatccgtgccttagaggactcttaactgtgctgtctagaacctgtttgcttagattttagagtctggaatagctttgctgggttgttgcccttcttgagtgaagctgcggctactcagtggtgatctctcactctaggtgcatgatctctgagatgagcgtctactgggcagtattgttcgtgtgttcttgtatgacgtgcaggggcatgagcagcttatccctgcactaatagtgcagtgttgaagttgttgtcaagacacagtgaggagctgatagcttctcacctcagaggacctggttctcaccgtctcctttgtctcctgacttcctttgcctttgtgctgagcctgctgccactcacccactctgagcattgagcttcacaactgtgttcttgctacttaaatagtcgttgctgacaggatattttctgaagtattttatttttaattatatttatttcgtctcacacacgccacgggtccaaggacaatttgtaggagttcattttcttctaccacaaatgtcgtaggaatggaactcaggttgtcagacttggcagcaagtgcctttatccactgagccctctggatggtcctctgaagtgttttcattgctgacaggatcactggtatttggtttcagtggagatttcttcaggtctttctagatgctgtcgaaaactcaatagggattgcccttgcttgccagtcattttagcatctgtctaattcttagagctcacagatattgtgctttttttcttggtattcatattctgttaaaatgtatttttgtgttttccaaatagaaatgttttaaacccccactgtcctcctctgagcattgctgctggctgcctctccacagcctgcccactctccttgtgcctgtctcactttttacttcctctgctttgctagctctcattttctcacaccatcgttttagccgacgtgtatttatagcacagaacactgcagaagagtaagggggaaaaggagaactgggcagtagttctgggcagtgtttaccagcatatatcttttatcaaatgaagtattattggaaggttagtgtcttaaaaagcagtaggcacattcatgtgaagtcacttaggtctccattctagtgttcccaacgcttcattttgtgaaactttccaaagtaccactctggaaattgtttgaaacttgtgatttatatcaagtgtctttcaaaagtacttttatattacaaacaacaacaacaaaacccaaagggaaaacgcctccaagtgtctctttcctgctacacatgatgtgatctacagcccgtgtaaactcaggtcactctgctgaatccctgttcaatgccaggaatgtgtccagctgctggggtgacctcgaacaaagcctttagagcttctgcctagtggatgcttcactctggcctctgggacagaatctgacaagctaagattaagatataacatcctgtaacaatagacaatggacctagattattataaacaccacgtggtgctctgtaactctccttagggtgtttagaggtcattacagccacctgaagacagggagagtgtctggatagttgagtctctcaggggacaaaaggtgaacccagtgatatgaaagtcacctcttgctcccatggtggctttcagcccacttgttgagactgtgtggagaggtgggctaagtgttggctttatggcccgtagtcatggcctctgggtgccttttcctcccttacagtgcagcttgacccggcctctggagtgcggtactagtctttcgctctgccttgtctaacacacctctacattattctgttatatttgtccttggcaggtcttccccagggaagtcatgaacttcacagctgagaacatctataagtgggcctcagaaaaccaggagaccctcttccgatggctacagcctcatggaggcaagagtctgctgttgaacaatgagctgaagaaaggaccagcactcttcctgttcataccgtttgatcccctagccgagagacatcctcttctagatgaggtaagaggcctagtgattctgacacctgtcaatagatctccttccacgttaaagggcactaactaatccatcatcacaaggagtcatcaggaatagttgctggggctcagtggcttttgcctgggaccgggattccccagcttctcttgtctattcgttgctccagtctggggtgaatagcagagaagggaaatgaacttgtttccccagagacctagtaaacagcacttcttcagatggctgcactgaccttcctgttgaggggcgatgggagctcaggcaagctggtaaagcctagggcctgccacttttggggacctcgccaggcacagctgcactgatgatgtgtgtctttctctaaaccttataggcaggtttccagagacagctgccctgcctggagtcttccctccctcctgccttgctttctgggatatccgttctctctagacatgagttcattttacacgtgaatcatttggaggcacttagagggagcaatagcaatcagcagagagcctgggattgctaaattggatttactaggcttttttttctttccttcaaggatcccttaattggcccaaactataatctgaatcactgtaacacagcccaggcgaagcagacagtgcctgtccctgggcctctcagcactgctctggaagctggggaggaagtcactagccaggctcgccatgctgttctccagcatttgtttcaagttgccatcccgactgggagctttctaatggctgcacagcctggctttaaaggaaaagtagagagaagtgaagcggctctgttcctcccactgaactgaagtgggactcaaggctccattctttacaaagtgtgcactgcatgaatgctttatggtccaagaagctctttccatgcccaggcctctgtaccatctagattaagagttgacaaggtctttggaggtttttactttaacttttgagacgtgacttgacttgagcatgcagggtgcagggcaatgttggcaggagtctagtccctcacttcagagggctgaggttaaatttggcaccaaagggaggctttgcttctagcctcatgttctcagatgatcatgtccctacaccttctgtttctataatctactaacaggctttaaaaaaaaaaattcagtttcacctgtgactccattccccaagctcttatgggtgctctgaggtaggtggagtctgtcacctcccctccacatatggctggtatggtccttaatattatgcatttctgcgacaagcagcatctgctcagcactttccctccacgtgacaggtcagcctggccagtgttcattgagtactgggagctcatgggagaggaagtatgtggcaaacactggcatctggtctcagaagatggtctaatctagaatcaagaatctgcttataactcaggcagaggacagtcaggctcagctaggccagggtcaggaagtggaagaagagggcaggagaggcttagaaggaagcaggcacaccgggtaaggagggaactcaggtagctttgttttccattgccattgtgggcctaggtctgggcagacacttaaaagcacttacacacctgagggcatactaggcaaggatgctagtaacagttgtaggctttgtgtagtccagaagtgaccaggtggtggctacaccaagcctaggagtgccagctgccttacacatgttctccacgaatgcacactccatcctgcatgtgtacacacaaagaaaacatacatcttgacaccaggaacaccagcccctcatgtccctaagagcattcttgagacaccatgctgtatattatgcaacatgctaaaggaagcacttgtctccgcctccaaaacccctttgacttgttttctactctgagtagtctttgggaattggcacatgtgctgtcaagaatcttgtccaaaaagataatgatgtttatatgggtcaggggtcatttaaaacatctagtttaccttctaaagtgtctttttattctaagaattagtctgtaaatatgttttgaactaatcttctataaatactgttatagaagttatataagtggaaaattattcattaaatggttcatacatactgatagactttttgtttgagacagtctcacgggctttgaactcactaagtagctgaagatggccttaaacttgaaagtaaagtggttcaggagttaagaaaaaggagggtgtggcctgagaagactgggcaggaatagaggactagctggtttctagcttgaggctaaaacctagcaactgtggtccaaggaggggagagatgctctagaaaggaaagatgggtgtggactattgggagcagggtggttggtgatctcctgtgtggcatggatgtatttggaagaatatatgctgtaaatttacttaaatgtccaatgtgtttgagaagttttcagacttactgaggactagagaaaaatgacagcattggagaatgttaaaggtataaagaaagaatgctcacctgagaggcaagagggctccatttctttctgtcgggatacattcctgatctgaacagttttgcctgctggactttatctatctatggtgggcaggtatctctagaaccttctgactcaaagtagtggttcattgtgcgctgaaccacacaatgttcagaggggaatgttgtaaaaaaataactcaagactcctgtattaagagtctggtgtgagctgggcagtggtagtgcatttctttaatcccagcacttgggaggcagaggcagacatatctctgtaaatttgagatatgtagatatgccgctctgtagagaactgtctgtagagaaaccctgtctcaaataactaaaaacaagacaacaacaacaaaagtttgtcgtgactacttctctcctgcctgtgactcagggatgccatccaagcagcagagctgccattttccacatccataaaatttgggcctcttaccacttctgctctgtctttcagatcaccgaagtggccttggaatacaataactgtcatggggaccaggtggtagagcgcctccttcagcacctgcggcgggtagaggcacctgtgctccagtccctggcaccagagctgccagcttcactgcctgatactcagctgatggcagcatccccctgctgtaacacggtggtgctgccacaggggccagccctctccaggactcacaatgtctgtgagctgtgtgtcaaccagacagtgggtggtaccaggcctagctcagtgagtgtgccacagtgcagcttcttcgagatggcagccgctctggattctttctacctcaaggagcagactttttatcatgtggtgtcgggcagcatagaatgcagcaattttttaacctcctatagccctttcagctactacactgcatgttgcaggaccatatcccggggcatggcaagctttactggctctgaacagaatgtcttgacagccccagccatcgagttctcttccttagagaagagctgtgaggccactgccccgagctccattcctcacattgaggagaacaggtaccgctttcctcaagtgggcctcactagcacagccttcacgggcctgagctgcagaaccaacaagaccctgaacatctaccttttggattccaatttattttggttatatgcagaaagactgggtgccccgagctctgctcctgtgaaggagtttgccacaattgttgatgtgaaagaagaatctcactatatcctggatcccaaacaagccctcatgaagttcactctaggtactgtgggtggtttgccctcctccgcataatcagctttacttagcttaagagctgtcatttgcactgatggtctcattattcctaatcatgggggtgacaccagcttcagagctcatgttaagtcttcagacaactgatggaaaaactgtctttatctgttggttggtcagtttgaaaagaagctagtttgtccaggaaatagagcagaagcttctgtctatcaaaatttggtgcagtttgtcagctaacctgtaggggctaagagtctaagactggcaacttctgtcacctttccaaagcagagcaaatgctaatcacaaggaacctggctcccatgccagacaaagtggtgagagcctttctagtggagtgtgcagaggctgatggacttggccagtaatggcaccacagttgaaaggagctgaagcagaaagaagtgcacttagattgtcttgctcactcttgctctatggggttgaatgtatgagtctcagggccaccaggccccatttgttgtgctgaacttttatagcatgttgaagaagcctgccttatcctccagtgcctacattgcaatatacaagtgttgagagcacgtgcagttaaaaaccacgggaggtggcctaagcctttttactgtgggaaaacagcccagcgttgactcccagggcttggcagcagcagcagcagctcatgctgccctgtccccagactctgccgaggtttctgacacgcaacacaagaaactaagaattcaaaagccttgttagttcagcatcactggaggtgcagggagagccaatgcttgccaagtggaggaaggaggagtgtgatagtgagaggaacttgagctctaagtttagagactatgaagacagggtgagcatagctccttaagtcctagtccttttgtctgtccaggtgaaacgttcaaattagccaccttcatgaaaggactcatgaaatgttggttattctgtgtcaaattatatagtataatcacaagagctctttgatgctcaaagcaaacctgtggtcagccactttatggagtacagttactcccagtttatgatgtgttggtatatttggctttcttaaaatgaaacaaatatgtattttgtttttatgtatatttttattttatgcgcatgagtgttttgctgcatgtctgtctgtataccacatgtgtgcagtacctgcctaggccgtaagaggatgtcaggtcccctgaatctgaagctacaggtggttctgagccactatgtgggtgctaagtatcaaacctgggccctctggaaaagcagtcagtgctcttaagccatttctctgtcccccaagcatgtggtttatgttttatttttattattctgttttatgtatatggtattttgcctgcatgtatgtatggtatccagagaggccagaagaggcattgaatctcctggaacaggcgattgtgagctaccatgtagatgctgaaaactgaacccaggccctctgaaagagcagccagctatctctccacagcccccagctatgtttttttgttattgtgatttggtgtttttcctcctttgaaacagggtctatcttaactttggcttaatagaactcactgtgtagagcaagctggcctctgcctcccaagctctagaattaaaggtgtgtgccaccacacccaaatgaacatgtaagttttaaagcaagtggtgattggtttctctggattctgtgagtaatactcagctcagagaagctcattacacattgctttgaatttacaggttttctgagagactccctcttgaggttttaactctgcccagcagttttctctgttctagactttgtagcagatttgggagtggcttcagaatttaggcttcattcagattaggaagccatggtttcacagttcaaaactatggccagttaagttttgctgagctatgataaagacatgtttttagtgttcacgcactctccctatctcccgcttctacattatgagtcactgctaagacctccattggagggagttggaagaagggaagtttatagactagtgctgcttcactgaggcagagggctctgagatgtggcattggtggcaagggtgagattgttggtgtaagttaagacttttttacttacaggtttatttatacatttttcactatgtataattgtttgtttttgttagctttttaaaaaaggaaacttaaagaactttaataaaggaaacaaaaagcttctggtctgagattaatgagctctaaacaccttcatattgtcctggcactgcatttgcagtgatgcttaaagtcttagcgttcaaggctgccactttcagaggggttggtgtatgccattgtgtgtgttttcatggtgtgtgtctgtggcagtttctgtggaaaagagcagggatggatccccacaatgcattgagcaccctatgcacacactgtttagttagtaaaggactgtccttagagtgactactgccaaagtcaggtctgttggtaccctgggcccttgtgttaggttctgcttagttgaggtgattaaaacaaacaaacaaacaaacaaacccccataaatatggagacacaggcctttgctcctattactcaagaatcaggtagatctctgagttcaaggccagcctggtctacatagcaagttccagttagccagaactataaagtaagaccttgttttataaacaaaaccaaaagtaaaataaagcaataataaaaatatacacatgggaaatcatttcagttttgaagtgtttgaaatttaaagtaggccacctattctgcttgcacctagaccaccactgatctcattttctctttattttcagagtcttttattcaaaacttcagtgttctctacagccccttgaaaaggcatctcactggaagtgattctgctcagtttcccactcagcatttgatcacggaagtgacgactgataccttctgggaagtaacccttcggaaacaggtatgaggtgggagctagggcttcatggagagcactgtgaggccccacagtcgtgggagtgaagaccgctccatggagagtgctcactctgtagtgacccgtcctgatcactacaggaacaggattaggagtgccagagaggaacaaaagtcaagccctctatccctcttagttcctacgctgtggttatttgagggaaaacggtctggttttgataggcagattggtttgtggtggaacatgagcagattacatggtgcttttctagttgtccaaagaccataaacaaaaatcgcaattttaactaaagatgaaaatctcaccatgatttctgcacaggcagtcgagttgactcaatgcctttggaattcccagcccagcagaaagtgagggccaacagcaggtgtgagtaaatactgtccccttcccacaggacgttctgctgctctattatacacagtggtgtggcttttgcccgtctctcaatcacatcttcatccagctagctcggctcctgccagaggacacatttactgtggccaggtaaggacaccagtctagcatcacgggccatgctgttcttggttgtttggttttggtgtttgtttgtttgttttgttgttgttgttgttgttgttttcacgacaggtttctctggctgtcctagaactcactctgtagaccaggttggcctcgaactcagaaatccgcctgcctctgcctcccaagtgctgggattaaagacgtgccaccactgcctggcctgctgctcttttaatcctctctgccaacccacccatgctgggtgggctggaagttaatgatcataaaaatgcttattgctgactggaacacataggaaaacaggtccaggtctggctgcttagacgtcttgagaaagtggttcccagaattgcagtccagccctggactcagggcctttgcccttattttcctctttattggtgtaataaagaggaagactttgttgatagccatgtgtctagttatgactgtggttgctttatgtggacttttgtataaacacattttaaatcttttgttttgagagagactctcactctagttcaggttggcttgagcttactatgtagcctaggctggcctttaattcttggcagtcctgcctcagtctatcaagtgctagggttacataattcttggcaatccttctgcctcagtctaccaagtactagggttacaggtgtaagctaccatgcctgccttcaaacaccagtttaattacatgtattctttgacagttgggtaggtgggagatgtttgctttgttctattttgttttgagacagtctactatgtagccctggctggcctgtaacacactgtgtaaaaccacgctgaccttgaactcagatccacctacatctgccgcaaatgtgctaggaatgaaggagtgcaccattatacccagctcctcggcagttttatatgtggatatatggtacaccctgagtacactcaatgcacaccctttttctaccctcatgcctgttaaccttctttctttcttccctgtaagtcatgtcctactgtttttgttttgtaaccgagcttaaccagagtcatccacatgctcatgggtgtggagctgtaccctagaacatagaggatataccagtggctacacttctgaagctgaggacttcccttccctgggctaatgagtccccaggagggacaggccatgagcccttcccatatccctgagtaaatgttatatgttcatgaatgcagtggctgtgtcatgctcagaatagagcagagcatttcacatccctcccccaatcatcagttcttacacttttccatcttcctgagttccttcatctaccaccgttggctgcagaaagaagtctctctgatgaaggctgagagcagcatttgcctgtgggtataagcatacatatttacagagcatttgcacatttagtaaattaacactagcaggttcccctctagggcctgtgaccttcatggccatggccttttgatgaattttgatggtctttttgagttatgaagcaggcctcaaatctagtcaggaaatagtcatgccactgatgtgcttgtgggccacatcttgtctggaggtcagcatggcgcaggcaagctctgccattgcgtaagatcattgatgccttttctttcccagctgcctgatggcattttatggtcctgtgaccttccacttcttttccagcttaatttctctgtcctgcaactgaattgtgttgtgtctacaataggttctagtctggtcagcaaccaagagcaatatataataagcactttaacaagacctcaaatccagatcatgaagtgagcagtttagaccagatcatggggaaaaagcagaagatagagataaaatctttccagtgaaagataatgaaaggtaattcatatccgctagaaggatatgcagtgaaaacaacatactcgatgtgaatggtgttctttctttctttgttagtgacaggattacacctaggacctcatgcatgcaaagcaaatgttctgccacttagctatattcctagccataatttaaataagcacatgtatatttatattttacttgctgcctgctatttactctcagaagtgactgtgcaaagagattgttatatgcatatatacttatgcctcagaacactaggcgggtgaaactgctgactccatcactttcttttgatttaaggcacagaaatattaggcaacttgtccagaactgtgcagcatgtaaattaggggccggcattcagactcgagttgacactatagctccaccacatttcaagtgggccggagctttagtgtggggtgcagtgctgtctggcatgcacagtgcctgccttattcctaagctcacctttaatcctggtactgcactagggagtcagaggcaggcaaatctctgaatacaatgctagcctggtctacagagctagttccaggacagccagggctacagagagcagctgtctcaaaaaaactaagcaaactaacaaagccaggtaatcaaatgtgaacaaagagcacaggccaatgacagagtaagcaaacaacaggggaaccagtcacctaagaaatgtaaataaggtgtcatttatgcttactaaattaataaatgctttcaagtgacaggatctagtattgataaaggtggcatagtccgacaacatttacattggcaacatttgcaagaagtcacaaaaaagttatacatttctgattcagttaatttttctttggggacttgggaaaatccttacagcaacagataaggcatgtatcagtgatgctggcatagtggacatttctgtccattcctaaatcagtatttccctgaattaatggagaagggtagggtaggctgtgtcagctcataagccacactgagaggattccaagaaggaaccctggtagctcggtgcagttcctgtggatttgaaaggatctcacttcacagtgaactctttattgaagtacacaattggagggaaaacgcattcaactatgaagaatggtggccaaaaccacttggctttcacaagcagaggcagacatgccattttgttaaaagatgtggaggaaaaatttgcatttggttgtgccaattttagacttttctgtatgtatttatgaaagtatcccaggctggcctccaaatacctatgtagccaaagatgacctcgaccttgtgacccccttggttttgtctcctgagtgttgaagttataggtaggtgccgccatgcctggtttaagaagggcttcggtataaattatgctaaacaagcatccatcaccttgtcttctttagggttttactgctgcgaacagacaccatgaccagggcaactcttataaggacagcatttaactggggctggcttacaggttcagaggttccgtctttatcatcaaggcaggagcatggcagcatccaggcaggcatggtgcaggaggagctgagagttctacattttcatctggaggctgctaggagaagactggcttccaggcagcttggacagggggtcttaaagcccacatccaccatgctacaccacctaatggtgccaagcatatacaaaccatcacacacctcatccacattccttggccatattgcagtttgtacaaatacataacactggtttatactgcctgatcatcccatactacttataccttttgaaaaaccccaccaaattaataggtccaagggaagatgtgcactgatcatgaatatcctccccttaaaggatgccatcagccctctgatggatgggtcagcgcacgtgcttctcatcacctgcccagctgctgctggagggagttcactcaccagagcagttgtagtcagttctacactatacataaatttgtatacataaattaatctactgtcctcggtggcacattccagtaatcccagcactaggggtgctgcagtaagatggctgctgagtggttgaaaccatcctgagctaagctagctgaactagaccaattgcagcaccaaggcccctggtggggagaagaggaggggtggggttgaattggcattctgttaagacagtacattgatcttggccttcatatagatttatcgactataaagtatactcttcaaagggacctactgtgtgtgctgtactcagtagctttccttttctagaactaatgccagatcctgatgagtagatgaagtactttcatcgagacaactcgggatttatgctccgtttctattactcagggtacacagtgacatgtttataaagtgtaaatgccttgacttgcacctgtagtaggggtcggtctagcctgggccacagacacactccagattcttcaggtttggggcttgtttggccaatcactccttaccagtcattttctctttgcctccgtcaggatcgacgtgtctcagaatgatcttccttgggaattcatggttgaccgtcttcctaccgttttgttttttccctgcaataggtaaggctggattttttttcaatattgtgtaactgagcttccattgtaaatcactcatcatgttctaaactattgttaaagtattactattagagatagagtagaagagctttagtgttggaatgtcatgtattagtatgtttattatttgtttttgtttttctgagacagggcctcactatgtagctctggctgttctagaactcatgtagaccaggctagccttcacttcaacctaccaagtagctggtgatacctataaagtatcacgagatagctggtgtgaacctataaagacgctacagttgacaggaaagtgctcatgtttgtgtgggatgaatcctgctgttacttatgtgtccctctcacccaaggggcactgacagttctctacccactgctctattcatagagagatgtctctgcatgtatacagtctgctctgaagttgtctgtcacccagctgtgctgaaagctccaccaaacagagatgggacgttagcaaggagggttggacttagaagtgtagatccgggctgtcgagatggctcagcggttaagagcattgactgctcttccgaaagttctgagttcaaatcccagcaaccacacggtggctcacaaccacccataatgagatctgacaccctcttctggtgcgtctgaagacagctacagtgtagtaatgaataataataataaatctttttaaaaaaaaaaaaaagaagtgtaggtccaaacatttccacaaagaaggaaatgaactctactctaaagccaaacaagctggatgctggctcccttgtcactcacacacagcttccctttggatacataatagagccacgtgggaactgctctcacccctgtgggtgtgtgggaaatgcagggtcctttcaggagggctagccttggcacttacaggtcactgcagcactgctgtgctcatctggcttctctgccagagggcttccttggacttccattgtctctgtttttttccctttatctcagagaacgtgtgctagagtacttcctgtggtaggtagcttgtcagataacacactaaaaacagagtgactcagtctgttccattgttggctctaacacaatgaactctcttctttccaaggcatgtttaagctgccatatagtcaagaaaccatgggcacagccaccagcagctccatctgtgtgtgacccagctgggcatgtagtgtaatgatagtaacgttacagcacatggtaaaagcctttgcaggcagaggctcccagcaaatgggctgatgagcatgtgtatgtgcagggcaagtgcaccataggagcatccatgcccagcatcccactcctggagctgccttgtatagtagaagaccaagtgcaggccaggtatggtcttgggaggcagaggcaggtggagcaacttgggttgaaagctagcaggaattataaagtgagaccctgtgtcaaaaaataaacaaacaaacaaaaaccaacaaaccaaaaaaaagtgaaaccctaggtccctgcaacccctcctttgtcccttgatactgaagagcagaagactgtcacatctgttaaacacagagagcttaaattagagtctctcgctttagaatgagattttccgcgtctcctaaaaatgggcacaagttagtcactggtccagagagcattactagaagcttacccaaaaggtagaagagaaaggcataatgtgactatttattgccggtacaaaaataaagggggcagcggtgctagcctggcagggagcagtcgtctgaggactgtgggggccactagacagcttctaagagctgaaagtggtgcaggactatcaactatcacatccaaaggtgcacagaagaggaaatgaaaccactgtgggtggggtcacatgtaataagacttttcatgttcacctgatcctgctatttttagtgaaagtttggtgcactgtggaaaatgcaaattctgtgcacaaagtggagatgtgcagcgaagaacgctaaggtgtcaacatggctgcttctgaggtgtgagggctgcgagcgttggaggatgctgcttgtatgttctctacatccctgctaactgtctaccttgactgtgccccactgttgagagcacttaccagattattaatagatacagttgacatgtacactttgaaattctgtgttgttacatgaaagtcttaaaaatcgtaaaaagttacctacagcaccccccccccccataaacgttacataaaggggtctgtaatttagtttcttttttgttgtgaaataggatcttacagtgtagtccaggctagcttcaaactttgcttttgcctcttaagtgctagggttaccagtgtgggtcaccatatgtagtttggcatatctaattaggtctctagtgatttttgataggaagagtgttatctattaataaaacatgttctttcatgtttagtatttgtgtgtgaaaaggttatacaagttttcagttaatgcatattcctctttccattttaattttgtttattttggttttttgaaatagggtctctaggtagccttggcaggcatcaatgtactatgtagaccaggcttagcttcaaactgatagagatccacctgcctctgccttcctgatgctgagattaaaggtgtgtgccaacatgcaaggttttttaatttaaaaaagatcatacgttgtgtgtgtgtgtgttttatctacctgtatctgtacagcatatatttacagtaccctcagaggtccgaatagggcatcaaatagcctagggatgaaattttagacagttgtgagccactatgtgggtgctgggaattgaagccaggccctctgaaaaaagtagccagcaatcttaaccactaagccatctctccagccccagcttcgttggtatattaaggaacaatgcaattttttttttcttttttgagacatagttttactgtatagcccaggcttgtttcaaactgtggtcttcttgcttgagggattatgtgtgataccataagggttaaaaatgcagttgggaaaaagctggtgttcgacactcacttaaccctttaacagccttgtgaggcatgggacactcccaccaccaccccattttacagagctcaagccatttgtctgagaatagatggcactgagcagggcaacataaatgctgcctttggggtcctgtcagctctgttccttactttctgagggtgctgatccctgcctgttgactagctaagggaggactgtagaaagatgtgtttgagttaccgtggttagactgcctatgcacagtacctgtgagagaaacttaggaggctgggcaattagatgacaagtcctgcgttagagcatgggagatgtggggacccctttcaatgtaaccatcgtcaactcttgtgctgttggggttgagctgtaagatgagtgagtagctgtgactcatcttagtccttcggttgatacgttggcttagcaactatccaggtttgaggccagtgtcccctctctggagtacagtcccctcagttaagaacacgttgtgctgtaggtactgtacattaagtgtgtactcttgctggttttgttttgtttgtattttcagttttactgagcactcttgatagccatggtaactgaggacagccctgtgccaggactgtgttcaccagctttgtagctcacacagagcgacaccattcttccccgtcccagatgcactgggttagggcttaggcctaagcatgcttatctctctgaaggttagtacagaaacagctctgtccttaggaacagatatactttattcaaatggccttaataactgcagtgcaagtctgttgggctcctcaactctacaaagaaccacttgcccaggcagcattgcctgcctttcagcaagaagccagcatcttttcttggtcagaatagccagtctcacatccagtcccatttgtctctattgtgcctattgagaccctcacttttggctttcccttcctctccagaaaggacctaagtgtgaaataccctggagacctccctatcaccctcccgaatctgctgcggttcattctgcatcactcagacgctgcctctgccccccaggaccctggcatcagccctcctacccaagactgtgtccagagcaaggcagtgctgcagcgcgaacacatctctcacgtggagaatgcgatgcagaagctgagatctgagatgagcagcctacgccgtacacaggagcaggtggagggcaggctccttagtgcccgcagggatgggcaccgcctgctgcgccggcagcggaccctggagcagcagcacaggctactccggcgccacagccagaaactgcaggctctgtatttaaagaaggcgcgagagctccaagagctggctagagcctcaggaacccccctccccgagcacacatggctcaagatccttgtggccactatggagagggagctggaaggccaaggtggggctaaggaaccagcccctctgggaaaggctcgaccgaaccactccaagtccatgggtacaactcagttacctggtgacacccctccgccctccaccaccagctccactttggcttcagagacgaagcatgagaataggacagactaacttttgaaggagccagaggtgaagactgtacattgggaatatagttatgcaaattttattgaaatttattgtaaataaagatctttctcagtggtctacaaaatgaactcgaatgtcatttagcatttattgatcaggaatggcatcccttccacttattgcacacactggtagctttgagacacagcagtagcacagtccatttgaacatatatctaggaaagtcagttcttgcttcagtggcttagcctcggagttcctgcaagctccccaggatgaaaggctagcttcgtaaccatcagaagacctgaccctgaccctcaatagttacactattgggaaaaaaatctgaagagaagttatgacttactaaccattggagtgtacggctctggtatacacttaaaaaggtagccagtgatagccaaggacagggaagacttgcatggttgttcaacagttctataggtgttcgttctccatatgacctcaccaatgccccacagtgcctgaacttactcgtccctctctggatggactgactcaaacttgaaagaccccctggcaacagggggtgataggaagctcccccaaagtgtaactgataagaatgtggtgatgtctgtttgaaaagccaacttcatcagcatagtacaagctgcggcctgcatctgaccctgcagcgatgaaccagctcaaatttcggtgtagatccaagctggccttggatccatggatgatggagaaaaggatcagcagtgtttaggctgctggctgcaagacgtaggaggtagaaaggtggatgtggggtgggaatcggtaaaacccctccgcctcagccaactccaggtagatcctttgataccttctgttcccctcctagacctacagagtcactgctcccaggactaacacacatccaagaactccttagcagcctctgtccatggccagtccatctttgactacctctgtgtaactaaggtgtttaacatctgcctcccaaccccatattggtatacactgctaagaagtgttccttccctacagctcctccctcgggttctaggaaatggattagtttcacatgcttttcaaagctgtctccagactagcctggagctctctgctctctgcatcaccaagggtaccagcatagtcaggtttaatcataatggttcagaatgcttacggtgatgggattaacatctgagcaagcttatagacataagaaatatcctggagacatgttgctggttcccttacctgtgagaaccaggccctgaacctgaactcttggtgactcttgtaaatgctatgtgcacaatagaaatgaccttctatagcacagagtgccttgagagctgtgtcaggaagctctgactacaaagccccaaggatcaaagtaaaacccaatacccactggagaagaaaggaagctcacttgtgaaaaggtggggtgtgggggatgtgcgggnnnnnnnnnnnnnnnnnnnnnnnncagacttcaagtagcctccacaggctctggtgtctgcagaggaccagagcagtttctgcaaagcctgggctgaaggggtgtactgggcatgctcaaaaccaaagggcaagagactgctctgccaagctgcctggcaaccctcaggactcatgaggtctcatccttcacaggcttccaagcaagcgcaacagcttccttgcagtgactccgccgtctacacacactgctcttttaacaaagctgaactagagaaagggaggggtggggtgtggttttcctccattacgaagcaagctgagattaccccaacaccccagcttcttaacctcctttccatacgcatcactaaggcctcagtgcaccctgccgagggcaactggggcctgaccagtccaagaccctccatggtcgtacctcagcttacgttgagtacagtcattatcaagccagtccacgggctccatctggtattttaaaaaaatcagcaaaaaggcttaagcacgtgcttctgggcctatttacagttcacaggttggttagttcacgcattacagtagtagctccatcaaaaacaggctcagctaaaacattcaagtaaggaaagcgctaaggggccaggagccccagcaaggtcaggcctgcccactgcctgcaatggacagcccaccaggaggcggagggggaaggccagaagagctgggacctggagccagtgcatgcgatgacaaagcccgaggagaccatgccagcaagtgtcaacccctctcacagagcaacgtgtctgcttccaccctctcagtgcttctgggctggctgcaaacagaaccatggccttggccttcacagcccagctcagccatgcacttctgggctgttggcggtcatcaacttggcctttctttccacacatggccccttagcagagtactgcaccagtagaaagggctcctttgtctcgccatcacccacgatgctctcctcatcctctgactggctgatgcgctgcagccgcaggtagcaccagcagcccaggatcaaggcccccagggcagctatggcgatgaggatgacaatgaccgttaccaccccggtggtggggctgtggtccataatagacatggtcagtgcttggaggggcttctttggtggaaagctcttggtgtgcctggctcaacgaggctggaattcgggctgcacaggacagtcctgaaagacaaagccaggagagactatacaaggggctctgtaggggacaacccagtgacaaccataggattggctttccactgtgtctgccaagatgcttacccagcctacttcccccagctacttctgccacccaggtgcttccgctgtgagtggaaagggaaatgggcaccatggcagttgaggcagaagctacaagaggactggccactaatctggctctgctgaaggtatacactgtctcctctttgagacagaggctcactctgtatcccagaccatctcaaactcatgattctctagccttaggatcacaggcatgagctacgagtgtgcatccagtactggtccagaaggctggagaggaagcacccagaagcagacacacagcatcagctcctgtggaagagtcgggtaacacagaacgcctcaatcttcaaagtctccagcgtctgcgcttctagaacccagggggaaagtcacaacagcagacagatttgccccatgtagccacagcttgtcagtgaagaccccatttttcaagaagtctatggatgtagggcaaacaggtcctggaagacataggtactgggaaagcttcaggaaagacaggagggatggatgagggagttagctccttctgtatatagcttaccatctagtatagaaaccatatagccacgaggtcaacactctaaaatgtcagtccagctatgatcacatcaggagcacaagggaccaggtgctatgggcatttaccacagggggagcagcattgctaggcctctgaaggcaggagagagagcctggtgcatcgccctgttagagtgccagctggactcatgcatgctgagggagtgatgccaggacacggagagctgagctgttcccagctccttgatctcagataactccaggtcccagtcctcatccttagccaaggctgcgagtggtaaaggagagagagagaggttgtgggatgcacccagggcctggagaacctggactccagctttcctcttaaacggtaccccagagctcagccagccacagccccaaggattgctaaccctaagctttgctactgaggcctcccaggtgctgaagtcagcagcaggctgctccagtctcttacaggcacctactttcttactagtgcttgtcagtagtgaacattagagtaagtgagagggatgaagaccccataggcatgtcctgcacaggccaggcacaacctacactgaggatgccataaatgtccaaagtcttgccattcatgtcacccaggtagatggcactgtaagattcacactccaaatgtgatgcatccttgagtaataatccccttagttagaaatgactctcacggggctggcgagatggctcagtggttaagagtgccgactctcttccgaaggtcccgagttcaaatcccagcaaccacatggtggctcacaaccatccgtaatgaaatctgatgccctcttctggagtatctgaggacagctacagtgtacttatatataataaataaataaatctttaaaaaaagaaaaaaaaagagagagaaatgactctcactcaagcatggaggctaccaggagtcaggtctgcctaaaggtcacaggcagccagtcaattccctggaatgtccaggaagcaggccgcatgaccaaagaataccatcctcattgcctgtgccagtcttcagggaagctccagggagggggagcaccctctgattctcgatcttcagtctctagtgtctgagctgcccggctccctctcaactggctccccgtccactcttgcaatcagagcacacagaatgtacccaagtgcttccccattcccgctcactcctctccagccatgtgccttccactgtccttctgggcccagacctttggtcacatagttctttctgcccagggtgctccattccctgacctttgatcactaggtctcaagttgagttcaactatgcacctggccacacttcggcaggcagagtccaaagattctgctccatacccttcaaggcataggatagttcccaaaaccttagtgcagaacagcttggccccannnnnnnnnnnnnnnnnnnngtggaggaagaaactctgacctagtttacaccagccaggaaggaagcctctctcaaccagaaagcctcggctgcctggcccctggcttccccacattcccagagctgcgtgtcccaagagagctctgctggctccatcagttcccacaagcccacacagccagcccacacaggacacccactccgcctccacctgcacgtcttcctgtgggctggaccagaaggcaaggcagtggcaattcagaaagggaagtttgtgtttggggtctggggtggttctgggatcggaagtggaaagtcaaacaatggcaccatgatctaagggaaacagctgttctgtgactaatgaagaaactgaggcagctcaaactcctgctcactatgcccactaggcttggaggtggacagaaccagatatatgcctctcacctaaaagcacaaacaatgacttttgacccagccagtcatgcctgctctgtggcctccattagggcttctgtttcttttttcatttagcaaacgtttcctgagaagttctggccagacatgatagcctcagaagggagggctcctgagattgccccggcatcccctgcaggtctggctaccacccatacttcatgaacatgcccggtggtggcctccgtccttaggactgaacttagcactttctcagcagtgactcctggagctgctttcaagactcccgatgctacctcttcccacactggccagcacctacacccctacatgcaccatctttcctaaggccctcagctctctgcagttctggtttacagagtagtaccctggctgtcatcttctggcctgtgccctcccgagagactaagaaaaggtcactgcccctcaagttcacagctatgttctactgcatacatactcaataaagactgactgagtataccaaggccaggcatgtgatgatgagctgaaagagagctggctctcatgggatcaaccagaggaccctatttttgagccagctccctaagtccagacttctcccagttgcctactcacaggtccccatgcctgctaggaagcagccatggggaatagaggatgtaacccaagttcagggcagggccaaggcatggcagtagaggatggcaggtctgacagctaactgacagctagctcagtggttctcaaccttcttaatgctgcgaccttataatacagttcctcatgttgcggtcacccccaaccatagcattattttccttgctactttgtaactgtagttttgctactgttatgaatcacaatgtaaatatctgtgttccgggtggtcttaagtaaccacatatgaaagttttgttctactcccaaaggggttgtaacccataggttgaaaaccaaggtaattctttatgcttggggtaaggtaggtggtaacagggaagcagaacccagaggatgctgggatgccctgcatctggcttgtacaaccctctgcataaccactgaccaccccatttcattcaccaaggcccatgggtcaggcataatttaacccagctgagggaagttccaggaccacctcaaagctatgccattacatccaccttactcctctctacttgccttgatcatcccattctgcttatgaggaaactgaggcacagggtcagaccacagaccatcccacgtaccctgttcgggagcagctgcagtgacaacttttaggtgagcactggtcaatgtgggtctgggcacaccacagccagttcagtctgcaatgctgagaattgctgggcctggtttctcaaggcccagaccaatgggtaactggtcctagaacacactggtctcaaaatgacatacagtgtggtgacctctgggcagaggtctcctaaaattcacactctcctttaggtcttccttggaaaggcgtctgttatccctacctcttcatgggatcccaaagctaacctttcaccccacccagaaggcaacaaggcaggccaggttctcaccactcttatccacagcaggctgttcttaatgtcttgcctttttctctgtaacttcttgtacctcagggcacaaagcctggcctggacccatgtcacaaatagcctcttctctggggacatcctctgcctactcatcacttaactgggcacatcaccagtgctattgtactcagctgggcaccactctgccactccatccaaagcttccacctcccagggcctccaaggcagtgagaaatactgccctgctttcagggccaactaacatccaggggcttcctgcactgctccatcctccagcaaggccaccttccaagtgtcctcttcaggggaccccagaccagaagtatttcctgctcagggttctgcttggtcaaaccccaaaggcaccatcaccgagggcttctgccatccaagagcttagatggaggaccaacagcaacaggaaagaaaagggaacatctatcatggctgtgcccattgtcctctcccctccccttcctcctccagaagagaaatctgctccagatgccaccctactcccagttcttatgccaggaaaggaaactaagactaagaagtttgggaactgcccgaggtgagctgcaatctcatagtccaagcctgaattctgcccccactcgtcagggtcccatctggccatacaactctggcggtgatataatagtcgatgctgaaaagttccttgatgccacacttttgagctccaacatctcatgtggatctctccaaaacttctgcatcaaaacaatcctagaaccgaatgactgctcttcctacttgacaaataatctgtagcttagagaagttaactcggtccccaaggtcacacagtttaaaaagtggaggtgcagatacccaggaagccccgatcctaaataaccgatttcaaacctgattctaaaacgtcatatgtctgacctgtcttctttctcctgaaagctgagcacaatgagtctgtgtttgacccctccttaggagatagtctaggtgacctgggtcgagaggactggacactaatgacaagcgtcccagcagctcccgcgtgctgagcgcgggcggtgtgcaggcgcggtgccaggcgacgccgcgtctctcccactctatcgaaggagcaaggcgaggcgctagggaagtaggggcctgttcagggggcgacagctgaggaggaaacgacagctgaagacaaatcaagtccgcctgaccccagtttttttccctgggggggggggtcccagagacccattcaagcccacgccgcgcaatcactgccgacccgacctgggaccaaacgctgcggctcagcctcagtctccccaccaatgaaacgagcgccagattttccctgggcccccgttcccctcgatcccatcttgaccacgctggggcgctgccaggaaccccgtcaatgcggagtgagtgttccaggcagcccggaggatccgcgcaggacatagaaccgtgggtcacggagaggggcagatgcccagccaagcagcctccgccccccgctacctcctttgtcccaatcccgcggcggaggacaaagagcccccgcccgcgcgcggcatctgccgcgccgacccgccagcgccgcaccccgatccatccggcgcgtcccttccccctacccgcctgctctgcccatccctgctgaccatgtcgcggcccgcagtcctgtgcaattagccagcagcagccccgccgccccggctccgcctgcgcgccagccgggtcggccgcggagccctcgccagacgccagagcccgatcagcagggggcgaggtgcttgggctccgccctgattgggggcggggcgctctggtgcgaccaactggagatcgcgctgggacggcggggcggagcggagcgggctgggtggagtcacgtgcgctctgggcccggaggcgcacaatgggcagagggagtgtaagcaagggggtgggtagtgtttctcagctggcggctcccggagctggggcagagaaggcgggaggccaggcttccttgagcgcttattgggtgccggcagtactgggcctgcgcctggcgtcctctttcttcgagggtcaacccaacgacagaggggaaactgaggcgcacagcggtaagagtgtgatacaccgcccggagattacaggcagagacgaatgattttctttccttttctcatcttttcttttctcttcttttcttccttccttttttccccttcaattccatcattatcctttcatctatccacccttctgcactgatcatgtatcttgctgcgcccttgagccactagccagacaaaccaggtcctgtcctcagggatgcggactcaataacctcttagttaagccttcaccaagtgccgtactctgttcagtccactcaacaacatcaaaagaacgccaaataaaaacataccgacccatttgacatgaggaactcaacactccagaagacttaaaatactctgatgtgctgtcctggaggcaggatttgaagctagacacaactggctaggaacacaaaggtgctaattggtgtactgactgccccccaaaaagagtctgagagaggatgggacactccgtgatggccaccaggaactccacaaagagtttgaagacctctgaggcccaaggtacttgggaagccaggaagaaataacttggttggggcagataagactgggatatccccctgggagctgggaagctagggactgctaactttcttaaggtcctgcacacaagctgaagtgtgggaactccctcacttcacctcagcagagtgattcccctccatacctctcatcctttggcccatgtcatttcttttatcttaaacgttcttccacaccatctttcagatctcagcttcacacccttgctctctttcccagtcaatggactttcatgtccattgggaaatcgtgttttctaagggcatctcattagctttcagtctccgtttcaggactaagactgaatcgttcactggtgagcctacagaacagtcagtacacagtaggctctttataagatataatgaatgaatagtaagatggcaaggctgtctctgctgctgaaggactgggctgaggaagtaagctggctttggtgtagagaggcagaaggaagcagggctctgggccagctgccgtagagcctagagcctgatggctctgaacagctcctgttcacagacctgcccatcgctgtgcgtcctcagagctcctgcctctcattagtggtctaggcctggaataggtaggtccagaactccagagctggggctggcagggagataaacacgagcaggtatatatatgactgaggggaggacgtggggagaggtgagcagcataccacagaaatgacttcaaatctagccttgcctactggagggctaacctaacctctgtgtctcacttttcctcatctgaaaaatggggtcatcagcaaacaaacctcatggaactgggaacccatcaagtaatggg

SEQ ID NO: 1748 - DNA, 2961 bp, Mus musculus
gtgcggggccgggtccccgggcccgaggtggcggcagcgacggtataaagccggccacggggagcatgtaatgtcggaatgcggaggccgcggcggcggcggcgggaacaacagcgaggacgccgaggacgagggtggcggccccaagggctcaggctccctcagccctgccggggcggcggcgtccttggagggccggatccgccgcggcttgcgcggcgcctcgcttatggcgcgccagcggccagagctgctgtgcggggccgtggctctcggctgcgccctgctcttcgccctcaagttcacttgcagtcgagcaaaagacgtgataataccagcaaagccgcctgtcagctttttctcctcgagatctccggtccttgacctcttccaggggcagctggactatgctgaccatgtccgccaggattctgaggtggtggtgctgttcttctatgccccgtggtgtggccagtccatcgctgccagggcagaaattgagcaggcagccagccggctttctgatcaggtgttgtttgtggcaataaactgttggtggaaccaggggaaatgcagaaaacagaagcatttcttctattttcctgtgatacatctgtatcatcggagttttggaccaatcgaatacaaaggccccatgagtgctgtttacattgagaagtttgtccgccgggcgatgaagccgcttctctacatcccgtctcaatcagcattgctagactttctctccagctatgaggtcttccccagggaagtcatgaacttcacagctgagaacatctataagtgggcctcagaaaaccaggagaccctcttccgatggctacagcctcatggaggcaagagtctgctgttgaacaatgagctgaagaaaggaccagcactcttcctgttcataccgtttgatcccctagccgagagacatcctcttctagatgagatcaccgaagtggccttggaatacaataactgtcatggggaccaggtggtagagcgcctccttcagcacctgcggcgggtagaggcacctgtgctccagtccctggcaccagagctgccagcttcactgcctgatactcagctgatggcagcatccccctgctgtaacacggtggtgctgccacaggggccagccctctccaggactcacaatgtctgtgagctgtgtgtcaaccagacagtgggtggtaccaggcctagctcagtgagtgtgccacagtgcagcttcttcgagatggcagccgctctggattctttctacctcaaggagcagactttttatcatgtggtgtcgggcagcatagaatgcagcaattttttaacctcctatagccctttcagctactacactgcatgttgcaggaccatatcccggggcatggcaagctttactggctctgaacagaatgtcttgacagccccagccatcgagttctcttccttagagaagagctgtgaggccactgccccgagctccattcctcacattgaggagaacaggtaccgctttcctcaagtgggcctcactagcacagccttcacgggcctgagctgcagaaccaacaagaccctgaacatctaccttttggattccaatttattttggttatatgcagaaagactgggtgccccgagctctgctcctgtgaaggagtttgccacaattgttgatgtgaaagaagaatctcactatatcctggatcccaaacaagccctcatgaagttcactctagagtcttttattcaaaacttcagtgttctctacagccccttgaaaaggcatctcactggaagtgattctgctcagtttcccactcagcatttgatcacggaagtgacgactgataccttctgggaagtaacccttcggaaacaggacgttctgctgctctattatacacagtggtgtggcttttgcccgtctctcaatcacatcttcatccagctagctcggctcctgccagaggacacatttactgtggccagaaaggacctaagtgtgaaataccctggagacctccctatcaccctcccgaatctgctgcggttcattctgcatcactcagacgctgcctctgccccccaggaccctggcatcagccctcctacccaagactgtgtccagagcaaggcagtgctgcagcgcgaacacatctctcacgtggagaatgcgatgcagaagctgagatctgagatgagcagcctacgccgtacacaggagcaggtggagggcaggctccttagtgcccgcagggatgggcaccgcctgctgcgccggcagcggaccctggagcagcagcacaggctactccggcgccacagccagaaactgcaggctctgtatttaaagaaggcgcgagagctccaagagctggctagagcctcaggaacccccctccccgagcacacatggctcaagatccttgtggccactatggagagggagctggaaggccaaggtggggctaaggaaccagcccctctgggaaaggctcgaccgaaccactccaagtccatgggtacaactcagttacctggtgacacccctccgccctccaccaccagctccactttggcttcagagacgaagcatgagaataggacagactaacttttgaaggagccagaggtgaagactgtacattgggaatatagttatgcaaattttattgaaatttattgtaaataaagatctttctcagtggtctacaaaatgaactcgaatgtcatttagcatttattgatcaggaatggcatcccttccacttattgcacacactggtagctttgagacacagcagtagcacagtccatttgaacatatatctaggaaagtcagttcttgcttcagtggcttagcctcggagttcctgcaagctccccaggatgaaaggctagcttcgtaaccatcagaagacctgaccctgaccctcaatagttaca

SEQ ID NO: 1749 - protein, 875 aa, Mus musculus
CGAGSPGPRWRQRRYKAGHGEHVMSECGGRGGGGGNNSEDAEDEGGGPKGSGSLSPAGAAASLEGRIRRGLRGASLMARQRPELLCGAVALGCALLFALKFTCSRAKDVIIPAKPPVSFFSSRSPVLDLFQGQLDYADHVRQDSEVVVLFFYAPWCGQSIAARAEIEQAASRLSDQVLFVAINCWWNQGKCRKQKHFFYFPVIHLYHRSFGPIEYKGPMSAVYIEKFVRRAMKPLLYIPSQSALLDFLSSYEVFPREVMNFTAENIYKWASENQETLFRWLQPHGGKSLLLNNELKKGPALFLFIPFDPLAERHPLLDEITEVALEYNNCHGDQVVERLLQHLRRVEAPVLQSLAPELPASLPDTQLMAASPCCNTVVLPQGPALSRTHNVCELCVNQTVGGTRPSSVSVPQCSFFEMAAALDSFYLKEQTFYHVVSGSIECSNFLTSYSPFSYYTACCRTISRGMASFTGSEQNVLTAPAIEFSSLEKSCEATAPSSIPHIEENRYRFPQVGLTSTAFTGLSCRTNKTLNIYLLDSNLFWLYAERLGAPSSAPVKEFATIVDVKEESHYILDPKQALMKFTLESFIQNFSVLYSPLKRHLTGSDSAQFPTQHLITEVTTDTFWEVTLRKQDVLLLYYTQWCGFCPSLNHIFIQLARLLPEDTFTVARKDLSVKYPGDLPITLPNLLRFILHHSDAASAPQDPGISPPTQDCVQSKAVLQREHISHVENAMQKLRSEMSSLRRTQEQVEGRLLSARRDGHRLLRRQRTLEQQHRLLRRHSQKLQALYLKKARELQELARASGTPLPEHTWLKILVATMERELEGQGGAKEPAPLGKARPNHSKSMGTTQLPGDTPPPSTTSSTLASETKHENRTD

SEQ ID NO: 1750 - DNA, 32706 bp, Homo sapiens
aatactcatttctttactttcatcaatacttgatgtttcctttgtcttaaattcttggcaatttgagggtcaaaagtagtcttttgttttaatttgcttccttttgggatagtgaggttgagtttatttccagtaattattagccatgtatacatatttccttttctgtggtttgtccatgttaacaattttccttgttgatttgtataagtctttatatatgctagatttgttcatttaataaatattttttgacctcttaactatacaccccggcacttctgtaggtgctgggatactagcatgaaacaaagtctctaatttcacagaaattacagtcagaagaggaaattgggccgagtgtggtggctcacacctgtaattctggcactttgggaggcagaggcaggcacatcacttgaggtcaggagttcgagactgccctggccaacatggtgaaaccccgtctctactaaaaatacaaaaattagctgggtgtggtggcacacgcctgtaattgcagctacttgggaggctgaagcaggagaattgcttgagcccatgagacggaggttgtagtgagccgatatcgcaccactgcactccaacctgggccacagagcgagactccatctcaaaaaaaaaaaaaaaaaaaaaaaaaagaggacattgggccaaaggaaatctaaataaatgaatgagattatgcaaatgttaataagtgctataaaaaatagggtaattggtaaagggagtacctgaatgggtcaggagcccagtttccctttgtaaactctctcccctaaatattagctgttaggtggggtggtcaaggaaggcttctcacagaaagtaggagctgagatgagtaatgacaaggaaccagccacaagaagtgtccagacaaagagaacagcatgtgcctcagcctgtcatcaatggggacaggtcagaccatcataggtggacacaggggactcctcagcacaagtgattgtcagagacgttagtcagagacatcctctcagaagcaggcttgacatctgaggggccgaggtcggtttcaggaggagaggttcctcagcgcctcttccttccctctctaggctaggttaccagaaggagcttagctgcaggggtttgtgcttcaagacttgatcactgggttttgtggttgttttaaggcacaggccttttctttaataaaggaaaattttctgtttcagattacctaggaacagtacgatttggggttatcacaaataaacatcttgcgaaactggtatccttagtacactctggaagtgtgtatttacatagacatttcaacacatcacttgtaagtattttgaaatcacgtttatgttagcgcagtggttcttaaccttgtttaggtcacagactcctttgagaattggttaaaatctatggacactctctagaaaagcgcatatgattttatatatggatggagagttcttacagccccaccctagagcccaggctccaggttaagaacccatgcattagagggctcttgaaattaatgtatagaaattctttatttgtattcttagattttggtacagactttaaagtttttcttcttggataaaattgcagagttactctcttgaagaattgttactctgagcccgtgttttcagaagctaggcttccactgagtgatgttctgtgtttatctgtttcttttatgatgagtagtaatgtgacatgcttttctccttagctgatgtaatggatttttgaagttcttgtcaagtcacagtgagaagttgatggcttctcatcccagagagcgtcagttttccattgtcgcctttgttccccgatttcatttgctttctgtggagcagcctgaactcagctgcttctgagcattgacctgtgtcctgctcagtcctatgcgtctactctgttgctgcttcctaagtcacatcactgagttgactttcctgaagtattctgtctctctcgcatcactgtcagtaacttacaggtcatatacagatcaatttccctgcacccagtgtacccagcctttaaaacctgcgccccccttggcacaatgtctaagtcttgtgccttcggaggggctgttgggcccactccaggggtgcccccttgcttgccagtcgccctggcttctgcatatctctcgtagcccagatgctgtgctttacttcttgcagtttatattccaaaagtcaaatgtatttttgtgttttccgaatggaaatgtttgagtgtagtttgagtatggtttttcaaactcccatcgtcccaccttgacaatcactgctgtggttgtttctctgctgcccacctacgctccttgtgcctctgcctaagctgctttgacatcatctgcttttgctatctgtcattttcctacatccttcatttttagcatgttacacagcctacatatatttatttatagtaaagggtactgagaaagaaattaaaagtagatggggaaagaaaggtaggactatgagatggaaaaatatatcaggtttctgcttcgatttggtagtgattaaggttggttggtttgtgtagcagtagaattccttttatcaaatgaaataatactgggataccattatttttaaaaacacaagcagtggttagtctctgttatgagtcaatttaaatcttcgttttgaggagttttaaatatctcatttttcagaaccctctgaagcacccctttggtagttctgtttgaagccagtgatttaaattgttagaatttcaaaaataattttatgttcacatacattggttgtttatagcaaaacaaagcaaaaaatctaggtgtctctttcatttattcgtacacgtaaaatatgatccgtggccttgtgcaagtttaggtcatttttgattgctgaagacatgtgttgagttcctgctgtgtgcctggtgttcgtctaggcccggaggatacaggtgagcagaacagacagcctgtgccgcacggaggctccatgctgcccttgggggcagcatttgaaggaccaaggtcaaaatctaaatgatccttgactctgtagtttctgttcccttagatatgtcttggtccttttatgaatacccagtgacgtttaatacctgtccttggacagggtgatagaggttgttatcgccaccagctggcagggagaattatttgttgataggtgggtctgtctcaaggcagaaagatgaatcacacgatatggaagtcacctcctgcaaccacttttgttttttcaaccacttgtgaggaaatgctgtctctggagaagcgggtgttagctgcacagtggggccaggccccgctccacgcctgggttttctcacccttagtggtggggttggaacagcactgatgtgccttgagcttgccccacctcacgagctctcctttatcctctgtgcctttgtccttcacaggtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgaggtaagagctgtgatgtgaaaagcacctcatgaggagtaggaaagcctcatctacctggctcctctcatcccacactcagtcatttactctggcagctaatggctgccacgaggggcagctgtggctctgagcattgctctttgcccctccatatgggcaggagagagcccgtgtctaggacagggactgccgcagcctctctggccatatttattgacagctgttggtgtctggagtgagtgggaagaggcagggaagccacaccgtgcccttctagagaaggaccaaatgccctcttctgatgtggctgctgttgagcttcctgtttagggggtgaaacagggagtggcaggaacacaggccgagtttagtgtggcctaggagatgccattgtcttgggggtttggccagactgccagccctggccatcctcaggacagcagaggagagcgagcagcagcagcgatgttgggacaccttgtttctctgaaccttccctgtcgtgcagaagccagagtggttttcagaggcagcgccatcggagcctgctgttcctgcctgtcttcggcttcatctggtgcgcctgctctgggcgtgagtttattttccacacggagcatttggaggcgctcagagacagcaggcacattttgcagagcgagcctggagagacagcaggcacagtatgcagagcgagcctggggtggcaaaattgcatttactgaggtttttattttttcactccctcaaggatcccttaattggccaaaaccaatttcagacagccagtgtaccactggccagctaagcagacctgagcccctcagcgctggcctggcctcctgcctggagggacagggaggcaggacttctcgcccaggtggatccctccctttgctgtgctggagtctttttgctcaagttatgattccctctggggagtattctgaatgaatgctgctctttggtttagaggaagaaagaggagagaaatgaaatagctttgtttcttcccctctaattagggaggactcaaagtaataaaactatttctttagaaaattttcactacatggatattttgtgaactgaggcaccatttcaaatgactaggcctttactgtatctaatattaagagccttaaagctcattgtaggaaaggaaggttttcggtcaaggtggtgtggctgtggttgtggatttggagagttctctcctgtctggtttgggtgtgtcagggtcctggctgggttgtattttgtggcaggagcccacagcctctgcccagagggttgtggttggatttaggcacctggtgggaagactctttctcgcctgttgtttctgaatgagtgtcccctccagcagtctgcaaatcctccacctaccaacaggcctcctttttatcatggttttgcctgtgactcctttctttggggctcccattgtctctgtgaggtgagtgcgttcccttaacttcagcatgtgggtgagatgaccgaacacgaggtggcatctcaccgtattatgaattactcagacaagcaaagtgcctgtccagcacatttccctttttgtttcaggtcagtttggcaaatgtttactgagcactgtgctgggaagctccaggggagaaaggatagatgcgacaccatcttgtcctgtggtcttagaggcttgtccagtacagggagtgaaagcctgcctataattcaaagtagaggacgatcaggcccagggtcaggaggaaccagaggagggagggtgccatctcagaaagcggggttccgggcaggggaggagttagcagaggctttggatgggtgaagtattcgagacggacttgtaggggcagccaggatcttgatgggttgagaaaaacttacgggaaggaggaccctgagcagagacatgagggacgggagttgctgcaggtttaggtgttaggaaggaggccgggttttgtggtctgcaggaagggctaactggggagagatcttgaaaaagcctttggaggagagggccttgtggacttctctgaggatttcaagattaaccatagtcatccaagtctttgtcttctcttttttttttttttgagttagggtcttcctttgttgcccaggttggagtacagtggcatgatctcggctcactgcctcctgagctcgggtgatcctcccacctcagcctcccaagtagctgggactacaggtgcacgcctctacgcctggctaatttttgtatttttctgtagagatggggtttcgccatgttacccaggcaggtttcaaaagccctgggctcaagcgatcggtcttccttggcctcctaaagtgttgggattacaggcatgagccactgcacctggcccatacaagtcttactgacagtgaagagatgcagccagggctgtgcgttatcattacgaacgtttttctggcaggagggttccagaaaactgcgaagtagtaagaacctgaacttgggtggtagaggtggagggtggaaagtagggtctatgatcggggaaactgtgacacagtgactagagatgaagaagcctttgggtaaggtgggaaggatgaacgctgtacttacgcaagatgagctgtaaattcattagcttgttgaccacgaaagagttaggtggctttactttttcattaccaccttaggcctaatattgggcagaactttgaggatgcttgcattgttgagaagagagaggtcatcttagagtgagtggaatagagttgggggcataccaagcaccaacattctggacagttgtgctgtggtgcatgtaggatgccagtcaggagtgaccatatggtggccgcaccaagcccatagtgggtagctgcttctacacacatgcatacctgcatgtgtacccacacacacatgcaaaagtacagatcctgacactggcgtgaggccactgacaccctggtgtctctagagagttctagagaggttataagacatcacagtgtgtattacacaacttgttaatcaaaggaaatgcttacctcagccagcaaagagtcttcgtgacttgtttcctattttaaaggtgtttatttgaggcattcacatcgtctgaatctggtaagcaaaggcgtggttagcatgttcaggctcacagatttccctgattaaagaaaatagaaggaaacatctactgtgcgaacagttatttgccaagatttccttaattattcacatgaaataaatgacatcaagtgatacacagaatgtgacatgagttgtgttttcaaaactgcctgttaggtaaaaggaatagaaacataaattccccttcataggagaaaaatgataatgcctaactctttaagagcattgctggctgggcgcagtggctcacgcctgtaatcccagcactttgggaggctgaggagggtggatcacatcacctgagatcaggaattcaagaccagcctggccaacatagtgaaacctcgtctctactaaaaatataaaaattagccaggcatggtggtgtgcgcctgtagtctcagctacttgggaggctgaggcaggagaaacgcttgaacctgggaggcagaggttgcagtgagtcaagatggtgccactgccctctagcctgtgcaactggagcaaaactccgtctcaaaaaaaagcattgctggtcgggcgcggtggctcatgcttacaatcccagtgggattacagccctgggaggccgaggcaggtggatcacctgaggtcaggagttcgagaccagcctggccaacatggtgaaatctcgtctctcctaaaaatgcaaaaaattaaccaggcgaaataaaaatagaaaaaattggctgggtgtcgtgatgcatgcctgtaatcccagctacctgggaggctaaggcaggagaattgcttgaacctggaagtgggaggttgcagtgagctgagatcatgccattgtactccggcctgggcaacaagagtgaaactctgtctcaaaaaaaaaaaaaaaaaaaaaaaaaaaaagcattgctgtagacagaatactttcttcaattaaaaatattctttacgtggctgctttgtttatgagatactgaagctaaaagagatgaagaaagatttttcaaggaattttcttctctataatataattaatgatctcctacttggacttctgtaaaagattacagtaaatcgtgaagtcttatggaggtttttgcgggagtgggtgggagtagttgtctattactgcgtctttgaatctaaaacagtaccaggatggggccagagggcatctgggctcttcacggattatataggcttgaccttgttagtactgcatgctgtcagagcctcatccaaaaaccactgagatgtttttgtgcaggggaaataaaatttcaagcactggcctatcatctaaagtgacttcttttcttgacccagtagttttctggtgggttataaagtgactttttttatgccgagaactattgaaacaatttatttttgtgtacaaatatgtatgttttgaattaactataaatattacgttataaaacttttttatttttatttttataaaacttgtgtttttaaattggaaattacactcattgaattgttttacacatgcagacacacagacacacacacacacacagcgaaacaaaatcctgagtgacagcaccctgtaactaactgtggtgagatttgattcaagttgacagactcttctgttttagagagtaaatgcctttggattataacttacatgtctttctcaggaaaccagaatgggaggtgggtaacgaaatattctttttggaaatggaagaatcttagaataaaatataaattcaaattgccaatactggcttgacggtaaagtggcaaatctcaccaagacagaggattgtgtgcattaccctgagctgccactcattcatcaggggtttactgagcatttgttatgtgcctggccctgtgctaggccccggggatggcaggataaatccaatgtggcttctgcctgtgaggttctgtaagtttgtggggaagagggatgtctcagcagaagcttgtgagactgtagaaggggtctcagggacactggaggtgcaaaaactagctcttcctggagtgggagtaggactagcttccctgaagcagctgccctggtgctgggccttgggaacagatggaggagccggtgtccccagccaggactccgtaaaggtgtggcattgcaggagggcctggtctgttctgaagagggtagggtgagactggaaagccaaacgggccagattgtgtggaggttttatctcatgggcagcgtaccatttggcccaggagtgccatgcctggggttgtatttttaaaaatatagtaaccatctccccctgcactctcatctaccctgctgcgtattcttggtgatacgttccaagacccccaatgaatgcctgaaaccacagatggtactgaaccctgtatatactacacacgaatttcacttttcttcacaatttcatgggtagaagattcgttcttaccgaagatcttaacatccttacctctttttttttccttattgagacttttgccgtttcacttaaaggaagcatttttggcttctctttggcatatctgaattgccagcatcactatccttacactttgggggcccttctaataaataaagggttacttgaagacaagcactgtgatactgagacagttgatctgataactgcgttggctactaagtaacaggctggcagcatccacagcatggacacgctggacaaagggatggctcgcagtttttgtaatggcaaaaatttcatcacactactcagagcgacatgtagtttaaaacttacgacttgtttatttctggaattttccatttagtatttttgaaccggagttgaccatggataactgaaattacagaaagtgaaacgtggctaacggggtgctagtccctcagtcatccccaagcccttcaccaactctgccctgtatttcagatcaccgaagtggccttggagtacaacaactgtcatggggaccaggtggtggagcgtctccttcagcacctgcggcgggtggatgctccagtgctggagtccctggccctggaagtgccggcacagctgccagacccgccaacgatcacagcgtccccctgctgcaacactgtggtgctgccccagtggcactccttctccaggacccacaacgtctgtgaactctgtgtcaaccagacctccgggggcatgaagccgagctcggtcagcgtgccacagtgcagcttttttgaaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctaggtactgcaggcagtttatttccccaagcattgtacattttgcttgacttcatatgggtaaattttattgatggctctcattacatttagttgtggggtgatgtcaccttcgtagctcattttaagtctttagaccaccatcagtcataattttcaaagaagctaattttgtctattaaatggaacagaaacttcctcactctgaattttggataagtttgtcatttagcccatggtgggggtaagagtcccactttctaaattggcgatttctgtcacatgtctaaggtagaaccagctgcaggcagtggggacttggggactagaacaggcagggaggtggagagctattctggtgggatgtcctaggggctgatgaaagtgagccttgacagcagctttgttctaaaggagcttaaagagaaagcagtggccgggcgcagtggctcacgcctgtaatcccagcactttgggaggccgaggcgggtggatcacgaggtcaggagatcgagactatcctggctaatgtggtgaaaccccgtctctactaaaaatacaaaaaaaaaaaaaattagccgggcgcgttggcgggcgcctgtagtcccagctactcgggaggctgaggcaggagaatgtcgtgaacctgggaggcagagcttgcagtgagcagagatcgcgcccctgcactccagcctgggcgacagagcaagactccgtctccaaaaaaagagagcagtgaagaaggaagtagagccgccttgcctccctttttgtctcataggcttaaatgtctaaggatcaaggccaccagacctaatttgttctgctgctgtttcataatgtactgagtaatattgctgggacctggggtacctacactgtaacaagtgtaaagtgcaaataaataagtgtcagtcgcaaaccagcaaaacccactttttgaggagtaaggctccatgatgagaaagcacccagagcttgcccctgggacttggcagcaacattgggctgacccaccctggcctgttcccaggaatttgctgatgcccttgactacacacaatgaagtgagaattcaaaagccacgttagttcagcctcattggaaacgggagggagggtcagtgtatgccgaatggagaaaggaggaatttggtagggaaggaaacctttcatttcaagttttaaagtatgaactcaacagtagactcagagcttctacatatgagtctttttagccatcctctttcaaatctaggtgaagcttgtttcttacattagacacatttgtgaaaaggctttatgtaaatattgatttttctatatcaagttacatattataaatccaagagttcctcactgtgtaaaagaaccctgtgaccagtcactttttgaagggcataaatctgtcgatattatagattactcccaattcatgttatctaaagtcattttgatgtgttgagctttcttaaaatgaaacaagcattttttttttaaatgggaaagagactccagagaaatggggtcagtgttcctacaagcatgtatttttgaggtagtctgtattagattttcctgaattccattcagtaatgctcaagtgtttaatgacctcataatgtgttcactttgaatttaagggtaattgaaagaagccttctttagatttctttccatcttctgtatcttctctgaaatgtttagcctagctgttctttgtcctgcagttagtgacagaattcttagggagcttgtaaaaaacacctactgtgtgtcattgttggtttagagacttaactcataaatcagctgtctctaggctagtttcagaatttaggctttattcagattaggaaataattcttggtttcatgtttcaaaaacatagccaactaagtgtttctcagatgctgatcatgaattctctttagtattcacatgacattcttcacttcctcttccattctgcacgctgcattgcccattgcacctcaaaatggagggagttagaagaaagaaaaagaactgaaactttagctgagtgcaatggtggacgcctgtagtcccagctactctggaggctgaggtaggaggatcgcttgagcccaggagtttaaggctacagtgagctatgattgcagcactgtactccagcctgggcaacagagtgagaccctgtctctttaaaaaaaaaaaaaaaagtgaaattcaaattagtattgtttcagatgaagcaaaggactctgaagatggcagaatttgtggtaaaactgttggttcaaatcaggtttttgattattatgggttttatgtatttttccactacatataattttttcttaacctttaaaaaaagaaacttaaagaaccttaataaaggaaacaaaaaactgtagctccttgtcctcaaattaatgagcatttaaacacattccacactactgtagcttgtgcagttgtcacatttgtggttaagcttaaaggtcttagtattatagggtgaaatttcttgaaaagatggtggcttgttgatgatttatacagtctcacttggtgtctatttgtggaccagtccttttaaaaaaagaatagtctatgaatattagagcatctaacattgcatagtgttttgttatccacattactgtctgctgagttaatactaccagagctaaacctgatgccacccgggcagctttgtttggggttttgctgataggtgaaatgttaaaaatgtgagcctatgaagtcatttgagtttttaaaatgtggagtttaaaagtaggccagctattctctttgtatctagaggagagttgatctcattttctctttatttttagagtcttttattcaaaacttcagcgttctctatagtcccttgaaaaggcatctcattggaagtggctctgcccagttcccgtctcagcatttaatcactgaagtgacaactgataccttttgggaagtagtccttcaaaaacaggtatggagtcatgagaggcaaaagttaagccatctgtccctcttaaaataatttccaaactacagttgttggggtgagcagctgtttttgatgtatagaagagtaaccacgtgatggcccaattatggaccgtgaatgaattacatgtggtttttaaatttcagaaaagtgctccagaaagcacagtattggaaagacctaaagatgaaaattttcactgtaatatttgcataggtagcatttttcgggtgcttgctggattctaagcaatgaggaaagaaatgaagaagagcccatttcccggtgcaagtaacatctgtcttccctttcccacaggacgttctcctgctctattacgctccgtggtgcggcttctgtccatccctcaatcacatcttcatccagctagctcggaacctgcccatggacacattcactgtggcaaggtaagcaggcctcttctgcagcgctttgggctgtatgcccattttcactcttatttgcagcttagccatatggtgtgtgagggtctgcccattttccattaacctttggtaggacttggctgaatttaattgtcaggttgaagccatgagcaaagcctctttgaaactgaacttttcctcatgaattctgagtgttccttccatgatgttgatgtttagccctgactagattcgtaggtggctgagtgcagttctgtggggagagcactgacctggttgccaggatggccccgtggaataccatgggacagttgccccaggcaatgccagtgggtcctgggatcccaagcagatctctccaccagccctggtttatctcatttgtgaaattaaaaggaaagaccaatagatatccacattctggtattgtgattccatgggtactgtatgtgcgcttttgagtaaacaaaatttttaaaaatattttttgggaaaagaaggctcaaatacagagtctttagatggggtagtaagcagttttgggtgaggaaaactgttcacatttaaccccccacctcccccaaaaccctacagatagataagagttaaatataaaaaaatcaaaacaaaaaataggatttgctgattcctctgggagatggaaactttccaaagtggaagcagttggaaaaataaagagagaaaaatggacagattccactagaaatacgtgcagtgaaaacagggaaagcagacaaaaagggggaccattaatatattttccagtgtctctgtgtcacctgttatatgcactgtaagtaataattagaatcaaatctgaggagttactatgttgggagagtttttgatatacatattacctgactgagtccttgcgacgcttagtgaaggcactctagttaaaaaaagaaagtgctatttgtgttgaggaggaaactgagacatagaaagattcgacaagttgcccagagtttcaagctgcaaatgaggggccaggattaaatcaggcattcatactccagcctccccggaaattaaaatggtttagaagatggctgagaccgattccattctgaacaaaggatgtgagcaggtttttcttttaagaggagagagtaaataaacaagtggggaaattataacctaataaatgtaaattaaaacagtaacaaagtatcatttaacatattaaagtaatcagtggttttaagtgacagaatcttgtgttgataaaataaaatggaaactgcagtcagatgtatctaatggaatgagtacattgccataactcttttggaaagcattttggcaacatttacaagaaatcaacaaaaacagttaacacatttttgacccagttaattttactttggagaagtaatggaataggaattccgaagaagcatgagctcatcattatagcattgtttacatccaccaggagatgaatgtttaagtaaattatggctgggcatttaatggaatttttatccttcaacagtgcttttcatacagttaatggaaaagaacagagtatgaaatatatgacaactcttcttaaaaatatgtaaggatataggcgaggtgcagtggctcatgcctgtaatcccagcatgttgggaggccgaggtgggcggatcacctgaggccaggagttcgagaccagcctggccaacatagtgaaaacctgtctctactaaaaataaaaaattagccaagtgtggcggcacgtgcctgtagtcccaactactcaggaggctgaggcaggagaatcacttgaatccagcagccggaggttacagggagctgagattgcaccactgcattccagcctgggcgacagagcaagactgtgtctcagaaaaaaaaaagtaagcatatagaccaagcctgcagcctgcataagaaaggggggccttatttagcccaatggaattctgagtggatttttacaatgttttaattttatagtttgctttctttgaagtaagaatcaagtgagaaaaagcatttaattatggaatatagtgttcactcccacttgtttagaaaggaacactaatgttttaggtaggctggcacaggtgaggcaggagtgctgttttgttagtaaacttttggtaaatggttttcatttggttatgccttttgttgctgttgttgttttttgtttttgttttttgttttgagatggagtcttgctctgttgcccaggctggagtgcagaggtgcaatctcagctcactataagctccgcctcccgggttcacgccattctcctgcctcagcctcccgagtagctgggactacaggcgcccgccattatgcccagctaattttttgtatttttagtagagacgggtggcgtttcaccgcgttagccaggatggtctcgatcacctgacctcgtgatctgcctgcctcggcctcctaaagtgctgggattacagacgtgagccaccacgcccggcgttgttgtttttttgagacagggtctcactctgttgcccaggctggaatgcagtggtgcaatcacagctcactgcagccccaacctcccaggttcaggtgattctcccaccttcccaagtagctgggactacaggcatgtgccagaatacccggccaattttttgtagagacagggtttccccatgttgcccaggctagtctcgaactcctgggctcaaacagtccacccacctcggcctcccaaagtgttggatttacaggcgtgagcccctgtgctcagcctggttgtgccattttttgaaaagcaaatttcatccttttggacacatacatgacacttaccgcaccctcactccccccagttatgctttctaaaaacttctgtcaaggtaaagattgaaaacatgttcatcttttgtgtgcactgtttatgaatagtagctgaatagcccctccgcaaggaggatgcagccccttccataaaggatgctgttgtggctccatgtctgcttagcccgagtgtgggcgcccagctgtgtgcccagctctgtgccagctgcccggggcaggcctctagagcagttgcggttagctcccacagtgattgagcacaggctgggtgagttagtacagatgtcattttctgtattagaaaattaatgtcaaatctgctaagaaaataggctgtttttggtctctatccagatttacaacataaagagggtataattttccatcttcagaggggcttgatgtattttgctcaatgatttcctttcttttcccagagctattcagggattaaaatacttggctagatcctgtcaggtgaggagtgaatgactcctcaggtgtcagtgcggcattttctgcaagttcatttttactttcaggacatcacattgccactcagtggaaagcgtccacgtagtagaatgttgtatgtcttggaagtatcagcgcccagctcacacctggtagtacattcatcgagaagggactagcccaatgtggggtgtaaaaaatgcaccaggttcttgaagttatctgagaaggttctttcaagttggtgtttcttgggctgatcatctgccatttctgttctttccctttaccaggattgacgtgtctcagaatgaccttccttgggaatttatggtcgatcgtcttcctactgtcttgttttttccctgcaacaggtaatgccaaatttttgtcactggtgggcagttgggattcttttgtggaggtctgaaaatgaaatgggtttaagatgtaaatcattcattatgttcaaaaaatgttcccttaggaaccaggcgtggtggctcatgcctgtaatcccagcactttgggaggctgaggcaggcagattgcttgagctcaagaggttgagaccagcctggccgacatggtgaaaccccatcagtacaaaaaatacaaaaattagccaggcatggtgacatatgcttgtaatcccagctactctgaggctgaggcacgagaatctcttgaacctgggatgcggaggttgcagtgagccaagatcacaccactgcactccaacctgggtgacagagcgaggctctgcctcaaaaaaaaaaaaaaaaaaaagtgtccttagggacataaaagggttgtagtgtcaggatgttatgtgtggtatggatcttttaaaggttgtttttcccagtctatctcttacccgagcttgaatgtggccgtgagaattcttagctttcatggcctgtatgaacatatggaggacgcagagactgacaggattcttctgttgccctggctggagtgcagtggtgcaatgtttgtgtggggcaaaacagcagagaatctgtggagccctgcctgccccaagccttccacttgcttgtctctcagttggcctcccagcagctcctcatccctctcgtacagaggacagggtggctttcttacccatggcacgtccttttctcggattccaggaggcctacaaaggggttttctcccatgcgtgcagactgctgtgaacgtccgccatgggatggtcgcttgattttttcacacttgcctaatcagtattccaggtgcagttcttaacggcaactaccccggaagcccctgcaagcaggacattaacaagggggagcggacttccagttagtaaacgtagatgcagatgttttagtggaaaaagaaattaactcttggtcctttagagcctaatacactggatgtttgctccctttttatagattccctttggtttttagaaagttgagtccttttggggacccactcacatgactttgacagtatcttctctccaggggaaagtgtctgcagcatcatttagggagttccctggctcgcatgtatgacgtttgctgttttaatttcctgcctcccttttgcgattcagcttgtcatgtttctctaggagagtgtttccttcatatctattgaatcattcccttggtttttgctttgtatctcaaagaatttttgcgggagtacttctgtggtagtagggtcttgtcacatcatgcactaaaaacagaatgtgactcacccttttctactgctgactgagttgtgatgaggctttttctttctaagaagtgtttaaattaccacatagtccaggaatcacggacagtaacactaacactttcatctgtgtgggccaggagttgggcatgtagtttaatgacgtataatttttgaattccaagcatagtttgaaaaaatatgaaaatcttagcacccagcacatgccttttaatgaagaagttctcagcagctggcagaaatgcatctgtgtagagagacacaggcggaacaggtggcagggtggggcgtcatctggaggcctgcgtctgggctgagtgaccttcgttcttaggctgcctggtgtgggaaacgtgaagatgtgcgcatttctccggccccatgctgggcacttgctgcaggcccttacccttgtcgtttctaaatatcgaacataagaagactgtccacttctcttttaatgtaaggatgttggtaaaccaaagctttatggctttggaatggaatttttctcatttcctaaaaataaatggtagaagtaaagtatgctcatcatgagctggtcccaagcgagtgtttggtttagccagaaggtaaatgggcaagcagcgtgagctgacagcttgcaaaagaggaaatgaaaaaggctgttggataacatgtagtaagacctttttcattgtccacctgcttatgctatttttagtgaaaagaatatgaaattgtatatttactgtgataaaatataaacttgtgcatgtgctaggtggagatgttcacagaggggaaaatgttgaggtgttaacattgatgacttcagaggagtgagattgcaagtgatttgaaggtgctgcttgtatgtttttacatcccttgcaaattgtctacaaagagcatgtcttgatttataaaaatcatgaaggaaaaaaatgcaagagcctgtccttgggaggaagaggaaggggtggggccttgagggagacatagccttcctgtgcagaggcatcttggagccacttgctccaccgagcaggtgctcctccagccagcacttgcgtcagactctgtgtgacattgcaaaatataggtgctctggcctggccctgggccagggtgatgagggggagatgggtgctcctgtccaccaagagactctgatgtgtcccaggggaagaatcacagttttttagaggtgtgccctgccactccctcagggttagaggagagttgcatagacatggggacctcttcccaccatagtttcacatgactgctttcctggaagtagactgttgacattctctgtccctgctactttcacaaagtgtggcagtattttagtgtgcccattagggacattgatggagagtgcaccaagacctcttagttagcagatagcatgctcacggatgtcactgtcctgtaaatgtctggaggtagacatcctgagggatcttggcagctttttctgggaagtaattcacgtttactctgccttacaagaccaggcttgtgccgcagaacgtgggggcaggtccagcgtctggtattcttccatgggcccacttgacagggccacgatgtgttttcagttgttgtggggttttttggttttctgtttttgagacaaggtctgactctgttgcccaggctggagtgcagtggtgcaattacggctcactgcagtcttgaactcctggactcaagtgatcctcccacctcaggctcctaagtagctggatctacaggtgtgtgccaccttgcctggctaatttttttatcttactttttatacagatgaggccttactatattgtccaggctggtctcaaactcctggcctcaagcgatcctcccacctcagcctcccaaagcactgggattacaggcacacagcaccacacccagctttgtcatttgaatggctgggccccacttgaagaaagcttatatgttaagaaaactaagctttaaaggaggggatggttgaatgtttaccccaaaattataaaacaatttacggccgggtccagtggccctgggcagccaggctctggagtccctgctgttgacttccattctgttaacacctgagggagacaaactcggctgccggcccacctcatacctaagtgcataaagctggtagttttgatcaattgcagccaggctgtacaggcacaggtaaatagatatgtgagagaaacatcatcagacgattaaatgacaagttctgaagaggaattttctagatctctagatcaggacctggaacaaagctgtagggaaaacccctttctatgtcaccttccttccttattctgtgctctcagggctgggcagcctgaattcatagtcctttggttgggctgtttgccagttatcaggttgccaggtgtgagccagatgtacctggggaatgggggtacagtcacccccagttgagaacccctgccttagagaatgtgtaataaatgcttgctgaagaaacagactgggtatctttcaagttcttcctttttctccgggcactgtcagtgggcacaagagggacataggtgggacactcctgcctcccctggacgctcttcctgacacagccgctgggcatctccgagcacacagaggccccatgcctacacactcctggggccctgcatcactggctttaggcctgggcctaggagctcttgtctttcttggagggtgtgggtgaagctgagctctggcttcaggaacagataagccatcttaattacagaacgagcatatgggacagcctcagctttgtagagaatttcttgcccaggcaacattttccttactttcagtaagtaaaatccacggaacgtcttttcttggtgagaagtagatggcctggcctcaggtacagcctgcttttggactcattgtgttggtgtgactcctgtctttgcttcctttccctctctctccagaaaggacctaagtgtgaaataccccgaagacgtccccatcacccttccaaacctgttgaggttcattttgcatcactcagaccctgcttccagcccccagaatgtggctaactctcctaccaaggagtgtcttcagagcgaggcagtcttacagcgggggcacatctcccacttggagagagagatccagaaactgagagcagaaataagcagcctccagcgagcacaagtgcaggtggagtcccagctctccagtgcccgcagagatgagcaccggctgcggcagcagcagcgggccctggaagagcagcacagcctgctccacgcacacagtgagcagctgcaggccctctatgagcagaagacacgtgagctgcaggagctggcccgcaagctgcaggagctggccgatgcctcagaaaacctccttaccgagaacacgtggctcaagatcctggtggcgaccatggagaggaaactggagggcagggatggagctgaaagcctggcggcccagagagaggtccaccccaagcagcctgagccctcagccaccccccagctccctggcagctcccctccacctgccaatgtcagcgccacactggtgtctgaaaggaataaggagaacaggacagactaactttttaaatgatatgaagaaatcagaggtgaaaattgtacattgggaatatatttatgcaaattttattgaaatttattgtaaataaagattttctcagtggtctagaaaatcagcttgaatgtcattcagcatttattgaagaaggatgacatcccttccacttattgcacaaacttggtagctttgagacaaatacagtagcacagtccgtttgaagatttgtccaaaaaattagtccatattttagtggctcagtgtcaagagttccctccctgtgcccccactgttgcttctgcagtgatacgaaggatgaatgcttaatttcttattagtcagaaaacttgaatgcaacagttgggcattcaaaaataatccagagaggtcataacctacttagccatttgagtgtggctctggtgtctgctaaaaaaagtagctattgaaaaatcagaacagtgagagctatgatgtggttcactcattctagaagcattttcattttcctcccgaaaacccccccagtgcctcaccgagccccggaccttcacccaacacggctgccacgctcaaatgggcctgattcaaactcccaggtacgtccctggcaccagggagtaggataagaaaacctccagaagtgaaactgatgaggaagtgacatttaatcacttcaaaaccgaaacttcactggcaaggtcaaaaccccaggccaaggctgacaatcgagcgctggtcagttccaggggtcaggctcggaacctgaaaatgcagatcctagctgttgctgcgtccctcaggtgtggaggaaggaaaaacagcctaggtgtatgtgctggctgtggtgagagtcgaggtagaaagcctggaagttctgaaacgtgaggggatggatcacacgccccagccttttctcactcaccaaagcaaacttttacccccttcttccagtcggcacctttggaacttgttctccctcctaggcctggtttcagtggcccccaccacgtgtcctgcccacccagcctgcagggcttctgctgacatcacgcctaccccaccaccacctcttctgaacttgccacaccatcagtagccagaggtgttgcctctcctgcttcctaaggtctcccaagagcccagctgaggtgtttcattaccaccttctgctcaggtggcccagccggctgtccctcttccaccccaagctcctacttaatgtttaaacccccaatttaggtgtatgctgcttaaacgaacagctccctacttctcccgcctcggggttccagaacgtggattcattcaacatggtttttagaagaggcttgggtgaggccagaggaggtgcctttagtctgagcaggaggccagagctctgagctcagccatgaagggccagtgctctgtggttaagccggggctgaccttccatctattacagggatgggcaggcacgagtcacatttgaatcataaataaaattagtatgtgcttgtggtgggattaaaaatcaaagtgagctcactgaaatgtacataggggaggccttggagacaggctgtggagacactagctcaccagagagccaccagctcaccacctgtgggagagtcaagtcctgaacttcaagttcacctctgccctgccccggctccctgccgcaagcacaggctggcaggaagcagtctggtggctcttaggggaatgtgcacgtgagaaatgttccctgggtcctaagtgcctttagagctgggtcaggggactggagacccgctgaggaaagtgaagtcagaaccccataggcggacggtcatcagagaggaaaggaagccaagtgatgtgaagagggaagaggaaaagaagaaaaaagacagaacctcaacagtcccctcccctccagtgcagaaaataggaaacaccaacacaaaacatacaaccttttctctttcctgggccaagtgggtttcagaccaaaagtagccaccacaggctctatgaggaccaaagcaatttcagcgaagccttcactcggggtggagggttggtggggggcttggcgtgctgaagacccaagcggcaagaaactgctctgctacaaggacgctggcagcctccaggacgcgtgccctgactcgcccttcactggctcccaggcaggtccggtagcttccctgcagtaactccactctcaacagaactgctatttaacaagtgagtctatgcagaaagaacggaggggtgcggggggtgtggtttttcttccacccatgactaatgaagcagagatcacccaagcaccccaactggtcagcctcaagaccccaaattggcatctcacttccttgacatacacgcagatggacacacatgagagacccctgccgagtgtggcgtgggcctttacaagcctatgaccctccagggtcttgactcagcttgtcattagtacagccagaataccagtcccgtgtgcgctagatgatatttttaaaaatcagcaaaagggcttaagcacgtgcttccaggggcctatttacagttcacaggtttgttagttcacgcattacagtagtagctccatcaaaaacaggctcagctagacattcaagtaacaaaagcgctacagggccatgagccccagcaaggtcaggcctgcccagtgcctgcaatgggcagcctcacctggaggccgaggggaagcccaggacagccaggtccccgggcatcagtgcatgcgatgacgaagcccgcagaggccatgccagcaagtgtcagcccttcctctcagacagcagcgcatccgtatggttttgcccctcccagcgcctcttggccggctgcaaacaggaccaggagccttgcatcctggctcagccgtggacttccgggccgttgggagtcatcagcttggcctttctctccacgcacggtcccttggccgaatactgcaccagcaggaagggttccttggtctccccatcccccacgatgctctcctcgtcctctgactggctgatgcgctgcagccgcaggtagcaccagcagcccaggatcaaggcccccagggccgcgatggcaatgaggatgacgatgactgtgaccacgcccgtggtggggctgtggtccataatagacatggtcagtgctgggggcttcctcggctggcagcactttgggggtggccactcagtgaggctggaactcaggctggacacgggagtcctgaaagacaaagcaggttgacgagctgcggttagcacttccacggggtctatttttaatcgttctcagacctgcccatcccaccctcaccctgacaaaaagcatgctggccggcgttcgaaggcgtctgctcacccacgctcacccagctcctgttcatgacctttgaaaccccgagtgctgctgtaccaggcaggtgagtcaccctcgctggcggcagagccgggaacactgcgacagcgacagctgcagcaaaggatgccagagggccagacatggttctggttcttcagctgaaggtgtgccttcgggaagcccagccccaactcagtgttcatgaccactcagggactgagggcaactggggcctcctaatggccagagatgggggtttgaaagcagataaatggccaggtgcagtgactcatgcctgtaattccagcactttggaaggctgaggccggcagatcacttgagcccaggagtttgagaccagcctggccaacatagtgaaacctcgtatctactaaaatacaataattagctgggcatggtggcacatgcgtgtaatcccagttacttgggaggctaaggcatgagaattgcttgaagctggggggcagaggttgcagtgagccgagatctcaccactgcgctctagccctccagcctgggcgacaggagcaagagtctcttcaaaaaaaaaaaaaaaaaaagaaaaaaaaaagaaaaagaaatgacaatgacatcagtccctctcccaaacagacatcatatacagaacaggcaggtcctttggggacacctgtgagagggtgtactggacaacagcctttgtcaccaggcactgcatcgggcctgggaagacccctggaacgcggcacaccatctgagaaggaagctgggcggtagagtcccttgtgtggtttggacggaggccaaccaaggaagcaacagggtagagtgtcccgggagatggagacaggcacttgggaaagcttcggggaggcagggagggtgagacagaggctccctccctgatggtgcttagcatctaatgcaggcgccagactgtaactggttagtaccccaaatgccggtcactcacaatacagggtgccattgtcaggaacacagcaaccaggtgccaagatgctaacctgggtgggcaggtgggaggcagggaggcggtgctgatggggaatagtgttcctggcagggggcacggtgagggctaaggctctgaaggcagagagggtccccctggcaagtgccaggagtcggggcaccagctgatttgggtgggagcggggatgaggcccctcccaggccaggccaagcctgtgctccacatgttgaaagaatgacgccagaagttggagggctgggaccaccacctccacctggccgagccacggagttcacccatgggtgggcctgccaagtggcggaggacagtgtggctatggaatgcacataaggtctaagagtccccagctccaggcaccctgtcaaccctctaggtgacacccaaggcacagccagtgagagcatgctgaggccagggctttgcctctgctgccccgcagtgctgaggctggcaggttctctggagtcccaagaccctgcactttcttccctctcctgcctcgctcgccacaaacagagcaaacgctggctgcacccggggtcagtgaggatgaggacaggcccgagacgcgttctacacaggactgggcgtgcggtcggcactcagaacgacacgtctggctttttgttccctttggataagactgacatcagcacaggcagacagcactggaaggaggttttccctccaaatagggtcgaacctgctgcgtccttgaggaacagcacccttaaggagaaatgattcttacccaaccaggagtttccccagaagccaggtttgcctgaaggacaaaggcagctaagtcaacgcccccagcgtctgtccagggaccaggcccggggaaaccggcagcttctgcagagggccctgggcagaggaggtgccctccctccattccactgccttccccctgactccaggagacaggctgccgcaggcgctaaggatctccctgcccaccctcaggggccactgcagccaggacgccttccaagtcctcacaatgacctgcaggaccgaacactacacatccccaatatgccctgctcgccagccacgctgacccccgcaacgaaccctcctaccaggccctggcccaggcagttgcccctgcccagaacgttctggcggcttacccttgttcagtggttctcaactgggggccactgtgtccccaccctggggacatctggccatgtctggagccacttctggttgtcacaactgggggcaggtggcactcctggcatcaagtagggagaccatggatattgctggcacctatcgtgcacagggcagcccccaccacgcagatggcccggctggagaaagacaccctgacccggttaataccagctctggcagggaagctttcccaacccggccgggctccttccctccggagcagtggccttggcatgcaaccctggcttctggagcatggccacctgattagcgcccacctctccctccagcgggccatgagctccacggtggccctgctctgtcccctgcatgtacagaccaccctggcctctcccctgccaccatccggttccacaaccccacttagctgttctctcacgcctccagactggacaggggacccctctgaccccacagacagccttcccaccatggctgggtgagcctgtctacactcgtcccaacctctgtgttctctccctgcaagaagaacaccaacctgccctgtgcctcccacctcccacctccctctcccctgcacctctggttcccagggcctgctggggtgcctgccctcccctggggtttctggacaggaagacaagtcagtatcaattcggaaggggaagtgtgtgtgtttgggggtgggggtggttcagggacaggaagtagaaaatcaaacaatggcaccaggacctgggataggcggggcaaagccaggtgggcaggccaggaggcacctgagttcaagggccccagttcaaccactggccccaggactaatgaggaaactgaggcacaggcggccccagctcaaagggattctctaagaggagtggtgaccccaaaaccccgtctgctgccctgaacccaggccaggaggcatgggcagagccagatgtggggttctgccccgccgcgagcacagagcccagtgactgagccacagtcacgcctggcctgtggtccggccctcccgagtgcgtatctgttccttcattcactcagcaaatgtttcctgagaaacgatctttgcaaaaatgtgatggcgttctccccactcagaatcctccccagcaccaaagagaatccaagctccctgcctccccaggcgtccccacaccctccgctgcgagcccacgctcccacctctgccctgaccgccccacggctggcaccttcctattcgggactttctcagaaggcgcctcttgcaggctgccctcccagaccaccctggacccaggcgcccctcctcccacaccccaccactacagccttgccctacttcatttgctctccttgctacctgcccttctctaggctcaggggctgtcccctggctgctgtctcactccccgcactggactccaaggcagtccaaggagggcaccgtctgtcccgcccacagctgtacccctgccctgcacgggtacacagtaggtgctcagtgaatggtctgttgagtgttccctccctgcagatacagtgatgagttagaggagaccctgttctcatggggatcataggtgggggggtccctgacactcagggcactcccagaaccctgagcacaggtccccatgttctgtcccaacagactcaaaaaagccggcagactgcatgggagaaggctgcaggcctagtgtggggacagaacggcgagtgccagtggattagggcaggcctgagcccatggaagggcagctggctccatgcttgctggcaggcagggagggaagggggtggccaagcagagccccgggaaactcaaagcgcggagggcagcaggtccccacaagcccctgtgcctggctggaccccacctgtctgttcttcctttctagcccctctgagtaaagctgtgtcttgcaagctgggtaacccctcgccctgatccagtaaagcccacaggatgcaggggacagggacgggccacagcttgggttggggggatgcccaggctggcacatgggaatcctggcccacccaacaaccatcatgacagcagctcacattcattcccaccagcatctgatccagaaaggctgcagccacctttgctcaccctagcatctccatctggcaggtgaggaaactgaggcgcacgcagggaggtgaagcaaaaagccagaaggcaggatgggagcccagaggggagcccagcagagccaaggggtcttccaagtgcagaggggccaggacccagagcacagcctgggccttccatctctgggcaggctggagtgtcccctctgcctggcatttgaagcccaaggccatctggatcccccaaacacacaccctcctgctccatgtgccttcagtcttgccatcctctgccaagggggtcctgactctcggatcccacccacccactataaaagcaagatccaaggcccaggctctccagaaccccctgccccagcatcctcaaacaaccccaaaggaggtcaactgcagcacaggacacactctgtctcccggcagagcccacacatgtcccaaggaataacaactgcaagacaagcctgagccatgccaggtgagcgggggcctgcaccgcccttggccactcctccccagcagcccaagcttgcaggtgttactgacactgtcctgccgggtttgccaaggcccacagagatccgtaactgggacccaaggagcatgggggcagagccgggggtgaaccccaccccgtcagagccattcaaatggacagtccctgccccagctaccagagaggggacgggtatcctcctgtcctgctctccctcccaggaccccggcttgtctgagcctgatcccactccagaggccactccatgtgctctaggcccggggggcccacagaccgcagtagagcaggctggagtcccctccatcctcccagaccagcactcacttttgcggcctgcttccgcccagccaagcaagctgctcctcttggcctcagtttctcaatgcgcaaagcggatacgagtccctgacctcatctaccaggtcgtggggaggatgagaagtggtaagaaaagtgaaaacaaaagggacatgaggtcaccaggtttgcatgtcaccagccacaccttcctgtgtgctacagcagggacaaagggagaacactgagcccgagggatccccaagcccacccccagggccagaagggcacagagcctggcccaggcccagtgccacaaacaccccttccccagggacacgctgcctcctcctaactcaaccgggcacatcatgagcattgccgggctcaccaccagcaaaacacccccgccttgcagccgccacctcctgaggctccttgacagacgccaggagggctgccctgcttacaggggaccagccatccctacggggctttcagtactgcctccccccataaagccacctgccaagggtgccaacaaactcttcagcgaaccccgggtcacaaaccagaaacgtttcctgccccaggttctgactgggaaaacagggttgtagggagaagagggcactgctggacacagccaggacgaggcgggacgtccgttctgccctgggcctccagcagccagtgggacacaaggacgcatcacacaaggccccagccctccagaagccaggaccaagaacggccggatgccagtgggactgacactgatggggctgtgcccagctctctggccagtgttatctcatcctccacccccacccatgacacccccatcctcagaagaggaaactcgctccagaatcccctaggttccccagtggcaaaagaggaagcgggagcccgcagagctctgaaccgggactgccccaaggtcagtcggggtcttcctcgggccaggccagaggctcatgcccccaccctgtgaatcacccgctggtcattttcacaggctgccccagggttggcctgtttggccaaacaactttgcttgtagatgccggagaaagttggtggcaattatatgtgccagacactgagataaacagctcacgcagatgtctcctttctgcctcaagacaacagggcagttgagctattactgttccctcttggcagatacagaaattggtggctcagagaagttaagtccattgcccaaggtcacacagctcaaaagtagacgcgcagggattcaaacccaggcaacctgcatccaaaatcccgcatttcgaccctgactctaaaatgccacattctccctacctcctctcccgcgtgcctgaggggccgcggacaggtgaaccccagtgtggccctcgctggggcgggctgggcgacctgggctgggtgctggggacttaggggtgacagcgccccggcggctcccgagtgctgagcgcgggcggcgtggcaggcgcggtgccaggcgcgctccgcgcaccctcccgttccaccctgcccggcggcgccggcgtctcccccactccacggaggagcaaagcgaggctccagggaggagggggctcggcccagggggcgacagctggagaggggacggcagctggggaggtagc

SEQ ID NO: 1751 - DNA, 1589 bp, Homo sapiens
aaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctagagtcttttattcaaaacttcagcgttctctatagtcccttgaaaaggcatctcattggaagtggctctgcccagttcccgtctcagcatttaatcactgaagtgacaactgataccttttgggaagtagtccttcaaaaacaggacgttctcctgctctattacgctccgtggtgcggcttctgtccatccctcaatcacatcttcatccagctagctcggaacctgcccatggacacattcactgtggcaaggattgacgtgtctcagaatgaccttccttgggaatttatggtcgatcgtcttcctactgtcttgttttttccctgcaacagaaaggacctaagtgtgaaataccccgaagacgtccccatcacccttccaaacctgttgaggttcattttgcatcactcagaccctgcttccagcccccagaatgtggctaactctcctaccaaggagtgtcttcagagcgaggcagtcttacagcgggggcacatctcccacttggagagagagatccagaaactgagagcagaaataagcagcctccagcgagcacaagtgcaggtggagtcccagctctccagtgcccgcagagatgagcaccggctgcggcagcagcagcgggccctggaagagcagcacagcctgctccacgcacacagtgagcagctgcaggccctctatgagcagaagacacgtgagctgcaggagctggcccgcaagctgcaggagctggccgatgcctcagaaaacctccttaccgagaacacgtggctcaagatcctggtggcgaccatggagaggaaactggagggcagggatggagctgaaagcctggcggcccagagagaggtccaccccaagcagcctgagccctcagccaccccccagctccctggcagctcccctccacctgccaatgtcagcgccacactggtgtctgaaaggaataaggagaacaggacagactaactttttaaatgatatgaagaaatcagaggtgaaaattgtacattgggaatatatttatgcaaattttattgaaatttattgtaaataaagattttctcagtggtctagaaa

SEQ ID NO: 1752 - protein, 491 aa, Homo sapiens [sequence omitted]

SEQ ID NO: 1753 - DNA, 67076 bp, Mus musculus
  misc_feature (1)...(67076): n = A,T,C or G
taatccctttctcttcctctataaactgtctctattcctattactctattactgtctattcattcctattccaaatacatatacacatacatcatacacattgatcgtacacatcatatttttacacacatacacataccatatatgtctgtgcactctgtttatgcacagctcccagaggccagaagagggcatcggagtctctgaaactggagttacagatggttgttagcagctatgtgggtgctttgaaacaaactaagtcctcaggaagagcagccagtgctcttaatcactgagccatctctcaagtcctgccccactacctcacccccaaaccctgacctaattctaggaattgatgctttggggttcctaccctacctggccaggtatcatcatcatcatcatcatctcttgttctcagcatttgaagttctgattagttaaatagaaggtgctgttattgccaagaattatcactaccaccaccaccagcagcagcagcgcgatcatcatcattaattttccttagatgcctgtttgctttctaaggagagacagaaagggtatgggccagatagttggggaggtagggaaggaactgggaggagtaaagggaggggaactgtaatcagaatatagtgtatgaaataaaacttttttcaataagagaaaaccaagaaaaaaaaagaggatactaaaaaaataaataaattgcagaagcaagtacttagacttaggggcaaagatagatcactccaccccaccaagcccctggaggaagaagagggaagccttggtgatcttgaattttcaaaactgatagacttttacgtgttttcaatgaattcatgcttaagtgcatttcttttctcttttctttttcatttatttatttatttatttctgtagtgaaccattaagactttgttttgtttgtttaagttctatgtgtacatgtagctgtctgctctgcatgcatgtttgtgcaccacatgcatgcctagtgcccaagaagaaagccttagatctcctgtgactggaggagtgacagtcggctgtgagccacaattttgggggctggcgtgtgatgcctaaagttgtgtttgaagtttaaattgctgtgcgtaagaaatccataaaacaaaactacctctgacctgtatgccccacttgtccaaggacataaattcctggaatggggtgggctgatgttcatgtacggtaacaagccacgtgttttcatttctgtaaacaaaggttggttagttaccccaaccgcatccgatgttcacatgtacgtgggaggtgtgttaacaggaaatgtcaggatgtatactggcctctgactggacgaaggtgagacgtacatagtcttctggatttttgcctttataagtctctagctaaagtaatttggtgctgttctctgggaatcccaggtgaaaaaattcacttgcttcaaatttggctcaaaatttatagcgatagttttattctcaatcagcgagtaagaattaacaccgggaattgaactcaggtcctctggaagagaagccagtactcatagctgccaagccatctccccagcccaccagtaaaattattgcacacgggtagtgtaccaaggagtaaggatgatccagtaagcgaaatcttgaaccctacagggtaaaagcaggtactgggagatgagccaagaaagattaacttccaggtactacataccttcccatatccagcttccctgccaccacagcccactagaaggtcttttgtgacttactttgaatttacagaaatagaaacacatggaggggggtggtaaagctaggcgggcttacagagcgatttctgcttctaaggcatctgcatcgcttcgctccttcctgaaaggtaactccgggtttcaggacctgcggttcagtgcttcacccgaagcccgtgcgtgcatgcgcagtgagatctggctccttgggagtttcgggatttctcaaattcactcacagaatctaaccatcccccatgtctcattctgtagactgtcccttgctgggtcagaatggcctggccaaggctcactctttctatcagctcactccccattatcaataaaaaatttcttcctgagctccactaaccgagtttcttcctgacttgtttggcagagggttatttgttgacaggcaagaccggactcacaccgccctctttctgaaggcaggacttaactatccacaggtaagaaagagtcgttgacgtcaccgacccagaactgccccctcatcccaagagctctgttttattgctttcctgtccttgagactggcctgttctcctaaatctgtctttctcactcaaaggattccagtgcggttttcctgttgtttactagatgagcgaatagagtttaaccggccggtgacatgagatcaggaatctgtgactttccctgagaacaagatttttatatcagaatcaacaaagtaaggaaactgttctcatcagaacccatcagtaccctctgcagcagaaggagaatctgcattgcctacaactttgttattattcttattcaatctctctagatgttacacccctggaaggttttgagtatctctgaagcaatagatgctactttaatcacctggagtcaacgctgcctacagctctgctagctgttcagtaattcttcattgcattcagccttggagcctagaattcagataatggcctataaacaggctgttcacttctccagagtgtgacagagattggctgagagcagtgatctggccgtggcccttcctgagaggaaaagtggggcttgcgttaataaataccttagaacatgacgaagcccagagcctcatgcagggacatcattaaaactaatgtttaactttatcagacttatggctaggcgaaaggaagagttattttgagctgagcaaaagcagaagtctgaaaaggtgtggctgtaagtttggcacgtgactggggatatttatgaattaccaagggtaacaacacaaaatagtaaactcacttgaaacatgagatattctgtaagtttttggtacctgggcggggtcattactgagcatgatgtttgtcgatggtggtgttgtatggcgatgtcagagggtgaacaggagtagttcatactgtggacgtgttagtgagtgtcttcataacaggcatcctagtttgctttttgttcatatggtaaagcactgaccaaaggctgcttgggaaggagggtgtttatttcagcttacaggatatgatccatcattgagggaagccggggcaggaacctgaaggcaggaactgaagcagggaccatggaacatcactgctcactggcttgctccctccagcttgagctcactccgctctcttagacaattcagggtcacctgcctggggttggcatctcccactgtgacctggctcctcctatatcaagcagctatcaagaaaataccccacaaacttatccataggccagtctggtggaggaagctcttcagttgagcacagtctggtggaggaggctcttcagttgagtctccctcttttcagttatgtcaagttgacatctaagatcagaggtgataggggaattcctttattacatcactcaggttgtttcctgggtaattctaaagctcttaagttgataacatcaaaccattacaaaggcagaacacttgtctagcacgctcaagactcctattttaatcttcagtaccgaaaagagaaataacagacttagtttcatttaaatctctgttcatgccaaaagatttaatgaccattttataaaaagtgattttagtacatctaatgtcttatatatttgtgactggaaatgtgcatgtatgtgtgtgtgtatatactatatatgtgtgtgtgtgtgtgtatatatatatataatgaagtatgcaaaatcttgagagttaaagcatataaatgcaatctattcaaagtgacgagtaagccttctgtgtggaagacatgaatcatattgagatgcaacgggtgtcagtagagttctttcggcatctctactgttttaatgagtaccattcaattgaaaatatgccatttgggaagtcctgctgtgtctaaagacctcatctacactaaagtccttgtcaacatctatggctttgaccattttattctaaatatggtatgtgcttatgcaccagaaaatgagtctgtctgtggtcaccagcactacatttttagaaggtatgtatctatttaatgagtatgtgtgtgcaccacatgtgtgcagaaaccctcagaagtgaggcgaggtcactgggactggagctacaggcagttgtgagtcatcatgtaggtgctgggaattgaacccagatcatctgtaagagcagcaagctttctcagctgctgagccatttatccactggcactaagcttgtgacaagtcagacgttctggttttgttaatgataaaggcctattttcctactgactcaaaaattctaaattcttattcaaaaatagaaggttaacgcatatatggcttctgcatagttcttccatgtgatcgtgtttaattgtcactggctcctttatatgtcaaacacgtttatgtgtatgatatactacacagtgtatggtgtactacataggattctcagaggcaaagttcacaagaacaaatttccaagatgtgttccaaactagatttgttagtggtcctgaccctttccaggtctgtatccatgtgtttctaactatatcatggctattatctgtaaacaaaggtaatcagacatgatctaatatgaagtatacaagcaatgcttcctaataaatgacaaggcactggccattggtcctctaaggagtacatctgtatcttagtcactcttctattgctgtgaggaaataaggtgatcgaggcaactctgacagaagaaagcatttaactggggacttggttacagtttcatcatggtcagaaacatggtggcacacaggcatgcatggtcctgaagagtagcacagtgcaacatcctgatccacagagaggagagagaaagagagacgagagagagagagagagagagagagagagagagagagagagagagagagagaagaggagaggagaggagaggagaggagaggagaggagaggagaggagaggagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccttttcctgaatatttactcttgtaggtcgttattttgtaaaactttgtcattgttgtctgtaaaatagtgcaacttttaacaaaaaaggaaaggaacagtatttctaaaaattttagagcccccctcatcctcttgcgactcagcctcttggtatggatccgtggtctcccttgttgttcttcaccactctcctcaagcactccttcttagcctgtctctatttctttgtgactccatgcccattgcagaaccattctataccaagtgcctaatcagggtgcctgtgctctccttccccttcgccattctggaggacactctgaaacagcccctgttgcccacctaagtcccatctcccagctaatcttagtcccagtaggaacctatgttccccccatccccccagttcttcctcaccagtctcctccgccattccttccagagcatctcctatcctttgtcataccctgctgaccatagaactgctttgtgccagggaccccactgccaccacactagactggaacctggatagcctacctatgccttcctccattctgagctctttaagttactctagtccatcttgcaagagtgttgttccagcccacctcccttaccttagagatttccaccatccatagtaagacccagggtactcctaggtctgctcctcatcaccttttgtggagccaaacaccaagtcctactacagagacgcccagagtcagcccacttcccatgaccatcacccaccccacacactgagcctaacctcagtgtgcatggagtctgaactcagaattctaaacagaacttcagatctgtgaccaatgctaaaagccagggtaccctaagactaaaaaccaagcatcattgcacttatccacatctatcagattagggtaaaagcattagataaaagcaacagcatccatctttctcctgcctgaacataccttatgatcaaggacagacatctgtcaccttaaaggaagaggatgacaaaaggtattccaagcaagtggagctgaaacacagacaggcacacagacaggcacacagacagacacacagacagacacacaaacaggcactcagacaggcaggcagacaggtacacagacaggcatgcaggcatgcagacaggcatggaaacaggcaggaagttaggcacacacaggcacacagataagcattcacacaggcacaacaactttaatatatgataaagtagacttcaaacaaaacttcattagaagaaaagggaaggacactacatcattaaaggagaaaaatccaccaagaggatattgcaattctaaatatttatgcactaaacacaaatgtacccagttccataaaagaagcctctactccagacctgctggagttatcaacaccccagatttaaaattatactatgcatctatggtaataaaattagcatggtgcgatggtttgtatatgtttgagccagggactattggcattattaggaggtatggccttgttggagtgggtgtgtcactatggatgtaggctttaatatcctagtcctagctgcctggaagccagtagtctgctagcagcctgcagatgaagatgtagaactctgagctcctcctgtaccatgcctgcctggatgctgccatgctcctgccttgatgataatgaactgatcctctaaacctgtaagccagccccaactaaatgttgtccttgtaagagttggcttggtcatggtgtctgttcacagcaataaaatccaaagtaagacatttgatattgtcataaaaacaggcatattgatggggtataattgaacacccagacataataactccacatgcctacagacacctgatttttttgacagaaaggccaaactattctgtatcttcaagatagaaatgtaagaggacgtgcaaggaagggtgaatagaatatagtgtcataaacaggaaatcagaataaggacctaatgggaaagggagtttcagtttcagatcaacctgggcttcacagcaagactgcctcagaaccagaatgcagctgcctgtgccagctctcccaaaggtaacccaaaccaaggagaaatggctcttctgtgtggcaacctgtcactaactaaacgcagttgtgaatgagacctccttacaagagggcatgtttacagaggctggttccgtctgcagcactgtggaaggattggaatgttacagaggctaattacctcatctggaacacccattgctaccccacctctgtgtcagagctgacgttctgtggctaagagattaaaacgaaaacccagcttttgaaatctattaacttggtgggctaacaccttccaaacactcaacccaaagctaagagtgtcatccgagaacatctgatgattcacagactagcttcccccatcttgctataatcatctctctgaggtctccattgatgcatttcaaacttaccttgatttagtccttaaaactgtacaacgtcttaaaacttcttccatgttggaacattatattcatacatgcttcagaataaactatgatctttttattcctttgaggaggtgagagctgtttctttggatgatacagtgtacccttgattcccacttccacttgtatttgtgtcaagtacaggaatcttttacctcaaaataggaagtgaaataactacaaggttattgcagttgtcctgactggaatggaggctaaagagtctcctgagctcctctttctgacttttaaactgccgacataacagaccccgagaaactgtaatctcccccaggaacatcatctgaggccacgtgggaacccgtgtaagaaagctgtgactgtcccgtgagctgtggttggggcagagtgcagaatgttcttccacaagtggccttctagaaataattgcaaaccccataaaaagtggatgctctcaaaaggggcgacatgaagggtatggcttgggatgtccacgttctctctgtgggaagggtggggtcctgggaggaatattcttggctttttcccacaggtgcaaggatgataagacataataccaagtgttttttcacttgctgttcttgtatttgcttaagctctctgtaaacatcatctcatgttttgcttgctttaataataaaagagtgagaagttctttatttgctctattcttgagttcaaacgcttagagtccccaggttatcccacaaagatctttggctttcaatccagggagactttgttagccttgctggtcgctgtccgctgctgggttcggatctaaaaagccagtaaatgtcagaagcctggagccactgtgccaccttcagaggagcagagatttcacaccgtctgacaaacgccacatcataggagaaactggagcctagacaacgatggtggaccagaacatatattgagcatgactacttagttatgtataccacttgccttccacttaaacccaaacctcatggcaggaccccaaaattagacttggatcggcagaggtatgggtgagagagattagatcgctgtctttccccaatgtagtcacattgaataaacctctttttctcctttccattggtaattgtatcgtgaattaggctatgggaggtgagcggctgaacctggcttgttagaggcaggggtggatgctggtaggcgtgtggggtgtcctggtggagaagacaatacccagcctcttgacctaataactagtaatttctttatgctcccagtgctcaaactccatttttgatagacagtgctagttttttgttttgtctctgtactcttccctctcctcccttcctctttgagggggatggtggtgtgttactttctgaggagcatcaggatggttgattattcttaatactgaaccaggagcggtgggaggacagggaggcaattcttaggacagcctctaagtcagcactagtcggggctcggcagattctccccttattaactgcctagccagtcggatcaagctcagcctaaaaagtgccagggtgaagaagagctctccaagccgccaggtcctgcgccgccaggtccagcaccttggctggctgtggctgcgtctccgagagccagtggctcgcgcgtcccctttaagagccgtctagtacccgtgacgtcagggcaggaagtgtttgaggaagtggcgctgggctggctgcgtggggaccccgagttttcatgtcctcagcgggtgtcgctggcggccccgcggcccccggggcaggtgagtcccacgcgagggcggctcgcggcgcgtggaccggctcacccgggtgtgcgctccgcctctccccggggtccgtggctgcgccgcgcccgatgctgagcggacccaccggtgggcccggccgccgcaacttttatttgttaactacaccggtgtcctagcctccccttgcagggcagcagccactgctgctcccagttgcttcttgagctccagtgttcttcttactctcaacttgtcctctctccctgcttgcttctagagttagcagggcatcgatatgagctggtcaccgtccctcccaacccagacatgtggagcctgggaaatgaaagaacgcctggggaccgggggatttggaaacgtcatccggtggcacaatcaggtagggctctggcaccaggaaggtgggtgagctttcttggcgcctcttctgacctggcccggtgtgaatgggtggatccctgcctaaccttggcgttgtccaatgggagcgtaagaaaaaggactgcaaaggggatctgtgagctgctaaactgactctttttaaaaaaccttaataaccatgccacttagaaggacacatgagggagtaagctgtcattccaagtattttgaaattatatttctactaatatttagactagcacgtaatacattacattgtgataaatgttgtagaatacaggcagtgttaaaaagatgagagcaataaaaaacattttaaataactttatttaaaatattttaggtagttgataaccccaaggtttttctcttctctttctttctctctttctttctttctttctttctttctttctttctttctttctttcttttccatgtgccgccatataatgctgagtgatgtggactgatttcatttttggatctaatttttattcctattattttagtccttatgtgtctgatgtgcgttgctcatgttaaaagtttgtgttcttccaaaaaaaatttgggggagggggctggcagtaagtacgctgagattcttggcaggactctctctagctcggctgtttactgtgggagacttattttatccgatttgggtaatgagttcatcacagtgcctcaggagcacacagtacttgtgatgtttccgctaaagagtacttactaacctcaggatacttgagtatcagacgtgatgtgtgactatcaaacttgggggtcatggcctgtgccctaagctgagtcctcaataagccaattaaaataggcaaattaatagtggaaagcaagggattcattcactgaggtcacattaggaagaaggacagacagatccccccccaccaagtccatctccatgatcctaaaattaggttaaggtctaaatagaacgccaaggatactcacatctaagcagtactgtggtccagcctaccactggcctggttttgtcatcctgtgagatttttctgagaatgtgttagaaatctgtaacccagaagacaatttccccctctggctgggagctttttctctcccaacatgaaatttctggggaatttcccatctctctggcatccaatgtttaaaagtatctctttagaatatcttcatttctgccagaccagttactcaacctcctgatagaccccgcggggagtgctgtctggaggcctatttttctattttaggattccagtgttggtcaacagttggaaaacataccaaaacgagaggccacccttctagggaatccttcctaaagagctaaaatcaaggtcttgactcagattgagtggtccaggtgagagaccagccaggttgatcgtggtgatgacagggagaaataggcagactgaagagatatttaggggttagtgtgaacaggacttgggtggatagagagggcaggggctggagttggggaggagtactggctgaagaacccgcctgcttaaacctggacatcctctgctgtcttcatggactgatctcggggaagcctgggggctgctttgggtgcataaaagcaatctttaacccacatctaagatcagaagatgctgcatgtcttctgttggacacgcctctgttccgggcctctggatggatgcagctaaaatatgctagttgtacttggcgccagacatccccttgctacttcatacactgtctcttgtctataggcatgagaatatttgtagctgtcacagagaagttccttgagaggccctgagtcagaaacgtggcccaagaaccaggatcactgatgtaaatacattacatgccgagatcgggctaggtttcttacatgctgggtctgtttggcgttaccatgagctgcgtatcatccttacctttcttacatgctttcataccagggtcaacagctttaatttctgttttataactgaggaattggaagcacaggggagttaggtaatatattgaaagaagccatgcttttaacacatctattccgatccagatgctacacccgcactgtggcttcttctagatggaactagagtttaggacacatcctgcatataaccggctattttgtaggtactatttggttcttcgcaaccaacccaagccattttgaagcaccaaggaaaaactaagggatactcaaatgtagcagatgacgctactgcaactccctgggttccagatacacacagtgtggccttgtcagtctttgttgcctaggtgcacccctaaatctcactgaaggctcagtgcaaaccgtttgtgcttcgggtaggctactgtttgcagcagaccttgagagacaaagagagaggaaaaagatacaactccggggacctcagcctccagctccttttgagggtagacaggggaaggagccacacactctccccaccacatagcacttggttggaatccttactgtcaccttgctaattcatgcatttgggtcacaacttctcgttgaatgcataaatagaccctcattgtgacaggaagtacaccgtggaaacatcccaggatcctttgcaactattacgtcatcagtgtgctctaataggaaagagcctggcaaacctggggaatccgtgctgggaaatagagaccatgctggttgttagaaggcaaggggttatcagttattcttcctgtgaagtagcgctaagcttttctgtaagactaaggtcacttccgtttgcagtgtggtcttggaactcagttcccagtgaggacttattacgaatgggcctgagctccgtgcaggcaaatgaagagatgacaccaacctttatttgtttttacctacattgaatgaattcttaaagctatgactaaaccgatagtcataaagatatgctcatgtgtaaaaatactaataactaatgctcatcaagaatccttatcaattgcctgctgcgtgaggcaacaacacctttaacctgtgtgcccacccgggaggcagaggcaggccaaccttcgtgagttcgaggccaacctggtctacagagatagttccaccatagccagggctccatagcgagatcctgtctcaaaacaaaaacaaacaaagtccaaagcaggtgctggctgtgacaggtactctgtccctattttcctgcttcatcaggttcttgagaggaagtggacttcagacgacctgtcgggaaaggagacacttgagtgggtagagcggcgtgtacggaaatgataaagtcatggcttgcccaaggctccctacggatgagacccttcattttcttttaattggcatgcctggaagggctgagtttttctccatctgtgataaagtgccaaaggaccgctggcctctgagccccatgattgcttgcccaaggaggcggccacacttttctccttagagcctggcctggcctctgtgggtgagatgggagcccaccgtgtcattgtgtgtctgttgcagagagactgaagaagctgtagccctttgtcatagggacaggttgtgtccaccacttgttatgttgggaataaagatgaatctagaccacttttttttttaaagaaaaattatttattttattttttgagattataattacacatttcttccctcctttcctttctccaaactctgtcatctactccttcttgttctctttgaaaatatggcctcctttttcattaattactgctatacacacacacatatatatgttcctaaatacataaatacaacctgtccagtctgtataaggttatttatatacatgttttcagggctgaccacttgttactggataaccagttagagtgtgtctcccattctgagcgttccttggttacctgtacttatttgtgtaggtttgaggcctcctggttttcccctgtccacgttggcatgtccattacttttgttcttgatcagttcatgcttaagcagtcttgttagcaggactttatcgatgtaacttctgacactgctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcacctcacttccttgcccatccgcctttacatcttaaaaaagaagaagaagaaagtctagtttgtgcccctcccactgaagtgtggttgaccctaccacagaacacacccttaaggagaacccatccttctctaagcaactataaactgccactagcagcctagctagctaggggtgggacttcctgctagctagctagctaggggtgggacttcctgcctgccttcctctccaagcttgggttttccgtggctctcggcccgtgtacactgtcacaactgctgtgacttcatacggggcagcttccttgttttcccctgggaaacactgctttgttgtagtccctcagaacctccagctcttaggatctttccagaatgatccctgagcttagcaagaagggggtatgatacagatgtatcttttagggtcgagcatcttacctcctcccaccctctgtgctttgaccagttgtgggcctccgtgttaactgccaatcactgggaagcaacatctctgagtagggttgagcaacaccggtggcggctggtgcatctgtacctttggactccccagcctgggtcccatccatgtaatccttctgggcccagtttctctctctctctctctctctctctcacacacacacacacacacacacacacacacacacacacactcacacacacacacacactcacacacacacacacactcacacacacacacactcacacacatacactcacacacactcatacacacacacatacatacacacacacactcacacacacacacatacactcacacacacacacacataaactcacacacactcagacacacacactcacacacacacacactcacacacacacacacctgttttccctgaaatgttgatgttgtggagcaggatctgaaaaggccggatggctcattgtctctgtatgacagtgttgctggttgaatggtaataagcgattgggttttctggaatgaagttctaagaggagttctgtgaggggttttgtttgtttgtttttgcattttccctggatcataggaagccaaccacaaggagttgggtgaccccacttgttctgttgtgttgttgatgttgttgtttttttataaactggctttctggcacccttgtgtgcagtcaccttctttgggctttataatacacagacatacacaagatttgtgttcttgtgtaaaaggcaaagaataacaaactctaaggacctctaaaaatctgctatgttctatatagacaaaatctactttcccttttattgagaataaggatagtttttaaattgtattctattttaaggagtctacttattagcaagttggagatagatactcctagtttggtttctgttgctgtcctagacactatgaccaaacccagcttggggagggaagggttatctggcttatatgtccctcctgaagggaagccaatgcaggaaccatgttcctcctgaagggaagccaaggcaggaacctggaggcaggaactgaagcagagatggtaacagagaagcgctgcttactgccttgctttctatagtttgctggtgtttcttataaatcccaggatcagctgcccaggggcgagccgctgggggcctcccttctcaattgttaatcaggagaatgccccacaagcttccctgtagacaattagatgcggacaattcttctgttaagattcccagataagactctagcttatatcagattgaccaagaatacaaacttacccagcacacagagagaattcaggcccaggctggctttccaaactcctattcttgatctggggatcctgggcaaaatgcagtcatcttctgatgtgtgaatttttctgccgatgaacacattcccggtgttcatagttcatgaacgaaaataatagacaactgagtgaggaaaggtttgtctctatctcagacatccctaagccctagaagctaggagtcccctgcaatagggctaagctaagctgacacaggcagttctagtctctgttagctaagtctaagtttggaggttgaaggctgttctcatatcttcactcttcctgtcagtcttcatgatataggttatcttggcttctgggttgagccagctaacaactgcgtcttatgctctgacattgggcaagagattacagttactcaatgcacatcagaccgagttccctaaatcacagtgggtctgaggatttgttgtgttgtttgtagagagcatccgcctttcccacgggcatccataccttactctcctgaatctttgacattacacggcaaggaagaatccaggttgccggtccagctggccttagattggtagatcgtcctagctttagatgggcaggcacagtgtcacactgggtcctgaaaggttggaaaggaggcaaggagaatcagtgtggagctaagactaggggagaaagatccaacctgacgttggtgggtttgaggatgaggtgcctaagccatgggagatgccggggcttggactgcgagaggtcatgggtgatgtcccaaagctggtagaagtgagcacagctctgctgacaacgtgactattgacaagggaaaactcaccgcagacctgtgatatgcagacttgtgaactaaaagatgtattcatgttgttttaagcaactgggcctgtggctaattcattacaattgaacaagaaaacaactcactgctctgtgtgttaaagttagatgtgtgcagactctttagtctccgagcatggactctttcatcctcgggtagcatagcagaactgtaacatcttcatgtaaccacagaaccaccagcatactagctataggagtgtctggaccagagatcttctgcagcgagcttgcccctgcccggacccgcttccacgcctctgcagaaccctgttttccacaagtctaggctctgactaaaggccagtgtagagttcttgagtcttggtaatctatttttaatggtaataataacctttactcaagtgaataaaactcaccttccaaccatttgagaaataatttaatatagatttttcttaggtggccgtgtttctcttaaatatattattaatgtgttctttgacaattttgtacatgtacataatatttttggatcatgttcatcccattaccctctcttatccctcttcactaaaacccttcttgttctcacatccccctaccttcgtatcttgcaggtatgtgtgacccattgggcttaattaaggttgcctatatgagcctgggcggggtgttaggctgattgacttgtaaggcagagatcaaggctctggtcatttcagacaggcactttctctcacttaaagacatgtcttccactgtgccgtcacaaaggtctctacatgatagcatctcaccgtggctgcctgcaaccccatcagcttctccgcagccccacctctcaatgctgttacaaaagtaattacgtttcaacactctaacctcagcattcaacatcagtggggtttgctgttgacgaatccaccctagaactgggcaagaaaatatttgagtcccagcactgacaggaagtgaaactgaggacggttccagtcggcttgagaggagggagactcgttggaagctcaagatctcgaagcacggtgttttccaggctgtggcttctgagaatgtccgtccattagaggaatgtttttctagtatggtcgctcactcttgaagaccagagatggacttctccctgggttctgctgtgttcagcagccatagtggatatagtgtggaaaggaaatcagctcttcagagagagcctcagaatccaggccaaaaccaggattctttttttttttttttcatttttattaggtatttagctcatttacatttccaatgctatccaaaaaagtccccccatacccacccacccccactcccctacccacccactccccaaaaccaggattctaacagacaaagaaaaggagagaatgatggtggggcagaccccagttaatgatacctcctcccgtgggcggccatgaggaggctgttgaggtcacaagagtggacccgtagccgcagtgtgagtgaactgtggctttaagcgagagcgtctgtgtaaaatttcacacatgtgacttgttttacacggaatgtccagagcatgtaaatccacacagacagaaagtagatgtgtgttgtctaggggttgtaaagacgccagggacgatgggaagtgggtggggtttgtgggtggagaccctgctccagcatcagctgtgattttggttgtatacttagaatagaccagaaaactaggcatggacgtaagtgcatcttagacagcttaagcagtagttctcgattaaaaacacatcctgagaacattttagaggttttgttatatttgtgctccggcattagaatggtgatgaccaccctcatttctgaagttgtcagtcttaatcatccatttcagggtggatttcttaatcattgatcacattagataactcctcctggtgtttggagcgttctcttaccagcgtttcccaagcagcagcaggagttttgggtgaccgtgaggcagtgatcctgtcggatgctgatgacagccgcctgcttgtcttgccagggtcctgtgcgtgttggtttaactcattactgtacgaatcacacactttaaagttttaggattctttttatagaatgtacaagtgcggaaatggtctatggggcctctaggacttctttcatggggccaacagtattatctgtgctgattaaagttgattttaaaggtctttagaggttttagtcttttgccttttacctatagaagcagaaatcttgttttgtatggaaaataacccaccatcagttttgaatatgtgaagtgttttttgtttttgtttttaagtttgtagcaagcagaaatgaaaaaataaatagccaacagctaaatagccaacagtagacaggtaaacagcagagcagcttcaagataggcgcctacaccatccagagagagcgatcaggagtagtccaactggcagcgaatactgaagcttcctcagataggtgcttacgccatccatcagaaatcccctggggaagcccttgctgagttcccagatgagagctctccagacagaatagagcatgctctccatggatgaacttctgccttcctgttcttgctacaggtattttttataccgtgcaaaacaccgcagtaagctctgttgggaggctttatccctagctgttctcagtggcgtcaccgtgaacagggacgctgatactactgtccaaagtcgaggctgccctggtggttccaggacacctgacaccagggcttctctctgctgccactgcccaacccacagctcagaaccctcctctcctacgtgttcccatggtctcctttttgtaccagcaaagagatgcctgttaacctcaggagccagtcataagtcacaaaatactgactctttcagtaaaaaacccacacagtgtggttaagggtgtaatttggttggtagagtgcttatccagtgttcacaaagccctaggtttgatccccagcgccatataaagtgggcgtggtggtccatgcacacctgtaatcttagcatatggtaagatgcgtcaggaggatcagaaatccagtgtcatccttgtagccatagtgaatatcagtctaggcttggatccattagaccattctacagtaaataaggatgtaaataaataatgaaagcaggctttggaagagtatatgccatactctcaggactgtgctcttgtgaattgtcaggcacttgctatgggctttctatctgtatgatatagctacatctctgtcctcattacagccctgagctgtggcaggtcagtattcctgttgcataagtgaagacacagtctgtatgtagtttgctccaaggatacacagctggtgaaagagagttggaacctgagctgttctgtgtctcattgactacactatgtttgtcttctctccaaagagaaaggaaaaaacaaaaaacctcttacatgaaacaagggagacactcactgggccagtagttgaatcaatcacacggaagcgccacttttatatgtgaaacaggccaatcaccagcagcgctggatggcttaacctggcattattaccacggcaacagttagcgtgtgcagagagaagtagaagccccggacaggggtgtgctacaggggggcaggggtgtggaggaggcagcgacagagcaagatgtgaagaatttgtgccccctcgatggatagatgcagcgggaagatgggcaaactgtgatgtgggggtggtgaggagggcagacagacagacagacaggcaggccagccaggtgtccaggtgttctgcaggatgcctgtatggcactggggttctgcggtggtcataggtctggttgtccatcgctctgacgtccagcgtgccctctctgtaggcgacaggtgaacagatcgccatcaagcaatgccgacaggagctcagcccaaagaacagagaccgctggtgcctcgaaatccagatcatgagaaggtgaggggcctgggcccacagcgggggcgggggaggggtcatttccacagccctgtgacccgggaatgaatagcatagaaaagagccccgcagtgtcttctgtcagcacagtgcccacattatttagataggtcgctgtcctggaggcttctagaggagtaacatttaagcactacattgagctatgtggtcagtttgttgcgttaaacgtaagacagccatcttacctaggcgtggtgttgtgcttctataggacaaggaagaaggcttgggaggttgaagacaggaggaatagttgagcccaggaatttgagaccagcatagacaacctaacacactgtatcagacattgcttaattaataagttaattaaagcagttagcaagttttgatttgtcagcagaaatctttgttttccctatgtttctaattgcacagtggcatgcgactcgctgtttgccctctggggagagtcacacagtgcggacacaggatctttcaggcctgcctgggtggatgctgtcccccccagctagtgggacctgtagtggcgagcactccgagaattagctcgaagaaatcaagcagaagccccccacagctcacgtccttcatttttaaaatcactctattttgtgtgtgtgggtggcttggctgcatctgtgtctgtgcatcacatgcatgcttggtgcctgggctggccaggaggggcacttgggtctgctggaactggagtttagagaactcagccacatcggggcttggacttaaacccaggtcctctggaagagccctgtcgaatcatctctccagacctctgctcacgtcttaaaagatgggaaagagcagtgtctcctttgttgaatgtccacatgcatgcctgtgccagccttttcccttaagtggcataaggttacctgttgtcacctatcagaagcagtcttacagacactgaaaaatggagataggaccctttaaggacaattaaatgatctgcgatgtacttgtcgggtgtttgagttcagaggctgagcaaggccgggtaaatatttaacttggtagagtcccaggtgagtctctcatccctgaacccccatcttctcctgtgtagtcaccaagaatgcctggttattctttgccttcgttagaaggtgagatggtgtgagacatggaataagagggatggatttgagctgaaccccggaggcttattctttcccctctttctaggctgaaccatcccaatgtggtggctgcccgggatgtcccagaggggatgcagaacctggcacccaatgatttgccactgctggccatggagtactgccaaggaggagatctccgaagagtgagtcttctggggttgtgggattgtgggatgttggtccatttgggccactctggaacactgggaggggagacaaggagagatctctagccatcatccaggaagctcaaagagtcagggaagtatcttcacctgctcagcctccctcttctatgccttctttggggtggtttctgtgcgtgcaaatcaaaaggctgagtcaggagtgcccacaagaaggctgaatacgggccgggtcacatggtcgctaacatgacaaggaaaagttaccatcaggcctggaccacgggaagaaactgaatgagtctcagaacacactcttcccctctggcacattagagccactgcaagcttttggggttggcgtcaccactgtccaatggggtgagacttttttcatagacattacagtgccacacagaatcacagcgggcaggaagggagccagcttagtcatcagagaacagggttgcagttccaggtcctcctgactcacctcagggcttcccctttccctctcctgtcctgtatctgctctcatcgcacactggacagtgggcgtcggctattctcccttgtcacacggacagttctgtatgccacccagatagagaatccttatgcttttacagggtgcctggtttatggttccaatatattggcacccagatagagttcctgcactgtaggtggatatcatggcccagagacactaattaggcaaagccctggctacatacagctgtggactagagagagcctggaccgtaggccatctcaggtgcaggcggcttgctgtctgtgaacacgggtcatgtccgttttgagaaaaataaactctccaagtgagattttttttttatttaatctattcttccaatagctccattcagctctttattctaaacgagcctcagcacgtggcttggccgccccttcacctctctctctacactgcagtttcccagactcacgtcatgtgctgtgctcttcatccttccgggcctttcgtctcattttataaaaagaaagtttccatgagtgactctgccgctgtaggggtgggcatgtcccgagaacgacgtggcctggggacaggatgtgcccgtaagtaggttgataacagtagagaaatggagagcttgaccacccagtgattctcctgttcccaaccattggaggtcatccagttgctcattgcggttatagcgggaaatgcacccgtgctgtcataggcaaggacttcaggccggagtgggtgggtgtggccaggtgacagacagacgtggtgttcagaaatgaggggaagtatacagttgcccttttaggcagcaaagagctcataagctaggggaaaagatgatggaaatgtcagcatgactcttggcttcagtgtgatctagggagaggcaggatgtgattgcataaaggacctctgtccttctgtccttctgccacttctggcactggggagaggggcctgttgcccagagcgctacgagcttcttctctttcttccctaaataaggtagcctgtcctttccttttctcaaaggttcaaaatctacattatctcttggcacagtggttctctgccttcctaatgctatggctcattagtaccatccctcatgttttggtgacccacctccaaccataacattattttcactgcttttatcttgctagttaggaactgtagtgtaaatatctgttctccaaaggttttaggcagcccctgtgagagagggtcgtttaacacccctaaaggggtggtgacagtcatttagagccactgtcttagataggcttgactggcacatagtacatttcagaatgagagttaacttcaaggcttaagtccaccatgctcagcctgtacctacggcaaagttagggaaggagactctttcttcaaatctgagatcaactgcaataggatggtgagaccttgttaaaaaagaaaacaacaacaacaaaaaaacaaaaactacaacccccaaacagactaaaactgtatagagtgcactgtatggtccagaagtggagtactctgggatgttcttggatttgagtgtcaatcaccacagccgactcacggcctggacaaggcgcagagccaggaacgcaaaggatcaaagttcacctcactttaggctgcctgtaccaactgataatggctcccccatctcagagggagcggtgggcctccttggggcagggatgctgggaagagcctgctgagttcatccctgcagggctgggtgtgatgctcaggcacatagcaaacacccattcctttcccttagtgaattgtccaagggagaccccattagcatagcggccagcggtggctttggtgagactttctgtacccgtcctttctgcaggagcaaactcagttgctattgacatttgaccctggccacatccttcagactcagggccttagtgaggctgattcaaatacttcctgccggggtcagggaggtgacaccatggctacccatagactgctgcttcactgactgacccaggagcaatccctgccagtacaactgctccagttgcctccagccagctccccggagcccagcacccgtctatctgactggcagaagacgctggtgggcctgtcagggctgtgtgatgctccacactgacagcatctctcctgttttctgcagtacttgaaccagttcgagaactgctgtggcctgcgggaaggagctgtccttaccctgctgagtgacatcggtaagtcccaccctaaaaacaaggccaggtagacgcacagtcccctgagagtccagtcggggacagggggaattgttagtgtcctgtggtctctgcagagggtgtggtgaggtgtacagagagcctcgtggattaagggggccagccagggctggttggaattgtagtgaactcagatagagttccttcctctctaagtcacagtaggaatgactgtggtcagagtgagatttcctttcccactcaagagctccactcctcgccttcctgaaacagtcagagcttcacccatgggcagtgaacctttctacccttactccggcagttatttgccaaccacaggcatagacaaacccactcctgttaatacgctggggtcatgggtgtccctggatgtgcgtgcttttggcgccctgagaaggctggcatcagggaggagagtcccatgggcctgcagagatgtgtggtgtctcctagatcccgagactccagagcagacagatggtcagctctgcctctcacctagagaagcagatactaaaagtgccacagagcttgctcagggctttaagattgattgggggacgatgatgatgatgatgacgacgatgatgatgtcgtttttccacggttggtggtgtagactgatagtttgggctctaagagtcagtgttacccagaatttatctttgaatgcatggtccctgttttggagaatgactccattttcacctctcccccacgctgttcttctcaaattgtactcgtgattcgtttactcaaactttgtttttacaatacagaaatgcagaccgtgtgaagtgatgtaatgaagtcatactccctccccttacatttcccagtcgttagtgttaatcccacctaagtacacgctgtgctctctaacctcgcagtccaggagcccctcaccttccagaaacttggtggctgctgcctcttacggcatatctttgggtagaggggaggcaaaagggctgttggaggcgggtgaggactggggtcaagcaaccatgtatttaaggctgaggtctaagcagtctggcatataaaatatccgcctttccctgcatcgtattgtttgcttttggatgaagtcctgtggagggctaggtgatattagtacggtcttcgttgactgagcagccacctcttggcctctgactctcccgtgtgttggtgtatgtgtctgctggaaaggccctgtctgtatacctaacctagaggtctagaattccactcctcttcgtgacaccatgcctcattctcacccagccacacatgttgcttagatgtttacttgattgcagtatttaaaatcagcagccaaactgctaatttgctcatgttggattgggttaaaggcaggctagaaattcgaggagtagaggtgtttatcttgtctccaagggcaacatttgcttcatcttggctatagcctccttcagttatctttctttgatactatcccctgaaatatttttcctctatgaattaggttacttatacgtctatcacatagctagtagaagtctctaaatggaactggtgactcacaccagtagttctagtacttggacgatagaggcaagaatactactgtgaaacctggtggtggtagcgcacgcctttaatcccagcactggggatgcagaggcaggtggatttctgagttcaaggccaacctggtctacagagtgagttccaggacagccagggatacacagagaaaccctgtctcgaaccacccccccccaaaaaaaaagaatattgctgtgaattgagggtagcttgggctacagtgaaaaccttgtctcaaaggaacaatgttaaaaagtcctgcttgcttggtgcatgttggacctgtggcctctcacatgctgggcatgccctctgccatggagctaaatgtcttaaaatccccgttttgtctccagcatccagagaagtggtggctggtatatatatcaccttgtctgtagatatttataacatcagtgtgccccaaaaggaattaaaagatgtaagtactcagtttctcccccaaaccggacacccctgtattcatactcctggcttgcaaaccagtttgtcctctggttagccatgcggcctgaagctcgggactcaaactttcagaatgtttgtttccttcactgtaacagaaacattgtttgcctctttcgagtcgctgcacataaaatgagacgctgtacatcagctcgtagcaaggcactcttcctaagatggaaaaatagtaaatccgtatggtctcctttctccttccctccctgcgggatcgtgagaaccctcagtccctactgtgatttatgaatggggttggagccagcaaacccatcaggtgggagttgcccttcctggaaatggctgatcgatcttccccagacccatttctcacccagcattcccgtcctatgactctgtttgaagttgctgataaatttcccttttacttgcgtaccaccccccatttctggtttggtccgaggcccatcagatttctttccttgtaacttctgctcctaagccagcccaaaagcgttacttggagcggctcagctacgaacccttctgtatcctgagcacactgtgacctcagtgcgaccctaatcctcgatgccggagtcaccacagctcttccctgcttggttgacgtcagttagttaccaagccacactctcggccacagggtccagcttcattgacttcccatttgggttaagtttatttgcccctagtctctgggacagccacacatagaaagcatcatcatggtaccggacacagattctcgctgtgagttgtaagctgccaaatacggctccagtaacttatacatcagaaaatggacagacaaagatgaagcctgcttcctgtgccagagcaagcctgtcagatcagtgccttccactgacaagagaacctggggcagacgtagaggcagcaccaacggttcggacttcccgtactatgaccccaaaatagcccgtgggagttacagttccactaagcagtcttgtttattgtcctttagaaagcactgaagtgttttcttcctgccagtgaagtagcaaatccctaagcagtcagggctaaggggcaggtggctgccctccttgtcctaccacggagccttggtcagtgacccccagtctgtcactgacctcatgatcctcctgcctctgcttcccggatgtcaggactacaggtgtattgcacatgccccaggccacgccccatctcccacatcaccttcttgctttttcttcatcccctccaccctgttttactctggccttgcctgcctggctttttgagcatccttatcaactgcatcatcttccccgtgtcccttctctagcctgaactgcgtgcccatgtctgcagaatatctctctcaaagtcactctcaaattgaattctagaacttcttattttaaaaacttgacccttttctgatatcttctttttccattgggcccgtgtttctgcctccccagacatgaatgaacatcaggtttaaatctcatcttttgggtcatcagttaagagtacttgttactctttggaggaatctaaaattggatttcagttcctacatggtggctcataaccacctgagcctccagtcccaagggatctaaaaacctctgaccatcattggcagcagacacacacacggtctacatacgcacatgctacacatgcgcacatacagacaaaataaccaaaataaaacaaaatctttaaagctcagcttcccctgttggttctttgcaccttccttactgtgcctgcctgagaggacagtaaagcacattaaacactctcaaaattgggctgggctgtagttagttcagttgtaaaacgcttgcctagtatgcgtgatgcccagtaactcataaactggcatgttggcacatgttccagctctgggggtggggggagggatctagaatttaaaatcatcttcagccacagagcaagtttgatgccaacctgagctagggaccagagggcatgctcaaaacagacaaaccaaaagtagaagaatagaggtcctcaaatccagtgtgtctttcctatcatagccttttcttcctgcctgtccccactgcctccagcagtacattgtcatagcaagtcattgtcgggaccccatgctggcttttttgctaatccatttttcagaagggcactttctgctgtgtgcccgaagtcactgagcagcccagactggcctcaaactcacagcagcccttcacctcagctcctgaatcctgggcttacagatgtgtatcactatgcctggctgaaggatactttcatcactatctgctccagaccccttcttcccgcatgtctccaagtgcagtagccagcctgccgtgcacaggatccccacagccattcccctgcttgctctgctcttgctattcccacaccacaccaggggaccctcagcttttccatcctttaggggatagccgtaggttttgcttgtcactcttgatttccctcgaagaattcctctcttcacggccactgagcaaatggaaggatgagtctgcactttcatcttaacgtttggtcctcctccttccgccctgcttgttagtcatagaacctattttagttcagaaaacttgagccagaccttgagccttacctggaaagtccaccaacaggctgggcaggcagctcctggtagactcgatgttttaattaataacagacatcctctcgcttgggccacccgttggttggcttcctgcatcctcctgcttcacctccctgtctttctttcctcctttctgctccccccccccccatcttcactcaggcagtaagatacaactccagcccctgcatgtccagttttgccttttcttggtcttctgatttctgacaccccaaattttctggttcatttgtctttccatttcttcccagtgtaacatatatttaacaagcattctgaaaagagcttaactacctcttcaaacttatgttgaaagatgggatttcataggcatgccccttctcaaccagttctctttattgaagtctgactgctcttccctgcttcctgacttgttgtttgatcttctgaacaaacgtggtttggaatcaagtcgcatccgtcctgtaaacccagggagatcctaggtgcagacctgggtaccaccctggcaattacagtgatgccctttgtcttctgcaagtaccacacctggatctctgcagaatccatgctagaacaggccagcgtgtagtccagagagctgtttgtttcagtactgtagataaaacccaggaactaacgcatgctaagcctgacagcatagtctaaaattgagtgtttcagctcatttctcaaattggagcatgagagattagttaaacttttatgtgttgtgattttcagtttttatgggtatactctatcacaacatccaagggtttagatttttttgataaacttccagacacagcatttttttcttttgtctcaacattgcatgtctcatccagtttaaaccaatttaggttttcttggaattaagacagtgttaaacaacttcctgacactgttcctcagggactgtttgtgaaatgtacagtcagactgcccacagcgcattatacaatcaaactgaccacggctcattacacagtcagactgatcacggctcattatacagtcagaccacccatggctcattatacagtcagacttcccacggctcattatacagtcagagtgactatagctcattatacaatcagactgaccacagctcattgtatagtcagactgaccacaggtcactgtacagtcagactgaccacaggtcattatacagtcagactgaccacgggtcattgaggatctgtttcaaaaaaagatgtttgaagaccttgcctgtcagaatgcttgctgttttagccacctaaggggctactcagtccaagaaagcacttagagttttacctgtctgattcctttaatcccagcacttggggtggaggtaggcagatctctgtgagtttgaggccagcctgctctacaaagcaagtccaggacagtcagaacttgttacccagagaaccctgacatctttggcttgcacgtgcacgaacatcacttgtgtgaaaacatacaccacacacatactcaaaggattgcccagtataatatggatctgtcataatgtaactaggtgtttcttgattataacgaaatttcaacttatttctctagctgttactctacgttatgcagtatctgtatatgtgtgttatcaccctgttttgggagaaagacctttgaggcagattctccatacgagcagattctcatgctcaccttgaactccttcctagtcaccccataattcctgagccctggattacaggcaccaccatgtccagagtttcttcctcgccccttttcaagatggcaagcactctgccactgagccactttcccaactcccctctcctttgtgatgtgaagaaagactgaactcaggtgtgctaagcagtgatgttttcaattttgtaagctagtttttcagaggcagaaactgtagttcactctcaggtgtgctaagcagtgatgttttcaattttgtaagctagtttttcagaggcagaaactgtagttcaagccagatggatggatggatggatggatagatggatggatggatgggtggatacctagatagatagatagatagatagatagatagatagatagatagatagatagatgcatggacagatgaatggatcgatagatagatagatggatggattttggatggatgatggatagatagatggatgatggagagagagagagagagagagagagagagaatacttgtgcctcttccagcagtgtggcggagcacccttgttgcttcactctatagtctttgatgtcagcatgggcagctgtccactgcctcgcttgtcattcatattccatttgtgtgagagagttatcttcccttcacctttgtttgtccccttctgggcattgaacggaggccttcattctcgtagacacgtgctctgccacagggctacatcacaacctctctttttacttttgatcttgaaacagtctcaacaagttgcccaggctagcctcaagtctgtctcaggctcctgggcagctagagttcccagctggatctttgctttatgctgattttttttgtaatgtttataaaatattttaatttcattttttcttttttatgattacttaattgatttacttgccatcccctttctcctgaattttaaaggctctgtttgctgtggagtgtatgctgcagatattctttcccaactccctttgcctttgaactttatggcgtctttcactatgaattttcaaaacatttttgtgccacttcccgtgtcccctcccactttgctaactggggtctattgcaggccggccttgatctccctagaggatgactttaaactgctgatcttcccgcctcccaactgcccaaacaccaccatggcttgtctttatgtgatacttcagcacttcatgcatgctgggtgtcttagttagggttttactgctgtgaacagacatcatgaccaaggcaagtcttataaaaaacaacatttaattagggctagcttacaggttcagaggttcagtccattatcatcaaggtgggagcatggcagtatccaggcaggcatggtgcaggaagagctgagagttctgtcttcatccaaaggctgctagtggaagactgacttccaggcaactagggtgaggatcttatgcccacacccacagtgacacacccattccaaccaggtcacacctattccaacaaggccacacctccagatggtgcctctccctggtccaaggatatacaaaacctcacactgggagaacaccatactagctgaactgcaccatcagtgggtgtgtcaggatctcacagttagaattctactctcttgtcctggtctccttcacccaacatgaacagtgtcagccacaggctactcaaaagtcagaaaatgtgtcaagacaagacacaccgtattgtctcttgcaggctagtcaattctgagacaaaaaaaaaaaaaaaaaaaaaaaaccacacacacacacaaaaataactcttttctagacataataaaacatcactccccgttgctcttcctcagcatcggctcttagataccttcacgaaaacagaatcatccatcgagacctgaagccagaaaacatcgttctgcagcaaggagagaaaagagtgagtggcgtccccgggtctcagagcatctcaagggccatgtgggctgctctggcacacatgaaagggatgtgtgtgctttggaagctgcctgtttctgtatttccctgaggcactctggttctcttaagaaccttttttttttctttcttttgtttttcttgaaacagcagtgcaagcagattgaggcaagcttagaagtataacattggagttttattttcatctttattttctccagctctgaatgtagtacattgttaactggctaagtcagaggaacctgataagggacacaatgtttgttaattcatgtccaccctcaacctaacacgtcttggaaagagacttttttcccgtttgacttgtgagcctcatcttttggtgagctgaaatgagctgacgttggctgtggatatggccgagaagagacacgaagagccggcatcggcccatcttggacatggtccagcttgccatcgcacacgaactatctgtagcccttcttctcaatggctgccctactcaagtgtgatcatagcctctccatgggcttggatgctgtagttttcccagctctgttcagccaggagtcagcctccctcacaattcccagcccagcccgtgactgtggcaggctcatggagctatcatccttccagtaatcctggatatctcctgagcaggggctggcctggcctctcacattgccaatccaggcttagtgatcctgagggatgatatgtaggttcttaattgattggtggcagaccaagaaaagtatctgcccaacatttatagtgccccaaatctactatgctgagggtactctcccgtgaatgctgtggctctaagatgtttagggaccagtgtcctttgggaactcaggaatgtctttgctccgatggcaaactgccttcttacagccttcagatttcttctccccacccctcccctcccttcttttttccagttaatacacaaaattattgatctaggatatgccaaggagctggatcagggcagtctgtgcacgtcatttgtggggactctgcaatacctggtaagaaatggggctccagtgtttgcttctctgatcgctgatatttgtatttgtgggtctgtctgtccttcctacctgtgtctcagtcttgccggctccatggatatttagaattggtaatttacttgtgaatgtcttgtgccctctggaaagactgttgtgagaagggctgtgtctgtgtgcctttaggaagagcctggaacctctgtgtgccacggggtcttatctgatcatctgtagaggctgagtttcttggagggtctcgggagccagggaggaagaggtggggctgtgatttcccttctgtgtgtcatggggtctgaataatggaatattatctgagcgactcattcatcaggaatatcatgtgccagagattgtactcagagctggtattacaacaggaagagagagaaacattttcagatcatcaagcgcttggcatttgaggaaaaactaaagaaaacagacatttgttaccgtgatacacagataatacagaaaacaccattgtcttgggtaccactgattaaaaacaaaaaaatgcgcattgtgtctaaggatgtatacagggagcacctaactaagtctcggcctaaaggcaaagggctaaagtgggagtcggctgtggaaggaagggagaggcgatgccggcagaagtgtagtagatctccttggcatatcctattggatatgccattggaagatgtagtcgggtggcagacaggggctcagaaaacaaagacagtgtctggaggtgaaactggggagaaaaaaggggcagattattgccatctttttaaaactggccttaaaagttttaaactgtgttgtaaaaaccctggaatagcattgaagggcctcacactggagaagctagcctcgaaggatgacgaggagaggaattgtacccaacaggagaacctcgacacctgcacatctgctcgaggagaggagagaggtagagagcgactaaactcaggaagtgctcaccaggctgggacactgcgttacacacccgtcatctcagcacttacctacaacccaagtacttggatggtagaggcaagaaaagaacaggcttggggctagcctggactacacagtgagatcccatctttaaaaaaaaaaagtcaggggtggcagtagataacagagactctaaggaagacttagtagtagctcacttacgggtgataacagccatcagcctgtgattgaatggtagaatctgcagttccgtgaacggaaacaggtcagattctcagggctgaatgagcttcagcatcctatttcttaaggaagaaattatgctgttttcctgaatccagtcgtgtttcccacccagcctaccaactagcgtactcggttccctgttcctctcctactgtatggatgcagctttctcaacagtgaccacagtgacattattcaggccttgtctccatatgatgtaattatctacttcctgctgtgtaccctctggggtccaatgtagctcagcatcaattaagtgacgtgaacccatgctctaaccgtcacggacgaatgcttgcctggctcctgggacttgagggctggcaagagaatgaagccacggctgactgacaggcacctctgaagctccctgcgttatagcagagaggcaaggttattcactgaacaaggaggtggggtctcggagatgggtttgggtctagccaatcttcataggagtctcgatggagaggagcggtctctgagctgtcagtgttgggggggggggctgtaatatacctttcctgcacacactttcagcagtcatgcatggaccccctaggaaagctctgccatctctgatccttaccgctgtgggcagggctttgccatttccccgtgggcctgaggctgtggtccttgacacggcagtgcccacgtcagcagcacacattcactcagatttcctctgtgtcccactcaagacgctgagtgaagctgtccacatgtcagccgcggccatgtctagagactgagctaaatttttgtccaaatctctcttgcttttgactccctggcccttctgtgagtcttgcctgcccatgtagatcatgtatggtctttttcctgctcatggtcctttctgggatgtttctttctgtgtgtttccttcaagcttttggagcccagattatggcctgcctggcttcatcaccctcctgggtcactctagctctcttagcctgggcgacaatcgtgcatcttggttctttactgcttgaccgtaaatttcccatctcattgtatggctatatgttagctgactcagggttccttggtccaatatatgttctatacatttggtgtgtacaagctgatgtccttttgtctgctggacatggcttatctctccatctctatacaacacccatgaactgggtactacatgaaatcttcactaagtcctttaaataccacctcaattttaaatggggaaaaaattaaataactgtgaaatgcgtaattgattgactctgctctactttgaagcgacccctcaggagcctgactctcctcattagcatagtctcattgtgaatatgaagtacagaaagtcagttacccacagctgagcctgcttgggttcctctcctcacacccaagtgggcctactgtgcgctggcgacgatggcaggaggctgactcctctatgagctggtggcccttctgtccagggagaggacagcataggctcccacctgtgtgttccaggcgccagagcttctggagcagcagaagtacaccgtgaccgttgactactggagcttcggcaccctggccttcgagtgcatcactggcttccggcccttcctccctaactggcagcctgtgcagtggtgagtgggcctggccccagtgggagggctggctctaggggaccgtgagccccgggctccaggtcttgtcatccagtccttgtccagtccccaggttaggcctgaatggtctgtggtccgttctcccttaggactcggccgtggcagttcaagctttccaatattgaacaagagtggtcgccagctgttacatgtctgacaacattaacacagtctagtagggtcagcctcaagagtcagtacactacagaccatggtgtcgccgtgcgtctatactgaaaatgttagtgaattactagtaaagagaacagaggtgcacgcttggcatgttatgaaggaatatttacactgtagttaaacttgtcaacagtaggtcttcctgtagaaagttactacttaaggtagtttctgtgctagtaataagcccacatgattcaagcttcaaaagaataagaaaatagagggggaaagattgtctcatcaaagtttccacactgcctggtcccctccccagaggccatgacagccactggcttgggtgctttagggatgcttgtatccttctcggcgggttgtgcttgtctgtctgtgtggtgacatcttctctgctccagtggtgtaactgagcactgttctgcgtggaccttgagagcagttgacagcagaatttccttcagagcagtttatttacagcacacacacacacacacacacacacacacacacacacacacgctcacgcacacacgcacacgctttccctggaatctacatgtgctgtgcagtttgccccacattaattctgtagtattttggaagatatagaaataatgaaaagtccagaactcggtaccatgtattctaaaattagaaactttttcttttacatagaaaataatcagctatagccagatgatctgtaaacaatcactgaacatcagttctgcccatcttcttatatgccctttgatataacctgcttctctgctcacactgaacatgctgcgtgtcttcctgggctctgggaggtctctgctcttctactcagtcactgtggtgtagttcttggccagaagactgagtggtttataattgtgcttcttaaaaaacaaaacaaaacaaaacaaaacaaacaccacaaatagcatccctgtaaagccgttgttcagatgtagctatttgtctagttattcatacatttgtataaatagaactaagaggcttttaaagagcacacacagtttaaaggctttgatgtatcttatgccacctgccagaagcggttgtacaaagacatgcttctgcaggagtgcaccgatctgaccttttccctgtgccagtctcaacagcaatgtcttcctttaaaaagaacaagacaagtatttactccaagaaaaactatatggtagaagatgacagtgacttctggccctgctgcctccagctcccagaagctggaattacaggcatgttctatcacacccagttttattcagtgctggggatggaacccagaacttccttgcatgctaaggcaaacactggaccatccgagccacatccccatgaaaatatttctagtgagaaatgaagcctggcctttgaagtcagttctagaagaaaggtttgggtggtagcagcagagaccacctccacagttaaacccacactcagtcagtacagaggcagagagtgttctctggaaagcccactgtcctactgcttacccacaaggctttgctctttcaagcccgtggtttctgagatatgggagaattaggtacatagttcatagtcacacattataatgtaaccagaaaataaaatagctctaaattgttcgtaatgtactgatttcagctaaccaagagattggttgttttgtcttcagttcgaacatcaacttttccaaattggtgggctccgtctccataacggaggaaaacatcacaaatgttgaacttttctctgctcataacaaaataagttagtctgtatagaactgaaaacacctttaatggcctggcatctccacatttttgtctgttgtctgtgagatctttcccctaaaaccacccttacttggcttcaagatgccaagttcactggagcctcgtaggaatcgttctgtggactagttatgagaagaccttctcctgggtttccaatgtttggtgacattttcatcgctcaaatgacaagacatgcagtcaagcagtgcatgtgttgctctatgcagccattgggtctcctgctaggagactgtgctctatagaagcagctgtgtaagttagaagccacagagaccctgacctccgccatcagttccccccctaagctgaatgccagcacctttgccatgcagacggcaccttccatacttcctgcctgccctggatagagcacccactgtctgccaactgtaattgtttaaggctaacgcattttgtttttaatatgaatgaccccttttaggggaaggatatatttgcacttttagatactagaaattatatcaaattttgagccctttgttctgtcactctgtagtgtctctaacattggacaacacgcactcagactaaaaataatttcaccacatggggtcatccccgaaaccaaaggaactttggcagagtacttggtcattcatgacgcattattcaaatttaagttggcctcgtttccaagaaggttggaaaccacttggacttaatttttttccccttccaaaagtactttaaatactttaggaatgcccctacgttagaaaatgtaaaggctcatttattctaaaaaaacaaaaacaaacaaacaaaaaaaaagttagccatatacttttaaagggaagtgtgggcctgcttggtagctaagtgggtaaaggcacttgtcccctgagctctgtctctggagccctagtggtggaatgaaaaccagttcccttaagctgtcctctgagatgcatgccatgtggcaagtgtgtgcatgcatgtgcatgaacacatatgtgcacacatacacacacaaataaataaatgtcatttttaaataaaagtaaagtacatgtgtgcttattttacatttcaaataaatgtgatgtatacacaatgaccgtggttcagaacccccaaattgtcctctatccaaacatgagagctgtcctggggacatggcttggcggttaggaacacttgctgttcatccagaggacctcggtttggttcctagcacctgcatcaggcaggcagcccacaggagacatatatccttctacacacacctaagtgcaattgaaaatgactgttttcaaatggaagttggtccctgacaactgaggtgcagaggaaattagagacatggccaagagcacttggtcgcccatgcagcactactcagacttaggttgtctctattcagtcctccacacagaggtcaacggtgcctcctggagacttaggacgagaggcctcctgctggactcagtgcactgagctaagcccctaaacacagtgccgaccactcacaaacactcctgctgaactcaatgcttagagctaagcccctaaccacagtgccgaccactcacaaacactcagagaagcatcctagcagcatgctgcccaccgttttccaaaagaatagtcgtgaagtgacattacacgtgtaaaccgggtacttgccactgagtgacataaaggacatcttaaaatgacacctacaggcactccaaagtccggcagaagagcgaagtggacatcgttgttagtgaagacttgaatggagcagtgaagttttcaagttcgctacccttccccaataatcttaacaggtaaggccgtggggcatcagtcttatagatcttcttcgcctctgtttagagctacaggtttgagataacagctgactcttttttactttaattttatacgtttgagtgactggtgcctgtggaagccagaggaatagtcagatctctggaactggagttagagatgactgtgaactgccgtgtgggtgttgggaaccaaccctagctcttaagcactgagccatctccaggcccatgcataacttttgaatagatatcagaacaccatcctgtgattgagaatttggaccagtctatctcaacattagacataggatgggtttccatatctcatcttcctaggagtctttttaaaaattgtttatttgtttgtttgattggttggttggttgctagcttgcttgcttgcttgcttgggtaggtagttggtcaggtggatgagtgggcgggtgggtggttaggtgggtggttgattgggtagttggttgattggttggtttttttctatggtggagatgaagtccctggctttggttttgattggtggcttttttgttttgtttttttgttttgttttctttggtttggatttgattttttgagacaaagtttctctgtgtagccctgaatggcctggaattcactctgtagaccaggataccctggaacttggggaggcactggggaggcagaggcaggtggatctctgtgagttcgaggccagcctagtctacagagtgaattccaggacagccagcagctgggatccctttgtgcccaagaaatgtttataataccccagatatgtagatacataaagtatataagtcaagcatctactgataataaatcatatattttaaaagaatcatttggtttaatcatactgtttaaaggcaaatattaaattttattaaagacaaatattaagttaaaatattcatatattaaacttacatactaatgagattaatgaaatgtatgtgattcgtttacacaaagaaatcttggcctaattttttcatattttcttcatatgtgtgtttacacatatgtacacacagagacatggtgctgatcaggaaaccacggaaccaggcaagcaccccacccagctctcacaagccttatcaaagtgtcagggtcactttcagtgtgtgcaggtgtatgtgtgctatggaagacaaccttggctctcttccgtcgctccacaccttctccttttcaaggcagagtctctctctcaggtctggaattcagcaagtaggctgagctggctgacccctcaaggatccactcatctgatagaagcatttcttatgtggactctgggatggaacttaggttctcatgtgtgcacagcaagcacctcactcgagctgagctatcagccaaggaaggctgtgtgtgcttcgggatttgcacactgcggcaggccggctcaggcctctcttccctttgctcccttagtgtcttggctgaacggctggagaagtggctgcagctgatgcttatgtggcaccctcggcaaaggggcacggatccccagtatggccccaacggctgcttcagagccctggatgacatcttgaacttgaaggttagagcagagcccaagcagccccgaggcagcagctgtggtccccagtggagcacagcagtctttccaaggaagggagacatatcagatcgtgggccacttggccttgtgaagaaattcaggttcctctgactctttgggctaaaaagaggacaggaaaattgagatgactgacatgttttgacatcttgccgttgaggaaaaatgggacttaaactagccctttaccagcaagtatgggttgggggtagcaaagggtcttggcaaatccatgagccttttgtaaagaattttgatttttgggatagtgagatagctcatcaggtaaaaatacttgtggccaagcctgacaatctacctaatggaaaagagaaccaactctttccaactgtcgtctgatctccacacacgtggtgtggtgtgcgcacgtgctcccccctcctaatatgcaagtgtcttagtcagggtttactgctgtgaacagacaccatgaccaaggcaactcttacaagaacatttaattggggctggcttacaggttcagagcttcagttcattatcatcaaggcaggaacatggtagtgtccagacaggcatggtgcaggagaagctgagagttctacatcttcatccaaaggcaaacaggagaagattggcttcctggctgctaggatgagggtgttaaagcccacacccacagagacacacctactccatcaaggccacacctccaaatagtgtcactctctgggccaagcatattcaaaccactacagcatacaaacacacaatgtaaataaatgttaagaaaatttcttcccagtaacatctgggttgtgttgcagctggttcatgtcttgaacatggtcacaggcaccgttcacacataccccgtgacggaggatgagagtctgcagagcttaaaaaccagaatccaggaagacacggggatcctggagacagaccaggagctgctgcaagaggcagggctggtgctgctccctgacaagcctgctactcagtgcatctcagacagcaaggtgagtcctgacttcttcctgcgccctgcttgccctgtttccctcagatgtggtctcctagaacactgtcagcattccacattactactctcactatgacaattgtatacagtgacaccgtgtacaaactgcttgatgggtcaggagtcccaggtgggtcgctaaaagacaccaatcattccatactcagtttgtcacttccagaccacgaatattttcttgtgcttccattgccaaaatcatgttttgctcttctagtcaggcacctgtgctaaggccatcgatgtgtgacatggtgtctgccccaaggtgtggagtagttatggaggctacagcctctgcacagggaagtgtgatgtgttcaggtcacaggagaagcaagcagagtaaactagaacatgatgtaaggcaggggcaggttcagataaaaagggtaggagagaaagcaggctgagtcacgcgtgcttcttaggctacgatgctgccctccacgtgcaagtggaactgctttaagaccaagtagccggaaaggaagggtgggatccccaggtctcattgttttcttgtccctctgcagacaaacgagggcctcacgttggacatggatcttgtttttctctttgacaacagtaaaatcaactatgagactcagatcaccccccgaccccaaccggaaagtgtcagctgtatccgtaagtgcatcatttattaaaacccatcagttgcgatatttagggtaaagttggaggagctcctggttgtttggttctgagtatataaagcctcctttacttggaatgtgcagagaatagtccaggcaaagtactggttaactgcctctcactagaggtaggcacagggttaagaaataccacctacttctgtggttcatttttgaggttgcatttatatttcaataactaatgtgcattggagggtaaaagcaagaggggtcaggagctcagccacataggatgttcgagaccagcctgggctacatgaggctctgcttataaacaagaatgacattaacataggtacatgatacaaaaacaacacaaagcctcaaaagatacccaaaaaagaatacacaaggcaaagtgaacactcgggctctagtccccagccaggaggcttgccttctgtagaactactgcttccaagtgcttgggtatccccctcaaagagaccacgatgacacagacatgcactgttctgtgtgtccctcctcacccaagtcgctcatttcctctccctcatgttggagggctgcatggtgctccactgcatgtttgtttggtgaacatcttactaacctagccccgttctcagccccctttctctcagatacatacttggagtaaacagaccaaagagctaatgtctccgagatctcccaggcttcttgatgatttaaatatctctagtatttctggtttcaggcttcatgttaaagtacttgcttaattaacttatttgtcaccgttgagggccgtatgtgacacactagaggtgtgcacatatagaggtcagaggacaactttggaataagttctctcctcccactttcatccacatagtcccaaggacggaactctggtctcacccactgagccatcccatatactttcatatttcaggaaaactccatacaactggtactgggcttctggctacatcatgggttctcctttcttcgacccttttcctgccctcttctacccttccaaagccctgacactgagtaggaaagaaaaaaggagagaaggacagagggcaatgccattgttagactacttcctggtggttagcagtgtcgatttccttgggacaagtttgatcttccctgacaggatgtttaatttcttctttttgtctttttgcacatgacaacttgacaaacctcaaccaaccaccaaccaccaaccagccaatcagccaacagcttccctcctcccccaattggggctttagcatttatatatatcctctgaaaagtccccctaattccaaatctcacacactcaaaacaaaacaaaactatgtgcagctggcagaagtcacacccctgctagatcatgaggcaaatcatagtcagctgctgtggacagtcggaagcagcctggcatcccacacctgggattaaaacaaaaacattcttatgtttctgtatttaaaaaaaaaacaacaaaaacaaaaacaaaaaaaaccccgaattctcactatatacaactttaactgtgctgacagtgagagcgtctgttgacaatctatggcgcgtgtgcttgtggttctttctccacgttgtccccagcacaggctgactttgaacagcagacctcctggctcagccacccgagtgctgggattacaggtgcgcatgcatcaccatcaaatcacgtgggagctttccgttggccatcccttctgctaatggagcaccgagttgtttaaactaataacaaacaacaacacctgtaaaatgatgtagcagtatagcagttatataacttgtaaaaatcgcggcaatgctgtggggcgggatgtggttccctgcagctgcgttcccctctgacaactgtttgtttccagttcaggagcccaagcggaacctctccttcttccagctgaggaaagtgtggggccaagtctggcacagcatccagacgctgaaggaagactgtaaccggctgcagcagggacagcgagcagccatgtactgcgccaggctggctttacctaatacgttttaaattgcttgttggcctgagaggtggctgaggcagggatccagaagcaactcttaggggctctggtttggacgacagggtgtggttgggtggcctggctggagggaggccctcgggctggctaaggccagggcttagagaatggggcaggagtgcagaacttgggtctgggaggctcagctgcgtggcacgtggagcttggagaagctcagtgagccttgggttaacaatggtggttaactggagcttgccgacggattctccaattaggacgaaagcctaggtgtagagtttcacctagttccaacattgatagagaccgtcatgggtttctaggaagctgctttggtcacagcggtggctacaagcgacgagccgaggctcccttggcaaagcgttttgttactacacaggaagtgtactcagatgccgaatgtgtcccaaggctccattcctgtgtcttcccgtccttgcaggatgagtctcctccggaataacagctgcctctctaagatgaagaacgccatggcctccacggcccagcagctcaaggccaagctggacttcttcaaaaccagcatccagatcgacctggagaagtataaagagcagaccgagtttgggatcagtgagtgcgctctgcctgctgtgagccggaagccgcttctctccggtctctttctttctgaagtttctttgccttctctctcttttttttctccccacccccttctttgtcctcttatggttcagtttttaacttctgtttgagttttatgatgtttctggttttcattttttttttcttctttctgttttttcttccagcctcagataaattgctgctggcttggcgggagatggagcaggctgtggagcagtgtgggcgggtaggagactcaccccagggctctgtgtttctggctgtggccggaacttggcgctaccatcttccactcccttatccaatactggcttgagctgctgtgtcaaactgagcatttcctcaacacatcctctgaccctaacctgacttgctggacggacgcagcatagagagacgagagagccccgctatgcccagacctgagagctgggcagagttgctccggatttagtaaagaagtgtcaggtgcccttgggagagtcaaggtttcctgctcccgcctcacagggtttcctcccaaacttgccaaagcatggaatctgtaaggaagaaagggtctaagcagaagtctcaggatagtatgccttaggcaccatttcagactcctcttcacaaggctagagaagtgtaacgtgaggcatcatgcacagatccaagaccccgcctgccagagcttctcccgctccaattcctgtgcactggacagggccttttcctccgggtcctagtatgtaactgtaaatgagacctagtaggtcaacacttacctaaaggtacatggacatgaggccagtcaaaggctcagtgggtaaaggtgcttgctcctttacgcctgatgacttgagtctgatgtccagaacccaccttttaaaaagctgataatagcatgcacctgcagtctcagtgttcctccagcgagatgggaggcagagacgagagttgctggaagctcacaggccaacccctctgaagtacacaatgtgtcagaaccaacaagaaggacttgcctcagaaacacagaacgagacactccactcctgaaagtgttctccagccgccacacacataggcactgtggtacgcagatgccagcacacacacacacatacacacgcatgagcatatgcatacagtcacagtgatgcatcttattcaaagatgttcgccctgtatgtagttccttttgtctaattctgaagaactgtgtgtcttcctcgccagtttgatagtcagctttagcacccgcttttggtagacacagtaaaagaagacaataatctgcactggacatcatctctgcccgacagtgagcttattctattggttttacctatgccgttaagccctgttgaaagtttgcttctagcaggggaaactggcttacagttaaggaacttttgagggtctcacgctagaaagtggtagccatgagatccaagcttggagcaacttattcctgaacacacatgccttctagccagtcagctgagggtctccccagcctgcccatcccatctgtcctcccaggatgccctctgtccatcaggtggcatgagcacagctttcccatcaggagaatgacgtgaagcatctagtagagcggatgatggcactgcagactgacattgtggacctgcagaggagcccgatgggtcggaagcaggggggcaccctggatgacctgtgagtataactggggaggggcgacactgacacagagcacattgacaccctgtagagtttcaggaggttctgtggggtatagctcctagtgaatcactttggctcattctctaggataagttgtgacaaatggctgtcactttgagccttgtccctgtgaagtgacaaggaaaggtgtcctcccagagtgggaggagccagctgataacttttaaaggttgtgaaacacacacacacatgctcacacacacacacacacacacacacacgagcacgtgtctgtggtagcagacgtccctgctcagacagcccagcgctctaggtgtggctcccagagcaggaagtagaactgagggaggagcccaccgagtccaagagtttggcactgtgtccaagaggagtcagggcaccaagcagatccatcctgcctggagaccctagcatgctgccctgtgtgctcacagagggctctaggcaggtgggtcagtttaagggccctgtcacctgaagggatcagtgtcacctgatgctcttactagaattcttagggtgagacatctgaaaacaaagaattatttgttctccattgtctcttatacagtaaccctttactcgttcttcaagtttccaaatgaaaatctgcactttgtgcacatgcgtatatggatgtccgtgtgtgcacatgtgtgtgcaggtgttctttgttccaaaacagggtctcactccatagtattccagaccttgtgctcgctagggagtcaagacttgcctcaaattcacagaaatcctactacctcagcttcctgtgtgtgcaaccgagatcagttagagcctccttctgaggctgttgccagcctgcctgtgttagaggaagaaataggccttcatgtctagctttggacttaggcttttgagggcaagtattttcttggtcaggtccagaaatggtgaccaagagtgaccttgaatcactcttgtagctaagcagaagaggactgtaatctttaaggctgttctcgtttgtggcatttgggttttataaatattaccataactggcaggttttattcccattgagagcatatgaccagtagtctaaagagtagtgatccgctggcaagagttagcaggctggtgcttaaatgtccttggtgtgccttgactctggccttccctcttccagagaggaacaagcgagggagctctaccgaagactcagggagaagccaagaggtacatgctttgtcttgtctttgagacactggtctaccctggaggccagtaggaggaactatgccactcccctctgcagaccaaaggacagaaggtgacagccaggagatggtacggctgctgcttcaggcaatccaaagctttgagaagaaagttcgggtgatttatacacagctcaggtaggcactccctcgcctcctccaggacaggatggagaatcaagcaaagacaaggggcagatggatgccctcgctctgctctgccttgcctacacagtgaagaaccgatcctaattgggaacagctctgtgctggcccagagctctcgggagtgtggctctctctgtccttacagtaagaccgtggtttgtaagcagaaggcactggagttgctgcccaaggtagaagaggtagtgagccttatgaacgaggacgagaggaccgtggtccggcttcaggagaagcggcagaaggaactctggaacctcctgaagatcgcctgtgtgagtgacttactccggcctctcaggtctcctccccacgcactgccatggccctccaaggaggcacaggctgacctgtggcatggagtgggcagggagggttccggaagggagggtttatgtgagtgtttttactgcccacgtggctactgtacgtaccacaaggagctccaggcagcagacattgttctttcagagcttcagagaccagaggttaagaatccagttgtcagcaaaatggtatctcttctgatggatctagggcaaagccacctccaccccacccccacagcggctcctcacctgtatctgtgtcttcagttgacaccagggtctcatctgaatgtgtcgtgtaagacattcagagctagagatgaatctcagctaaaagatgtctgccctgtgtataaggtcttgggttcagaccctagcaacacacacacacacacacacacacacacacacacacacagcagaaggttgcacacttatcatcccagcacttgctgagacaggaggatgatgagtttaggccagcctactcgatgtcatgacaccattcaaggtgttagtgggcagataaggaggtggcatggtagcacacacctgtaatcccaacacttgagagtctgaaacaggaagttcaaggctagcttggactacgtagtaagatctgcctcagataacaaaataaccccaaatagaacaagacaaggagatggcttattacagaagcaggaaacaaaaatggtgctttgtgaagattctaagactggagcagctccataggccagaggggaggaggcggtgccctgagggactcacaacagcaagctcacacttgttctcactctagagaactcagggaagtcacactccggagcatcattggtgggtttgcctgggtttgataggagctggggtgtatttcctcctgtaagcaaggaggggacgtggaaatcgagaaacaggcactggcttgtctgtcacctgcactcatgaaggagttgcgaaccctgtgaggagtagcctaggctagccctgggagccagtccatatggagtaagcttgcatgcctagggtagaaacagaggaagtgggtgttctgctctccccacggggtgcagcagatgggtgaagaacagtacaaatctgcttgcttaaaaggcttgttgaaggtggttagcccggggtggggggccactggagaagtagctggaggtgctaaggaattggctgcaggcatgaggaggtggccaatagccactgcctgggcctctagctggaggagggcagctgtagcaactctggtcatttagacacctcagtgttctgtcttagttaccacagatagtgcattgttataatctcttttgtatcttatttcctacttggaaaaagagtgaaaacaccttcctctcctttagatttatgttacctttgatggtgtgtgtttgtgtgtgtgtgcacatgagtgcaggtgtctgagggccagagacactgggtccccaggagctggagttctaggcatttgtgagccacccactgtgggttgctgggaacccaaacttaggctctctgcaagagcagtatgcacagtagctaaccactgagccatctctgtagccgctgactccacagtatgcttgacttcctattatcatcattcagagcaaagtccgaggtcccgtgagtggaaagcccagacagcatgaatgtgtctcgactcagtcaccctggtcagctaatgtcccagccttccagtgcctgtgacagcttacctgaatcagacaagaaaaggtaagctgtgctcggcagggccaaacgtcacgttcaagggcacacagggagactgggaatggatgcgcgtgtttgtcaccagtcacttccaccctagggtcttgtctatacatctctttttgtgtttatcaggatctgtggacacagacatgttctttacagtgtcttgacatgtgcccactagtttccctgtccaagagttggatttccagttgtctaatgagaacactgaaattattagtgtacatgttgctagttgttctttaaaacctacttcagggtgtgccctctatgtcacatctgagcccctggctttgtccatctagggcagtggttctcaacctgtgggtcatgacccctttgggggtcactatcagatacccttcatatcagatatttatattaagattcataacaatagtaacattgcagttacaaagtagcggcaagcctaattttacagttgggggtccccaccacatgaggagctgtatcaaagcgtcccagcatgaggaaggctaagaaccaaggatctcttcacacccagtgcctctctccatcctccttcacctcttcctttcttctttttaattgctgtgtgtgggaagatgtgccttggtgcgctgtcaaggtcagaggacaactggtggaaactggttcccttcttccaccctgtgagtcctggggcatgaactcaaagtcaccaggtgtgacagcaagtgcctttacctgctgagccctctctcaggtcttttctctatcctgacagatattatagctcttctctagcaagacttttaaattctcttttgcttcctgactctttaacttctagccaagtcctctgtttacttcgagtgacattctgaccaagtcatttggccagtaacagtgggtttgtaccccagtctaaatctaacttttaagtgtttatgaacacctcagtgtggttctggatcagtctgttgtatcttacaaacagtcaagatttctaacataaattacataataataatgtttcttaaaaatcctatttttgatcctagggagtgtatagtttttggtatttaattatatgtttctgtggagtcttaattacccctcccatccttgctagttcctggaggccagacagcgggtcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcatagacaatccatggtagaaaaagccattgttcagtttagatgcactacattgccagaaatgtgtgctatgaaagctcatacacttctcgatctattgtttgatttccattttaaaaactgtgatttggagtgatctctcagaggtagagcatttccctagcctgtgctcaacttccaacagtgccaacgaccaaacaaaaacaaaaaaagcaaacaaacagaaaaacccaactttagaaaacaggcgatggagcatctctaggtattggcactttggatgggaatttggttatatatcagtcaaaaggaaatcctggcgctaggacagcgcagcagctgagagcactggccgcgcactggccgcggtggcagaggacctgagttctgctcccagcatgcccgttcacaagagctctaaccccagtcccagggatccagtgccctctctcgtcgtccatgggcactgcatgtgtatagtgcacagactgacatgcagacaaacacacatacacataaaataaaaataaatccccttttaaaggcttttattatgtaaagatctgtttactgacccatattttcagcaacattatctcgtgggatttgggcacctgtggggtatttagcgagatacttgaagtcactagccagtgacgcggtgcttgaagacatgagtgattcctgtgttgttttagaacggtgtaaatagttctttagcatattttgcagcagtatactagccctggtgagatcctgatgaccttattgtggtaatctgattgtccccagtgaagaactggtggccgaagcccacgccctctgctcccggctagaaagtgcgctgcaggacactgtgaaggagcaagacagaagcttcacggtaaccgcctgagggagcccggcttgtccgtcccttcctctctgcagcaaaagtgcaaacgcagtttggcatcagccttggctcagcagagactcatggttggccctgcggttttcaggtttttgtatttatttcatgcttaggactgccaggtgcattcattatcttaatcccttatgacacgtaatcctaaggaggtgacagcagtaccaaaagccccttctttctctgtgggaccattgcagaacatctgtatgtgctgggcactgtgctgggctctgtgacaaaagagaaacctgtgtgtgtctcaaggactcagtttagccacaagcagtatcagtgtcagagaaactgacctgaaggaaatctagccacgatccaggcactttcagacagagcttaaacagttgttggtgtctaaatggccttttcctgctaatgcaagcatccactaactactcttgcatctaactttggggagtcagaagaaaccccattcagttgccgtcctcgctaacctgctcactggtgagcctcctaactcctgctgcttctcacttgtctcctggtgctgtttcttccatctcactacttgcttgcactttagccagagaaaagggcagccttctggttggcatggaaacggataactgagatgattcccacctatctgcagtgagtatgtaaatgagagctctatgctacaggccgtactaaaatgaccatccacattccacaggcacagagttccaggaacttcagctagtccaaaggaaatctgctgcacatttgaatctgtaactcacttggctcaagggtgccctgtagtagcaggactgacgctgataaggcttaaacgtacttctagattgtgttgcttgcctcctgaagaggaacgatggccccgccacttgagtatttaatgtgcctgttgactttcagactctagactggagctggttacagatggaggatgaagaaaggtgtagcctggagcaggcctgtgactgaggtgcccatgagctggcccgtggctctgcatgtgacgatgttctggtatctccaggtggacatctcactctgccagcagctgtgatacttgcccgcagcagcctaggctggccctgtccacacactggattctcgcccacagaagcacaacaatgcaggtacaagcacttgcagcagcgacgcttcatggctgctgtacaaagaaagcgacacagagaaatgacaagtgtctatcttgagtgtttccagacagcagacagcctgtctgctttggactcctgggggaggaagctctgccctgcccacccctcctctccttacagctggacgtcatccggatccagctctcttagacagttaatcctaagtttgactatcctatatctctcttcctcttcacttctcccctggtaaatgtttcaaccttctgtgctggtcgctgtggcaaacgacctttgactatgctgtagtgatggcgatgccaaactccctgctgtttctggtcctttaagccacaaagtgacttacaaagccaggcagaacagaaatgcagctacatatcttgagtcccaaagattacctagaatcaattgtcacagagaaaaaaggaagatgaaggtgttatgccaactactaccctactgaacactgcgactcctgggtgcctgtcaggtgtgtgtggatattgctgcctcttaaattagctagcaatattattaaattggttcattttataaatagtttctattttttgtaacattactcagatatgtatcctgggctcaaaggtgtatttccatagtataccatcactagtacttctgagctcaaaactcaacatcatgggaaagtttgtaaaattgaatagtgtgtctatgtctagatcatgagccatttttaacatcacacaaaacttgtgtgtttgtgtgcatgtgtgtgtgtaaaagcaaaaaccggctcaggttatcataggcaggtatatttaattagagaatacgtaacgctggagcagagaaatgtcagagtggccaccgcagaggcagtatgaagcatcgacggtcaaatgagttcagaggtgctgcacgctttgattgttcctgagagattgacactgtgcactggtaaactgtctgaaagctctgacaataaagatgctggcttaagctcagtgtaaattcacccatgagtcatgtcattgaccatagagtcctacccttcatgtgtgctcagtgtttagaaatcctggaaagggcatagtgggaactaagaccagaacggatggggtggggactggagagatggctcagcggttaagagcactgactgctcttccaaaggtcctgagttcaaatcccagcaaccacatggtggctcacaaccatccgtaatgagatctggcgccctcttctggagtgtctgaagacagctacagtgtgctcacatgtaataaacaaacaaacaaacaaataaataaaaaagaaaggatggggtgacaccagactgggctgaaagagctgggctttaacaagctgttgggaggcacgggaaaactttatgcaagaaaaatgacattaacccaaagcagtggtttggaaagtttgtcattagagcactgtaaattatgtcagtgaaattcaagggttacttctgcttccccaaaagatgaatgttctattgccatgattaaacactgtgaccaaaaagcaagttggggaggaaaaggtttatttggcttacacatccacatcacagtttatcttcaaaggaagtcaggataggaactcaagcagggtgggaacctgaaggcagggactgatgcagaggccatggaaactcactggcttgctccccatggctttcttagcctgctttcttatagaacccaggaccaccagcccagggatggcactacccacaatgggctgagccctcccccatcgatcactaattaagaaaatttcctacagctggatcttataaacacatcttctcaagtaaggttctagcttgtgttaagttgacataaagctatccagcacaatgaaatagatacttccccccctactgtaggtaaaatcctgggacattgtgtataaagcaagcagagagaaggcagactgcaggggtctgagcattgatgggggtggtgagttccctaggggcctgttcaaaggcaactagtggactccccacaaaaaataaaataaaaagtcccaaagggggaaaaaaatctctctctaaatgtaacaaatgacatagctaaagcagaaatttaaggaattgaaatctaaatgtcatcgagactgtacttcctgaaaggtttggggagagcctttgctggcctcttcctgtttccgaggctccatataatcttcagcttgtggtaggatctctctcttgggggtcacttatttttctcatagctaaggaatgttccatcagggcaaaggacttgcccctgactgagccagtgggaatgagaggtaggagcagggttacgtttgtcataacgtgacagtcaagaagcagagcagtcgggccagaagcgaggcctggaactttcaaaccccattttttcagccctaagctaggtaccatgtccccaaagttctcctatctcccaaaacagcactaccaaatagctaccatattcaaatatgagctgtgaaggacttcacacccagcccttcgtggtcactcctacagtctcctctttgagatttgcccttgtttgatgtataaaaagattttttttttccgtttgatttaaggccagtctgggaaatctggaataaattaagtccctctccccatctcaagattttaatgcaattatgtattttgccacgtgacatgacatcctcacattctagaatgtgtctgtagacatgttataggcccaccatcaacccagtctaacctctagctccaacaagactcttttatcacatatccaaagtcttaagtgcagcaccaactcctgagaccaaaacctcatctggatgtcagtttaaaagtccatggcctcatcatcttgatcgtgtgtggacaacatttccccatgtccagccaggggacatgaattaagccgttatagcaccagctactcttccaaaagacctgtgtttgattctcagcacccacatggaatctcatgaccatctataacccagttccagaggatcagatgccctcttctggcctctgctggcaccaagcaaaacacactcatacacaaaagataaatgcaagtaactttttttaaaaaagatttcccatctctggacctagaacatggggaaggcatggcctgatggcaggagcaagaggctgggtgatcacattcttcttccatacacaagaaagcataggaggagaagatcaggaaggaagtgggacaagactataaaccttcaaacctgcaccttctaaaggtaccacacacacacacacacacacacacgcaccaccaactggagaccaagcgtttacaaatacatgagtctgtggggaacagtcctcattcaaactacctcatccagttcctagccctcaagacacatgaacagctcatggtgcaaaatgcagtttgaccaacttcaaaatttcccatggtctttacactctaaaattccagtctatgggtctcaaagcagtctcttaaactgtgaccgacccccccccccaaataaaagagcaaattatatacccacagcatagaatggtacagaatatgcatccccattacaaaagggaaaaatagggaagtaatgtgaaaaggttggaccaaaacaggactgaccctagtagggcaaacaccaaatccttgttggctctgtctgtcgtctggggcacgaatctctaaggctgagatggcttggcctctccagctttccttcctggaatagacattactcacttgggttggttctgctccacgtatgttttgctcttcttagcaagcatctcatggctctggaattttaacatctctgagtctccaaaacaacccagacttgtcctttacaactttatgcaatggccctgcagagactctagctgtgctacacattgcccgacctcggtagctttctgaaactacggagaaacaatctgtggtgcactcagtcttacatcttttttgtttccaaaatcactaccacatgcatgatacctccaaatctggatgctagtttaggatgggccctcacctccttcaaccacaatagtagcagtttttgcttttgtttttggtttgttttttttatgtccctgcctcccaagtactgggattaaagttgttaaatcaggcactggcctgatttttgtttcttaatcacagacatgcagtcaaaacagtaagagcctgttcaacacgatttccactcagaagaacaaaattaggtacttatatctgatcttgtacagagaagaattcaagatggatgaagaccttaatttaaaacttgaaacactggaacttctggatgaaaatataggaaatactctctatgacactggggtgggtaaaaaccttctgaacagagttaatgcccaggaactagtctcgggcatcaacagatggggctacatgaagttaaaatgttttgacacgggaagagaaactatcagcaaaagccaacagcctaaataagggagaaaatccttaaaccagctagacttcagacaaggggctagtatgcaggatttacaaagaagtacagaaattgaataccaaggagatcaagctgccaatgaacacgtcttttgaactgaagaaacagtttaaaaaaaaaaaacaaaaccaatacatatctcaagaaatgtccaatatccctagtcatcaggaacatgcacattaaaactactttgatatacccacctcaccccagtcacaacagcaatcatcaaggaatcttatgacaaatgttggcgagaatgtgggaaagaggaacccttattcactgctagtggaggtgcaaactaatgaacaaccattgtggaaatcagttcagagactcgtcaaaaaaaaaatccaaatagtactcacttttgagtgattcagtattcacttctgggcatatacccaaagacttccacaccctacctgcagatatttgcacacccatttttttctttgctgtttcattgactatagcaaggaaataaaacaaacctacatatccatcaacaaataaatagtggacatctggttatatatatacatatatatgtatgtgtgtgtgtgtgtataattcatcaccaaagaaaaaggaaatcacagacttttcaagatacaatatataatattatgtaaggatacacactcaaaaagaaaaaaaagctgcatgttctatttcatgtgtattctagcccacagagcattggtgtatacaaatatacaggtgtattctagcccatagagagttagtgtatacaaatagacacttaggtatagagtaacatttagaaaggagaacaagaaagagtgatacaaagtaatcaggacttaatgcaggaaaaggacggaaggtggagggagagctaatgctaatggagagcgaatgctattcgcttttctagctttaccacagtccacaccgaagtcctctgatctccaacctagtgaacttgttccaaatggtgcagaactttttagtggcagctttgggggtggaccttgctgcttctacagggatcactccagttgtcccccaagccctcttcctcttcattatgtctccgtgcacagggaccttctgagaggtgttttccaactgttctgtctaaatagagctcatctcgcccctcctgagggctgccccatttccttgccttgtttatccgtgcagtgttgtggtggagctgaggccccattcctgctgagcatgtcctctcacagtgaatcactcattcttgacttgctcttaggccactttattaccccctgccaaggacatgcgcacaggacttgacttatcactactgtacatccagtagcgaaagcagtgccctgtccttgctaataaaaataactcactcacctaaaacaacaacaatgcattgctggacctggtgttgcatacctatccctagcatccaggaggctgaggcaggaggatttctatgagtctgaggccagcctgctcttcatagttctaggacaacctgggctacatagataccctatctcagaacaaaacagaaacaagaatagaaattttagaagataagagtggagtagaaatgtaaaagtgtatgtccccaaataataatacctaagttggatgacaagcccgtcattgacttccctttttccttctatactcttttcagattcacccacactagtgtgtatcttaataacaatttatgcccaaacgaattgctgtgtttgcagttaatatggacccccatgaggaacacttataaatggcacaagcgctatatttcaattcaaggacattgtaaggggatcacatatagaatatgagtgttccattgctgtttagttaagtcagacacttctttcttggggtcttttcctagctttagcttctcccacaagaggcatggataccgaaacaaacaaacgaacaaacaaagccagaacacgtctttagccgacggttggcatatttcattccatgttttacatggtgtccagaagcacagagcagctcttggattctgacagcagaacccgcgccggcacgcctcacaaacagtacaggccgtgtgttccatagctactgtccacagcagccaacgtccacctccgtctgcatctcgggctctaaatcagactattctcagaccaggagagcagatttgatctctcaggctaactcaccaggaggtaaacctgacctcctagctcccctccgcccagagattccccgcacccgcacccgctagccccgccccgtagcctggcgcgtgacgtcaccgcgctgcgccctgtcaggcgccgccattgttccaccggtaagacccaggtgtgggtccccggcgccatgagcaaacgcaaggcgccgcaggagaccctcaacggcggcatcacggacatgctcgtgggtgagtcccgggccgccctccggctcctctgctcagccgggcctcgcttctcccacccccccccccgcgggtcgcagcgccccggctgcgtccgtcgcggccgccggtggaggaacccgcccacacctccatcccgggacccgcgttcgcgggggtgtgtgtacttgtgtcctcgagccctttgttgtcttttcagaactcgcaaactttgagaagaacgtgagccaggcgatccacaagtacaatgcgtacaggtacgttgttagccggcgttccaggacatcctagtttgctgtcacttagcagggatggaaagccggtgcccagtggttcaaagctgagtggcactttatttaacctatacagggttttggcagggcgttatagggttaattcaggagactgtacagttccgactgaaaataggtgtctgatgcatatattcccaccattaatcttgacttgactggaaatacagtttaaaaaacataataaacaacagtagacgagatctgaactgtgaaatagatgtagttcaggaaatcgcctttccttctggatgggctgtcaccttcctgaaaaccagttgcctgcctatcactacaaacctcagcgggcaccttctcctggccgctcttcccacagtcagctacttaacctataagcatcccaaagcccctcagcttctaacagtaaaagtaaactatccttgctttccccaagctagcccttacagccttacagttagtgttctcctatagtctgttccatgcctggatttcctcatttgaagtcgaattattattattattattattattattattattatatgattatttgggggattataattacatcatttccccttttcctctctccaaacacttccatatataaccctctatgatctctcaaattcataacctccttttttcattatatatatatatgtgcacatatatatacacacatatttcgatacacatacatacacacacacattttcctaaatacataaatacaatctgttccaactgtgtaatgctacttgtatattttcagggataaccaactgatgtgttaggaaagactgtttcctgtagttctttgtgtagggttgaggtcctgaccactgtggtgtgtctgtcacattcttccttgttcagctcatgtctgggcagtcatgttagtaagaccttatgagcatagcttctgacattactgggcaacacagccttcccgccatttccctgatgctctgactctcacagtcttcccattccctctccacagtgttccctgggccttaggcttaggagttattttatagatgtatccatttaacttggctccataactctgcattttgattggttgtgcttttctatagtggtctctgttgcaaagagcagttttcttgatgagaggtgaaggctacatttgctgtgggtatgtgaaggctacatttgtctgtgggtataaggatgaacgtgtagactgtagctagggattgtactgctttgggaaagtggtggttgtagattcttctctcagacctatgactttgctagccctgggtagttgtctaggttgctggtagcaggtatgatttacttccctcttgatgagtgaatcttaagtccaattaaagagctgttggttaccactgagatatatgtgtccccactgcacccttagagttagcatgccgtgtaggtcattgtgcgtcataggtgtcatagctgtgtaggactgttggtggattcccccctttggaagcttgcgtggtgccttctgataccatgaaagccagtcctcagagaagggagagttcagggcagtgctagctcagaggcctcagaaatgcattatttcttcagcaataggaacttaccttctacttctttggtggcttttagggtaccaccaaaggcgttaccagtagcctgtatgtttgttcaaggtgataaatatggtcctgtttttattccactacttgaggacatccagttttctcagcaccatttggtgaagatgctttctgaaaatacatcctgtgttggatgatgattcaaagcatataccactttctggagagtcaggagcagccaccaggctgctgccacctaactggtgctgtaactgtaacttcagaaggccattccatctttctgtcagaccagctgcatcaggatggcagggaatgttgtaaggccaatggagcccatgaatgtgggcccactgttgcacttctctggctgtgaagtggattgtttggtcaaaaacaatccacagatggtagctttggcagaaacattacgtgctggaaaggcaaatctataaccagaataagaacctacttcagtaaggacaaagtgttgtcctttgcacagaggaagcagcccaatgtagtcaacctacatgaggtcactggcaggtcacactgggaaatggtgccacatctggggctcggtgttggtctctgctgttggcagatttggcactcaggagtagctgtagcaagggcagccttggtgagtctcagtgcctgttgtcttccccagacgtctttctcaccagtttctggtctgctccttccaagtccctgaatatccgtcggtcagttctacacagtaggaaaccatctttctttgtaaagcttgaatgtggatatttggtagtatgtgaatttcagtttaattgctggattttcagttgtttctttttcttcctctgtatgtatgttttatagaaaagcggcatctgtgatagccaagtacccacacaaaatcaagagcggagcggaagctaagaaactggtgagcttaatgagcatgtagtgaaccctgtcttttggagggggtggggagaaagaaagaaactgggtcatgtcatattagtgtgcatgcctgaggtttaaacaggcctggccggatggtgcagtagataaaggcttgctgccaagcctgcttgccgaacctgacttcagtccttggaacttcatgggaaaaggagagaaacgactctggcagtttgtcctctgacttctgagtgcgtgctctggcatgtctgcattcactctcacgaataaataataaagaggaccagtaaacaggaggcttcatcaataaagttagactgagacaagacactatgtaatgcctgtcaaattatgaataatgcatgtgggcagaagtgtttactgcgggaggagtattcgctggcagtctttctgaaggatcatttgacagcatatgtatataccatcccccaccttgtcttttgagacaagatctcattatgtagccttaggtggcctggaactcagagacccctgtctcagcctcagtaggccaggactaaaggtggatccaaggagtgtgtatcttttgacccagtattttcacttcaaagattttgtccttagaagaccagtggagctactaaatgacaagaattggttagtttataactttgagcaagtgtatccctcagaactgggaaatgcagtacaaagaggaggcctttattctttcatgttttacctttgagaagaacactatccagttttgcagccatgagcctcctctagctattgaattcttaaagtgtggttactgtagctgatgaagaagctaagatcttaggtacattgagttaggccttgtgggacgtggtgtctgctcctggttctgtgtaaggtgtcttgtacagtcagtactcgatggaacttagaggtgcaggcgctgccctttctactcacctctgacatagcaaagcaaggactgggggggggggggggctaggattgggttttaatggtgtagttacttttaatttttaaacttttaaaaatttatttatatatttattggtttttcaagacagggtttctctgtgtaaccctggctgtcctagaagtctctctgtagaccaggctggtctcgaacacagagatcagtctaccttgtactgggattaaaggtgtggaccaacactgctcggcgcttttaatttttttaattaaaaagaaatttttgttacatatgtgtgtgtggctgtgtggtttatgtgcaccatgtgcctgtggaggccagaagagcacat

SEQ ID NO: 1754 - DNA, 3210 bp, Mus musculus
agttagcagggcatcgatatgagctggtcaccgtccctcccaacccagacatgtggagcctgggaaatgaaagaacgcctggggaccgggggatttggaaacgtcatccggtggcacaatcaggtagggctctggcaccaggaaggtgggcgacaggtgaacagatcgccatcaagcaatgccgacaggagctcagcccaaagaacagagaccgctggtgcctcgaaatccagatcatgagaaggctgaaccatcccaatgtggtggctgcccgggatgtcccagaggggatgcagaacctggcacccaatgatttgccactgctggccatggagtactgccaaggaggagatctccgaagatacttgaaccagttcgagaactgctgtggcctgcgggaaggagctgtccttaccctgctgagtgacatcgcatcggctcttagataccttcacgaaaacagaatcatccatcgagacctgaagccagaaaacatcgttctgcagcaaggagagaaaagattaatacacaaaattattgatctaggatatgccaaggagctggatcagggcagtctgtgcacgtcatttgtggggactctgcaatacctggcgccagagcttctggagcagcagaagtacaccgtgaccgttgactactggagcttcggcaccctggccttcgagtgcatcactggcttccggcccttcctccctaactggcagcctgtgcagtggcactccaaagtccggcagaagagcgaagtggacatcgttgttagtgaagacttgaatggagcagtgaagttttcaagttcgctacccttccccaataatcttaacagtgtcttggctgaacggctggagaagtggctgcagctgatgcttatgtggcaccctcggcaaaggggcacggatccccagtatggccccaacggctgcttcagagccctggatgacatcttgaacttgaagctggttcatgtcttgaacatggtcacaggcaccgttcacacataccccgtgacggaggatgagagtctgcagagcttaaaaaccagaatccaggaagacacggggatcctggagacagaccaggagctgctgcaagaggcagggctggtgctgctccctgacaagcctgctactcagtgcatctcagacagcaagacaaacgagggcctcacgttggacatggatcttgtttttctctttgacaacagtaaaatcaactatgagactcagatcaccccccgaccccaaccggaaagtgtcagctgtatccttcaggagcccaagcggaacctctccttcttccagctgaggaaagtgtggggccaagtctggcacagcatccagacgctgaaggaagactgtaaccggctgcagcagggacagcgagcagccatgatgagtctcctccggaataacagctgcctctctaagatgaagaacgccatggcctccacggcccagcagctcaaggccaagctggacttcttcaaaaccagcatccagatcgacctggagaagtataaagagcagaccgagtttgggatcacctcagataaattgctgctggcttggcgggagatggagcaggctgtggagcagtgtgggcgggagaatgacgtgaagcatctagtagagcggatgatggcactgcagactgacattgtggacctgcagaggagcccgatgggtcggaagcaggggggcaccctggatgacctagaggaacaagcgagggagctctaccgaagactcagggagaagccaagagaccaaaggacagaaggtgacagccaggagatggtacggctgctgcttcaggcaatccaaagctttgagaagaaagttcgggtgatttatacacagctcagtaagaccgtggtttgtaagcagaaggcactggagttgctgcccaaggtagaagaggtagtgagccttatgaacgaggacgagaggaccgtggtccggcttcaggagaagcggcagaaggaactctggaacctcctgaagatcgcctgtccttccagtgcctgtgacagcttacctgaatcagacaagaaaagtgaagaactggtggccgaagcccacgccctctgctcccggctagaaagtgcgctgcaggacactgtgaaggagcaagacagaagcttcacgaagcacaacaatgcaggtacaagcacttgcagcagcgacgcttcatggctgctgtacaaagaaagcgacacagagaaatgacaagtgtctatcttgagtgtttccagacagcagacagcctgtctgctttggactcctgggggaggaagctctgccctgcccacccctcctctccttacagctggacgtcatccggatccagctctcttagacagttaatcctaagtttgactatcctatatctctcttcctcttcacttctcccctggtaaatgtttcaaccttctgtgctggtcgctgtggcaaacgacctttgactatgctgtagtgatggcgatgccaaactccctgctgtttctggtcctttaagccacaaagtgacttacaaagccaggcagaacagaaatgcagctacatatcttgagtcccaaagattacctagaatcaattgtcacagagaaaaaaggaagatgaaggtgttatgccaactactaccctactgaacactgcgactcctgggtgcctgtcaggtgtgtgtggatattgctgcctcttaaattagctagcaatattattaaattggttcattttataaatagtttctattttttgtaacattactcagatatgtatcctgggctcaaaggtgtatttccatagtataccatcactagtacttctgagctcaaaactcaacatcatgggaaagtttgtaaaattgaatagtgtgtctatgtctagatcatgagccatttttaacatcacacaaaacttgtgtgtttgtgtgcatgtgtgtgtgtaaaagcaaaaaccggctcaggttatcataggcaggtatatttaattagagaatacgtaacgctggagcagagaaatgtcagagtggccaccgcagaggcagtatgaagcatcgacggtcaaatgagttcagaggtgctgcacgctttgattgttcctgagagattgacactgtgcactggtaaactgtctgaaagctctgacaataaagatgctggcttaagctcagtgtaaattcacccatgag

SEQ ID NO: 1755 - protein, 747 aa, Mus musculus
LAGHRYELVTVPPNPDMWSLGNERTPGDRGIWKRHPVAQSGRALAPGRWATGEQIAIKQCRQELSPKNRDRWCLEIQIMRRLNHPNVVAARDVPEGMQNLAPNDLPLLAMEYCQGGDLRRYLNQFENCCGLREGAVLTLLSDIASALRYLHENRIIHRDLKPENIVLQQGEKRLIHKIIDLGYAKELDQGSLCTSFVGTLQYLAPELLEQQKYTVTVDYWSFGTLAFECITGFRPFLPNWQPVQWHSKVRQKSEVDIVVSEDLNGAVKFSSSLPFPNNLNSVLAERLEKWLQLMLMWHPRQRGTDPQYGPNGCFRALDDILNLKLVHVLNMVTGTVHTYPVTEDESLQSLKTRIQEDTGILETDQELLQEAGLVLLPDKPATQCISDSKTNEGLTLDMDLVFLFDNSKINYETQITPRPQPESVSCILQEPKRNLSFFQLRKVWGQVWHSIQTLKEDCNRLQQGQRAAMMSLLRNNSCLSKMKNAMASTAQQLKAKLDFFKTSIQIDLEKYKEQTEFGITSDKLLLAWREMEQAVEQCGRENDVKHLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDERTVVRLQEKRQKELWNLLKIACPSSACDSLPESDKKSEELVAEAHALCSRLESALQDTVKEQDRSFTKHNNAGTSTCSSDASWLLYKESDTEK

SEQ ID NO: 1756 - DNA, 81099 bp, Homo sapiens
  misc_feature (1)...(81099): n = A,T,C or G
ccttccaagaaatatatttcttttgaggaatgcaagcccctttaaattatgagacccagaaaggcatttaaaatgtaacaccagtcatgtccctctcccccttgagtgaaataattacctctagcagccactcactatgggggctctagattaactgtcaccaagtagccataaaatgccatacaccctgtagttcaagaatgcacagccaatcaccaatgttattcataaaaataaccgaggttatttctgtaaaccaatgtgaattcctgacaaacaacttttgtaattctccttctcctgattttttattttttcctttcaaaacttgagcctctcttttgttgtctggagcagtccccaaggcaacttggaagtgtgtcccgggctgcagtcctcaactttgtgctgatgacctctctttgaactagattctgaccgttttgatgattgtaggttgacagacactggtcacagatgggatgcagcccacacttctctttctgtctggttatattcctgggtgtccctgacctggtggttggctggccgtattctggggtgtccccgacctggcagttggttgcctgcacaggcagcctggataatctgggcgcctcagcaggcggatagtcatgctacatttttaggacacaaaaggagacaaacaggaaagcaatagctgtccctgggagtgaaaggatcaataaccaatggttaccccaaaccacatttcaccagagtcactgtccaaaaaaattaattcttacaaatgatttctcctgctaatgtgaatttgaaatagaaggtgggaggggggagggatagcattgggagatatatctaatgctagatgacaagttagtgggtgcagcgcaccagcatggcacatgtatacgtatgtaactaacctgcacaatgtgcacatgtaccctaaaacttaaagtataataataaaaaaaaaataaataaaagatgaccactttatttaaaaaaaaaaagaaaagaaaagaaatagaaggcacaaaagagaaacttgtaccttcctcccctgactgacatcacacagatccaggagagctaactaccacattcttttatttatttatttatttatttatttatttaagacagagtctcactctgtggcccaggctggagtacaacggcgcaatcttggctcactgcaagctccgcctcctgggttcacgccattctcctgcctcagcctcctgagtagctgggactacaggcacccgccaccacaccaggctaattttttttatttttagtagggatggggtttcaccgtgttagccaggatggtctcgatctcctgacctcgtgatccgcccgcctcggcctcccaaagtgctgggattacaggcatgagccaccatgcctggcctatttttttatttttttgagacagggtctcatgctcattgcccaggctggagtgcagtggcgtaatcacggctcactgcatcctcaattttctgggctctagtgatcctcctgcctcagcctcctgagtagctgggactacaggcgaacaccaccatgcctggctaaattttttgtatttttagtagagacagggtcttgctgtgttggccaggctgatctcaaactcctgggctcaagtgatccaccagccttggcctcccaaagtgctgagattacaggcatgagccactacgccctgctaattttttgtatttttagtagagacagggtcttgtcatcttgcccagggtggtctcaaactcctgggctcaagtgatgcacctaccttgtcctcccaaagtgctgggattacaggtgtgagtcactatgcctggctaattttttgtatttttagtagagacagggtcttgccatcttgcccaggctggtcccaaactcctgggctaaagtgatccacctgccttggcctcccaaagtgctgggattacaggtgtgagccaccacacccggccgacaccacattcttacctgttgccagattctgtcacttttccagggatcccaattgtagagcaggcagggtgtcccagagatcccatctgggtcaccgaaactgtaggggcagaataataattttctccatatcctttctgtgtttccggctgggacttcctataacaaaatggcagattaagaagagaaagacaaaaggaagtttaacaacatgtatatttcaggtatacataggagatacccagagaaatgagtaaaatctagaggggtggcttagaattcgggcttaaataccatctccagttgaaacaaaacaagaacggtgttggggtggacagttatggggtggtgtccagaaaaagcttggtaagtaaagctaaggtttgtagtgcagatttatgttggtgtcttctctaatgattagagtttctggtgcattagagccacacttcttttcctggtatagggacaaagaaacccttacaaatggagacgcgtttttttgtttgttttttgagatggagtttcattcctgttgcccaggccggagtgcaatggcacgattttggctcactgcaacctctgcctcctgggttcaagcaattctcctgcctcagcctcctgaggagcttggattacaggcgcccaccactatgcctggataatttttgtatttttagtagagatggggtttcaccatgttggccaggctggtttcgaactcctgacctcaggtgatccacctgccttggtctcccaaagcgctgggattacaggtgtgagccactacgcccagctgggcttttttttttggtatttaagtatacatagataattatattttattttaaaattaattttattttttataattaattataaaattatatttttaaaaattaattagagacaaggtcttgctggtctcgaactcctgatttcaagtgaccctcctacctcagcctccccagtagctgggactacaggcacgacaccacacccagctaatattttgatttttttgtagagatggggtctccctatattgcccaggctggtctcaaactcctgggctcaagcaatcctcctgcctgggcttcccaatgtcctgggattataggcatgacccactacgcctggcaagagatgttttttgttgttgctgaggctaacagaaaacagcagagagatggtttttatagatgtaaatttcccttacaaaagggtagcttttaaaatattatttaatttaacttaatttaactttttgagtttcactctgtctcccaggctggagtgcagtagcacgatctcagctcattgcagcctccgcctccctagttcaagcaactctcctgtctcagcctcccaagtagctgggattacaggtgcccaccatcatgcccagctaatttttgtatttttagtagagacagggcttcaccatgttggtcaggctggtcttgaactcctggcctcaggtgatccacctgtctcagcctcccaaagtgctgggattacaggtgtgagccaccatgccgggccttaaacattttttttttttttgagatggagttttactcttgtcacccaggctggagtgcaatggcgccatctctgtttactgcaacctctgcctcctgggttaaagtgattctcccgcctcagtctcccgagtaactgggattacaggtgcttgccaccacgcccagctaatttttgtacttttagtagagatggggtttcaccatgttggtcaggctggtctcaaacccctgacctcaggtgatccaccccactcggcctcccaaagtgttgggattacaggcgtgagccatcgtgcccagcccattttattttctaagtaaagataggttcttgttatgtttcccacgctgattgtgaactcctagactcaagtgatcctcttgcttcagcctctgggatagatgggactacaggtgcacaccaccacacccgggcaaaagggtcatttttattctgctttcggagttgcttcttcggttgctgtttctcagaataatctgtatgccaaagaggcctattttgggtggcatattctggtctcctactgtgatctggcctcccagatagtcaccagcagactcctgcagaaaggaaaagttgggacaggcaggtaggagggccaggcaccactgacaaggggaagtgcagagagaggcctgagcccaggaaggactagagtccggcagctgagctgcaacacagcccatgggtcaaaagtaggagctcagaaccaaggtaagccgaaaagcatacctgttggtttcttagacgtctacaccggcccatagcctttgtctccgccaccatggcctgaggtggcagctgccctttcatgacttcttcctctttagtttgaatttactggaataaaaacgtgtgtgtaaaagtaaagggagcttaaaaagtgatttcctcctctaagctcttgttcctccagagagggtgactcagagccccaaatccttgcctttgcttgtttctgcctaagtttgaggcacaacagccggctggccctgctcctctcagtttcttgattggcccaggtccagtcacagagacagcagctggccaatttcctttccttcctcttctgcagccagctctgcatggagcccaaagggtctgcggcaaggttcattctcaccctcgtctccaccagcccaccctcatctcccaccaaggtccccagaacaaaggcagacttcttcacatcctccgactttctaaactagtttctccaacttttctggcagaggagtttttgtctgttgaagaagcaagtcctgacctgcagagtcctttctctgcagggctgggataaaacaaaatcagatgggtcatgaaagagttgctgaaatcgctgaaccagagctgactatgggggctggggtgctggggaaatcctccccatcctctgtggtctgccttacggcctcttatctttcaagctgtcttctccttctatgattcagctccaggttgtacagaaaacaattctttctttacttggaggagctcagtgctgctttgcttcactgccatcaggtgagagagcagaatttaatcagtggatgacataaaagactgagtaagaagacagttatctttgacttactctgtgaacaagatttcattttaaatttaacagtgctcagaaaccttatccttatcactagtactgccagaagcatttgaaccagagcaactccatcttgaataggagctgggtaaaatgaggctgagacctactgggctgcattcccagatggttaaggcattctaagtcacagaacgagacaggaggtctgcacaagatataggtcataaagaccctgcagataaaacaggtttcggtaaagaagccggctctaacccaccaaaaccaagatggccacgagagtgacatctggtcgtcctcactgttatactcccaccagcaccatgacagtttacaaatgccatggcaacatcaggaagttaccctatttggtctaaaaaagggaggcatgaataacccaccccttgtttagcataaataaataaacataaaaatgggcaaccagtagccctcgggggctgctctgtctaaggagtagccgttctgttattcctttaccttctttttttgtttgttttttttttgttttttttttttttgaggtggagtctcgctctgtcgcccaggttggagtacactggcgcgatcttggctcactgcaagatccatccacctcctgggttcacaccattctcctgcctcagcctcctgagtagctgggactacaggcgcccgccaccatgcctggctaattttttgtatttttagtagagacggggtttcaccgtgttagccaggatggtctccatctcctgacctcgtgatccacctgcctcccaaagtgctgggattacaggagtgagccaccatgcctggcccctactttcttaataaacttgctttcactttactgactcgccctgaattctttcttgcgcgagatccaagaaccctctcttggggtctggatcgggacccctttcctataacggtactgtactgtggtactaattactgcagaacaaatccgtgtgtgattttatattgcctggcctttgtctgtccttacttcatggctccctgtgggtcttaaaaacccagtaagattctaagtgcctctgatgagatctcattccattgcttggatcccctgggtcagtaatgccctgggctgagctaggcactctggctggtcagtatttcttgatttccctatagcacagctaaaaagcacactcagcctcaaagcaggaagaaaaggggacatttttctgctgaatctgaaaatatcttttgtaaacagtctgctcatatctccagagcaggacagaaaccagatgcaggcagagatagctaaacatgtcttatctggatagaaaattgagcttaagataataaatatcttggaatatgataaaacccagaggccccttcctggtccatgattaattgaagaaaaaaaaagcctagtaatacgtgaccttatcagagagatttatgttcagttgaaagccaagttattttgagctgagcaaaatgaggattcaaattacaggagcgcagagtaaacttttggcatattagcggacatcttggtaagtttctcaggacagtgtttttcagagatgacaggattaaagagaaaccttttatgacattgtactggaaatggactctccacagtgcccagcacatataggtgctcaataatttttttttttttttttttttttagatggagttttgctcttgtcgcccaggctggagtgcaatggcacgatctcggctcactgcaacctctgcctcctgggttcaagcgattctcctgcctcagcctcccgagtagcttggattacaggcacgtgccaccacgcccagctaatttttttgtatttttagtagagatggcgtttcaccatattggccaggatggtcttgatctcctgacctcgtgatctgcccgccttggcctcccaaagtgctggcattacaggtgtaagccactgtgcctggcctaatttttgtatttttagtagagacggggtttcactatgttggccaggctagtcttgaactcctgacctcaagtgatctgcctgcctcggccttccaaagtgctgagattacaggggtgagccaccacacccggccaaatttttttttttgagatggagtctcgctctgtcgcccacgttgtagtgcactggtgcgatctccactcactgcaacctccagctcctgggttcaagtgattctcctgcctcagcctcccaagtagctgggattataggcacctgccaccacgcccagctaatttttgtatttttcgtagagacgtggtttcaccatgttggccaggctggtctcaaattcctgacctcaagtgatctgcctaccttggcctcccaaagtgctgggattacaggcatgagccacctcacctggccaataaatattttatttaaaaaatttacttattaagcaaacacttatattgcacttagaacaatgcagtcactattctacgtgtgttacaactatttactcatgttcctgttgcttctggccttgaggctgagcttgccatttagctgggagtaatcaagaaataccaggccagaagcggtggctcacacctgtaatcccagcacttagggaggccaaggcgggaggattgctttgaggccaggagttcaagccaagtctgagcaacatagtgagacccccatgtcaacaaaataaaatttaaaaattagctggtcatggtggcacgtgcctgtaatctcagctagtggggaggctgaggcgggaggaccccttgaacccaggaggtcaagactgcagtgagccgtgatcctgccactatactccaaagtgggcgatagagaaaggccctgtcaagaaagaaaaaagaaagaaaaggaaagaaaaggaaaggaaaggaagaaaggaaaggaaaggaagaaagaaaggaaagaaaaaaaagaaagctagcagctgggaagggaaggggaggggaagcgaggggaggggaggggaggggaggggaaggggggaggggaggggaggaaaaggaaaggaaagaaggaaagaaggaaggaaggaggagagataggaaggaaggaaaagaaggaaaagaaagaaaccaagtacccgggaagggaagggaaggggaggggagtgaaggggaggggaggagaggggagggggaaggaaggaaggaaaagagagagagagagaaagaaaaagagaaaggagagggaagaggggagaggggagaaaccgagcagccagcgtgcctagcacagccctggacaccattgacccctatgtttgggttgagatctgtccctgagttaacttcaaccccagggctgtcaggcactgctgctatcaatacctcatttgtccctcacaacaactctggggtggcctcctttctatgactttctatgagcccgcctgtccccctgctattacaatgaagcagatgaaactgctgatctttgttactgatgttttggctgttttcaatttccaaaaaatgacaattaaatgcaattcaacctaatattgcctaaattttaaaagaggaaataggttctcacagtgtttaagtaaccagcccccgtgcctcagaggtagtcaacagcagtatctggattcaaaatccagtttgcctccttctgaacttcttaacatgctacttttagccacggattaagaacccgggaaccagttgctagggtttgagtatcagctcatctacgtagcagccatgtaccttggaaataataataatgcagaccaggtgcagtggctcacagcctgtaatctcaacactttgggaagcccaggcgggtggatcccttgagcccaggagttggagaccagcctgggcaacacagtgagtgagaccccgccaccaggtatggcggccgcgcacctgtagtcaggagaatcacttgagcccaggagttggaggttgcactgagctgtgatcacaccactgcactccagcctgggtgacagagcgagataataataataatgatgatgatgatgcagtattttccaatttacagggttgccctgaggattgaataaggaaatctaagtacagagatttagaacagagccctgcactgtgtaagcactctatagatgtgagctattattatcatcttcaggttcctttggtagtttttttctgcttgaataaaatatagcaacacacacacacacctcctttgtccactaatgtaatcccataaaacggagaaactcagcagtgaggacattctgattccaagcaggaaggagatgaacgatgaacctcaggctgagcgcctcacggtttcctcatgtcaccggggctgggggtgcagtttggcttcacactgctaggtcttttcttgtttttaagggggcaggggctgtcacctctgaggagtcagctgtgattgatccttctccacacccagccaagcaccccccagacaggggagcgcccgcagtagggcggtaggcaagggcagttctagccaacagtccctaaatcatcccagcgggggcgcgggaaattccaccgaggtgaaagcctagggggccgggtgaagaaatccccatacccgggcccagaaaccgctccaggtggaagtaacttgtctaaagagaacagggtgtaacgggggtcatttcagggctgttcttttaaatcggtgagcacggtctgtctactttccctcagttgtctagagaccacacgccacccccgccccgggggagtcgcccggtcgagggtcccgggacaggcgcagcactcgcagcatccggacctggtctgcctcgcgccgggagcggcctctttaagagcggccgcggccaacgtgctccgtgacgtcagagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacaggtgagtccccctcgtgggtgcggcccgggtgccacctgcaggccccgccgccccgctgcctgcaaggcccggaagacccctctgtgccgctgggaagtcgcagcttgcggactggggagcgtttcacttgtgcgggttggagttcgggaagccgggagaaacagctctccctggggtggcttcttgggggtgggtggctttgaggggaacctgcgatttatgggaacattgtaaagaaacacgtgacctcggcgatgctcagaagtaggttctgcccctgccacctcgggcagaaggcgggcaggcccgggcgcccctggtggagtcagctggggatcccctcgctagggcaagggcgtgggcatcgcctccctcggtgactttcttccttgcctgatgccacagcaaccggatgggggagggtgagagggacaaaagtttgccacaaagtttggaccaaccaaacacattggtttctttacaaaataaaaaaccagttgtatttttcttctctcccattcaagagcagtggtatctcttgccttctccatccctttgagctccatttttttcttaatcctaaccttttttccccatcccaaattgcttatagagttagcacgacatcagtatgagctggtcaccttccctgacaacgcagacatgtggggcctgggaaatgaaagagcgccttgggacagggggatttggaaatgtcatccgatggcacaatcaggtaggccctctgtgcagcttggggaggggcggggagccaggccccctcctcactgcctccactttctctgatcctgctgggccaagggctcacctttggctttggtcatcttgggacagtgaatagggggactgggaagagggcttcaggacttctgagctgactccaggttagtggtctccatgctttattgactatgtcacctaaataaatagtaaaataaagttaagctcttagtctctattatatatatatggtaacagtagaatatcatgtactaatatatactgatattatatgttataaaacatatagaaataggaaaatttaaaggatgagactaaataaataatttaaaatattttaattccttgaggccagtagttcaagagcagcctgggcaacatagcaagacctcgtctctacaaaaaaggtttaaaaattaggcagccagctgggcgtggtggcttatacctgtaatctcagcactttgggaggctgaggcaggcggatcacgcagtcaggagatggagaccatcctggctaacactgtgaaaccccatctctactaaaaatacaaagaattagccaggcttggtggcacgtgcctgtagtccccagctacttgggaggctgaggcaggagaatcgcttgaacccatgaggcggaggttgcagtgagccaagattgcgctactgcactccagcctgggtaacagagtgagactccgtctcaaaaaaaaaaaaaaaaaaaaaaccttaggcagccttggtgcgtacctgtagtcccactacattggaggctgatgtgggaggattgcttgtccaggagtttgaggctgtagtgagctatgattgtgccactgcactctagcctaggtgacagagtgagaccttgtttcaaaaccattttttaaaaattattttaaatgtcgggtgcagtggcttacacctgtaatcccagcactttgggaggccgaggcaggaggatcacttgaggtcaggagtttgagaccagcctggccaacatggtgaaacctcatctctactaaaaatacaaaattagctggtgtggtggtgcatgcctgtaacttcagctactcaggaggctgaggcaggagaatcgcttgaacccaggaggcagaggttgcagtgagccgagatagtgtcactgcattccagcctgggtgacagaatgagaccctgtctcaaaaaatatatatatatatatatatttaaaatatttgctaattatgatgtcttcccagtattgcttgcgatactgcacggcaaaaaataagcagatccacatgaaagtgagaattcatttagaatgatgatgaaaatccatatttcaaataattaacatttttttaaattttgtagagatggggtcttgctatgttgcccaggcttgtctcaaactctcatcctcaagcagtcttcccgtctttgcctcccaaaatgtttggattacaggcctgagccatgggacctggcctcagctgaggttttttttttattttttgtagtgatggtggtctcacaatgttgtccaggctcgtctagaactcttggcctcaagtgatcttcctgccttggcctctcaaagtgctgggattacagccatgagtcattgaacctggcctgtttttatttttaattgacacataataattgtacatatttatggggtacagtgtgatattttgatacataatgtgtaatgatcaaatcggggtaattggcgtgttcatcacttgaaacacgtatcctttttgttggaaacagtcaaaattctttcttctggctattttgaaatatacaatatttttttttttccggagacagagtctcgcactgttgcccaggctggagtgcagtggtgtgatcttggctcactgcaacctccgcctcttgagttcaagtgattctcctgcctcagcctcctgagtacctggaattacaggtgtgcaccaccatgccagctaatttttgtatttttagtagaaatggggtttcaccatgtaggccatgccggtctcaaactcctgacctcaggtgatctgcccacctcagccacccaaagtgcttggattacaagcgtgagccactacgtccggcctgaaatatacaataaagttttattcactgtagtcaccctgttgttctttagaatactgtaacttattccacctaaccgtaattttgtacccattaaccagtctctccctatttccctccacaactccccccacccccaccaccctttcctgcctctggtgaccactattctactttctacttctgcgagattagtttgttgttgttgttgttgttgttttgagacggagttttgctcttgtcgcccaggctggagtgcagtggcgcgatcttggctcactgcaacctctgcctcccaggttcaagtgattctcctgccccagcctcccgagttgctgagattacaggtgcctgccaccacacctggctaatttttgtatttttaatagagacggggtttcaccatgttggccaggctggtctcgaactcctgaacttaggtgatccccgccggcgcgcccccccccccccccgccatcccagcctcccaaagtgctgggattacaggtgggaactaccgagcctggacgagatcagtttttttttgtttgtttgttttgttttttgagatggattcttgctctgttgcccaagctggagtgcagtggcacaatcttggctcgctgcaactggtgtctcccaggttcaagcgattctccagcctcagcctcccaagtagctgggattatagccgtgcaccaccacgcctggctaatttttgtatttttagtagagacagggttttaccatgttggccagtctggtctcaaactcctgacttcaggcgatctgcctgcctcggcctcccaaagtactgggattacaggcatgagccactgtgcctggcatttttttttttttaatttttaatttctttggagatagggtctcaatctgtcatccaggctgagtgcagtggtgccatcatggctcactgtagccttgacctcctgggctcaaatgatccttctgcctcggcctcctgagtagctgggactacaggtgtgcgttgccatgcccggctaatttttgattttttgtagataggaggtctgtctgttgcccaggctggtctcgaattcctggacacaagtgatcctcccacctcagcctctcaaagtgctgggattacaggtgtcagccaacagactttacccaactgagatcagttttttattagctcccacggatgagtgagaacatgtggtatttatctccctgggcctggcttaattcccttaatgtaatgccctccaagctcatccatgttgccacagatggcaggatttcattcttttttatggctgaataagagtacattgtgtctgtgtaccacattttctttgttcatttgttcattgatggacatttaggttgattacatattttggctattgtgaatagtgctgcagtaaacgtgagggtgcccatatctctttgataaactgatttcctttcctttggatagatacccagtagtgggattgctggatcatatggtagttctatttatagtttttcttttttttttgagacggagtcttgctctgtcaaccaggctggagtgcagtggcatgatctcagctcactgcaacctccgcctcccgggatcaagcagttctcctgcttcagcctccaagtagctgggattacaggtacatgccaccatacccggctaatttttatgttttcagcagagacggggttttaccatgttggtcaggatggtctcgaattcctgacctcaggtgatccgcctgcctcagcctcccaacctgctgaaattacaggtgtgagccactgcgctagccttgtttgtagtttctcaaggaacctccatactattttccataatggctgtgctaatttacattcccaccaatagtgtatagagttccgctttctccacatccttgccttcatttgttactttttgtctttctgataatagccattttaactgtggtgagatgatatctcattgtggttttgatttgcatttgtctgatgattagtgatattgaacattttatcatatacttgttggccatctgtatgtctgagaaattcctgttcaaatcatttgcccatttgaaaaattggattatttatttttttgctgttgaattgtttgagttccttgcatattcttgatattaatcccttgttggatggatagtttgcaaataatttctcccattccataagttgtctccataggttccataggtttattctgttttttcttttgctgtgcagaagctttttagtttgatgtaatctcatttgtctacttttgcctctgttaactgtacttttgaggtcttatccataaaatcttttcccagaccaatgccctgaagcacttcccgtatgttttcttgtttttttttttttgagacagtctcactctcagctgagacaggtgcgatctcgggtcactgcagcctctatctcctgggttcaagcgattctcctgcctcagcctcctgagtagctgggattacaggcagcgccatcacacccggctaattttttttttttttttttttttttgagacggggtctcgctctgtcgcccaggctggagtgcagtggtgtgatctcgggtcactgcaagctccgcctcccgggttcatgccattctcctgcctcagcctcccaagtagctgggactgctggcgcctgccaccacccccgactaattttttttttgtatttttagtagagatggggtttcactgtgttagccaggacggtctcaatctcctgaccttgtgatccgcctgctcggcctcccaaagtgctgggattacaggcgtgagccaccgcacccggccacgtgtggctaattttttttttttttttttttgcaacggagtcacgctctgttgcccaggctggagtgcagtggcttgatctcggctcactgcaacctctgcctcctgtgttcaagcgattctcctgtctcagcttcccaagtagctgggattacaggcacctgccaccatgcctggctagtttttatatttttagtagacacggggtttcaccatgctggccaggctgttctcaagctcttgacctcaagtgatctgcccaccttggcctcccaaagtgttgggattacaggcatgagtcactaacaggcgcctggcctgttatttatttttaaaaagccaaaagccagcttcctcctcctgccggctgaaccccacacagtctgtctgcacctgcctctccatcattcctccccttggctgcctctgttttgagcgctgagccctcttgccggacaggcctccccctcctccacattcctccaggaccaactctaggccatctcctcctcatatgcgtctgggatggctttgttctgtggcaactggttctcccggtgagttcctctgggctggttcctgtgccgcccttcctgtctgcgtgtggagtaagtcttgtcaggaccctgcattcctggtcagccagggctgggtctggcctttggagttccttcagttctcctgtagcaagtgcctgacgttgtatatgtgctaggtgccccaaatcatccactctgccagtccacaaatatttatcgaatgtctattatgtgtacattggtaattaaagcagacctttggagaagggaaggagccattagtcaactaattataaatgtaagctcctaagtatggtaaagtgtgagttgggagaaggacccagtgcactgagaccttccgttggggtgggatcagtcagtgtcagaggaggttccccaaggaagtgacacttgaactgaggccctagtagaagtcagcttgacagagaaggtgggaggagagttccaggccaagggagaggctcctgaggggcctctgtggagggcaggtgtggcaagtgggcaagactgaaggccagcgtggccggaagggaggatggggcacaagtgcctgggtggctgagggtggacggtgcaagtcagatcctgtggtgttttttgggcagtttcagccgaggaggttttgttttgatggaggagcagtggaacgatgttagagggaggcgctgtgcccatggggacagattgggagggcccaagcagtgggcagcgtgctgggaaaaaatcagctctcggaagaaatgccttgatccatagtgtgcagcagttctcatggagtagctactcccaccagggctgacttcaagccaccagtagtttaatagcccgctccggcctgattcctgagtagttaacaaccagctctcagtgactgctactacagtgtcactggctccgtcccagtgatgcaggcagaccaggtctgaatgttttggagtcgtctaggtgagagatggggagaggtgggcagacttaagagatatttaggcctggtgcagtggctcatgcctgtaatcccagcactttgggagcagaggcaggtggatcacctgaggttgggagttcgagaccagcctgaccaacgtggagaaaccccgtctctactaaaaatacaaaattagccaggcatggtggcgcatgcctgtaataccaactactcaggaggctgaggcaggagaattacttgaacccaggaggtggaggttgcagtgagtcgagatcgtgctactgcactccagcctgggcaacaagagcgaaactctgtctgagaaaaaaaaaaagagagagagagatttaaggggtggaattaacagcgcttagtggtggagtagaggtggaggggagcaggaggagtggagtgcctgcaggtcctcaatgatgcctacccgtgagcccggcccaggccaggaagctctctaccttccttccccgtgggttctccccaagtttgggaaatctctagggctgctttgggtgctgaggagaagtctttgatcattgtccaagttcagaagatgagcgtgtatgttctctgttgggaacccctctgttcacagcctcttaaaagaagcagctgggctatggtggtgttggttccttgactctgatggttttactccacgtaacaacagtgtgcactttcctgacactccatgcactgcatcttgtctgcagaagaaggaatgttgtagttatcacaatagaagttacatgaaaaagcccctaagcatgggtatcctcagtcagagaagtggcctgataatcagaggcatcatttactgagaacctgctatgcgccagcatcaaactaggtatttacgtgctttctctccagccctcacaactctgaaaggaagtactgttgtctttgttcccattttatagttgaggagactgaagcacagtctctgtgactcacccacagacctgagctcgcaagcaaagaggctaggattggaacctgcgtctgttcggaacccaacctcatgctttttccattgtgcctgtggcttctctgtggtgaggactcagggggaggccttggtgttccttaggctctcattgttcaccacagtctaaacctttttgaagcaggaaggggaaaacacttctttattgattttttgttgtttgttttttgagacagggtctccctctgtcacccagactggagtgcagtggctcgatcagggctcactgtagccttgaactcccaggctcaaggagtcctcccacttcagcctcctgagtagctgggactacaggcgtgagacaccacgcctggctaatttttttatttttgtagagatgaggtctttctatgttgcccaggctggtctggaactcctgggctcaagcagtcctcctgccttggcctcccaaagtgctgggatttcaggcatgagccactgtgcttggttgaaaaacacttctttggaggacaaaacacttataagtcttccttgttagacagagaaccccacattgagtgtttcccagggagggagggcagtgaacaagcgagccccaccacaacctgcttcccctgttcttgtggttctcctgccacgcgggcctcaccattccacattgtgtcgggactccctaagacctccagcccaggggtcagcacaaaccacttcccagtaccgtttagataggctgatattttcaatgagacctttgttaaatacaaaggaagaggaggaggagataaccgagtgctcccacctggcagcatgttttgggagtgggggcgggaaacacgatactcagtcacacagacctgggttcagatcctggctctgtcagcgtcttggctgtgggtccccactttttgcatggattatggggattctccaatactgatctcctcagtgctgggtccccaacatggctgggcaggatgtgggtcagctaccttctggaagccacccagggtaccttgtgatatcatcatgttctgtgtacacttggctgtgaggagggccaggaagcgctgcctggggccctgcgggatgctcgttggggtggaggaggcagtgtgtgtactggctgttagaaggcagagtattaacgatcccttctatgaagcagcacggacctgtacttgtccctttatgggacaaggcaaagctttccacagcttatctgtgtgcttggaagccttaaagcctctgctccgttcagtcacttctctagggatttatagagcctgggcccgagctctgtcagggataccaggaaaaaagggtccctgcccttcgtgtgcttactctctgatcacagtgatccagggagcattcagaaatgcattaagtgagtctaaatccaagcaccgaactgcatggataacagtggctgccatttttccagggcatcatgtggcatctgagctgggttccctgtccgcatgatctctcccgaacgctggggaagggaggcttcttggggtgaatggagctttagcaggatctggaaaggaggtacactttcgagggcctggcaagaagacagaagccgactcaggtgggcagagcagcatctccacagggccagaaaaggaagtgaggctgcggtcgtttattcccggctccctgtggtcggatgctgtgtttcattttagctgacatccctggagtggatggagccatccccatcttatggatgaggacccagatgcttgtaccatgggcttctatcgcacctttaccaggcggtgggggagggagttacacctggacctgcttgtctcctgagcccgagtgcctggcttctgtgggtgaggcggcaggccactgtgccccttgggggtctgcactgtagggagtagggtgaagaagtcatggccctcttagcgtagaccaggcgatgctggggcccagggtctgtccagttacctgctgagccaggggtgaaactgcagctggatcccggacctttttggctcccagccctgggtcctcctgcccagtctctctggtcccagccctgcacctcctttctgaagcattcatttcagggggtggggtctgagaaggaggaggaggtttttactaattgcccccatgtccacagtggcctggttggatgcttgccatgataacgggacactgggctttctgcgctaagggtctaaacatggctcttggcctctgtgagtttcccctgagtcgctggaagaggcaaacttgaggaagctgggccccttttgtttctcctgtgactgggtcttcagctcgcatctgccaggcaccttttggtctgaggatgtgctccccctctgccttttttacaccttatgacacacatgcttatatataagttttatgtttacatgcatcaaaggcaaggaattgcaaactctgaggaccttcataatcactacattcaatctggacatacaggggaccctttctccgttttctcaaaatacagaccagttttttgttgttttgtgtgtgtttattttttgagacagggtctcactccagtagtccacgctggagtgcagcagcatgatcacagctcaacgcaggtctcgctctattgcccagccttgacttccgagggtcaggagattctcccacctcagcctcccaagtagctgggactacaggcatctactactatgcctggctagtttttaaaaatatttttagtagagacagagtcttgccatattgcccaggctggtctcaaacccccgggctctagcgatctacctgccttggtctcccaaagtgctgggattataggtgtgagccaccatgcccagccacaaagcagttttaagttttgtccttcacgaggagttcatataccagaagttgggtactgagatggcgcaggcctagtctgggtttccacagaactaagctaagactcagtagattccaggaaaaataaagtaagccatccttcttaccttacatgtgtttgagttccactgctagtgaagaacaaactccctggggtttcagaaccggtgatcgtagcctgcttctgttttaattgaattttgctttctagagcaggtatgtttttagtaacaaagtcattctgtttgcatttctgtttcaaatgaaacattactcatggaaaaactgggaatatttcggaatacttcctagaggcagatgaaggccactgtgttaggaaaagtttaagtatgtctgtatctacgcagaccttcctaggcccagggagttaggatttcgcctcaactctagggcgaagctgagctgtctgtgagtagaaagttagttttggtatctatgcccagttatttcaagacttgttcagtgttcacattgctgagttcagtctttttagtttgcatttggatatttaagaccaatatcaagtcttcagtatcagaatctcctcctgattctgggttgggccaagtgacagctgtgtatcaggtccagtgtttgtgttgggcaaaagactgcaattatccaatttgtagctagacagattacctaaaatcacttaataaactaagtcatctaatctattttttggatctgatgatctgtcctgtttcatttatgataggtagaataatcccccccaaccccaccaagaaatctggatcctaatccctgaacctatgactgggtggggcagcatggcaaagggaaattaaggttgcagatgaaattaagttttctaatcagctgaccttagagattggcctggcttccctgggggtcccagtgtaatcccaagggttcttaaacgtgggagaaggaggcagcagagccagggtcagccgatgcatgtgaggaagatggcgggacatggctgacacacggatgggctaaggggctacgagctgaagaaagtggcgcttctagaagatgcagaaggaaaagtagggaaacagactctcccctagagcctctggatggagcatagccccaccaacatcttagctcagggagacccacatcaggcttcagcagatagaactgcaaggaaataaagtgtgttattttaagccaccaagtttgtggtaatttattacggcagcaatagaaaacaagtgccctcttctgtgtattgaagttacgttgctgcagatttttcagtatcttggtttagtctcagtcattctaaggtaacgaaccataagttacagtctctttggctaaaccattgcttggaatagtgtccatggaaatgttgcagggtggatggaggtggatagatgctcttggcaatggcacctcacgctgcagcggggccatcggtctctgtttgtggaaccctgcgttccccacgtctgagctcctctgcaaactccgcctaactggaggcaagtgtctgtagcagtgtctcagtcggctcagtgctgctatcacagagtagctgagaatgggtaatttataatgattttatttctcatagtcctagaggctatgaagtccaaggtcaaggcatcatcatagggtgaaggcgaaagggcaagagacaaaagggaccaaacttgtccttttataaccatcagtcccacctgggatgcagagccattgtggccgaattgccccttaatactgaggtgatgtcctggcgcagtggctcacacctgtaatcccagcactttgggaggccgagacgggtggatcacgaggtcaggagatggagaccatcgtggctaacatggtgaaaccccatctctactaaaaatacaaaaaattagccgggcgtggtgatgggtgcctgtagtcccagctactagggaggctgaggcaggagaatggcgtgaacccgggaggcggagcttgcagtgagccgaggtcgtgccactgcactccagcctgggcaacaaagcgagactccgtctcaaaaaaaaaaaaaaaataccgaggtgatactgctacaacaggaattggctttcattgaattatggaaaactgtggaacttaagccatagcagatatcgtcaggcagagctgctgtggatgaagctaccacagaactgggcaaaaatgtgtctgagcactgtggggaagtgaaacctgaaagcaaattcacgtcagcctgagaacagaccaggaatcgggaggtacagggaggtgtaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtcacccaggctggagtgcagtggcacgatctcggttcactgcaacctctgacaccagggttcaagcgattctcctgcctcagtctcccgagtagctaggattacaggcacccaccattgcacccagctaattttttatttttagtagagatggggtttcaccatgttggccaggctggtctcgaactcctgacctcaggtgatccacctgcctgggcctcccaaagtgctgggattacaggcatgagccaccgtggctggccagaaatgttattcttttgacacattccctaattcttgaaaagcttgagatggacttgtgtccaccatggtttgtaccactgtactaatcagtttaatagcaacaaggtggccgggtgcaggggcttaggcctgtaatcccagtgcttagagaggctgaggtaggaggaccacttgaggccaggagtttgagaccagcctgggcaacatagtgagactccgtctctacaaaaataaaataaaaataaaaaaaattagctggacacaatgacacatgcttgtaatcccagctacttgaagctgaggtgggaggatcgcttgagcccaggagttttaggcagcagtgagctatgatcactccactgcactgcagcctgggcaacagagtgagaccctgtctctaaaaagaaaaaatagcaacaggttttacaattgttgagagaggtcagctcttgttcagagagcgcctcagaatctaggccaaagatcagggttctactagacaaagagaatgagaaggatacttagggcagaacctggatgcccatgcctactgccgcagactggactgagggggtctcccatagtcacagacgtaagcctgtggctgcaccatgggtgagccttggaaacagtgctcagggaaagaagcctgtcacaaaaggccacatgatatatgattccatttatatgaaatgtccaggacaggctaatccgtagagacagaaagaggtgggtggttgcctaggactagaggggctcggggagtagggagtggctgctgatgggtgtggagttttgttgtgggatggcagacatgttctaaagtgtgccgtggttttggtctcacaactcttgagtatgccagaaactattgaactgtgtaatttaattggatgaattgtatggtgcatgaattattctcaatagagctgttaaaaaaaagtaggcatgcaaggtcaccatctgatggaaagcttagccaaagtggtattgggctttgatgaaagcagcttctgagagtattttagaagtgttgacagtacctcctttctggcatggagtctactgttccatttccacctttttttctgaagcttttggttcttggtgtcggtgttaaggattggtttattggtcagtgactcagtggtcttattagacagcttctggtgtatgtggaggtttccatttttccttttcttgctgtgaaggtccttgttcctgcagggatcctggccagtttggtaactgtgagactgaggtggcttgagtgccatgggaacagccacactgggaggccttgccacagtcctctgtgtgtctttttttgtttttgtttttgtttttgttttgaaacagggtcttactctgttgcccagatctcctgcaacctctgcctcttgggcttaagcaatcctcccacctcagcctcctgagtggctaagactacaggtgcatggcaccacacctggctaatttatgcatttttttgtagagatggggttttgccacgttgcccaggctgatctgtgtgtctttttaagtcccattcagtaccatgtctgttgctcacttacaagatttatgattcttttcagtttgcatcttcataaactgagaaaacagaaattggcctaacagggcctctaggacatccttcaagtgagccacagtagagtctggtacaatgctgaaatcttctcctactgctgggtgccctgtgccaccctgcaggtgtggctcttgcccaggtgtgtgtgcgggtagggagtttcgtgctgtaggtacacaggaggtgcaggatgttggtgcaggtcagcttgtttagcagtggcaggatcggctctcaggctggggctccgggagctgctgccttgggcagctgctgccccgcagttgtcttggagacccccccatagccaaaagaggtgacagtggtgcagtggtgactcccttgtggcagctggagtgcccgaggccagagccgctttccctgctgcccgtgccacagcctcagggcctgcccgtctccagtgtccccactcatgcaccagggagaagaggggaggccgccaggagccagtggctcagctcatgattcaccaggtggaggagccaccgctgaggatgctgctggttacctcgatagaggttaaagcccatgaagatggacaagtctataatttaacaaagagaagagaaaacagcctgttactctgcagaaagtaactctttggcatgtgcactgaaggaattacctgttacaggagtatagcagagggtgagaccctcttgagctcggcagaccgtggtgcccatgcacctgtgctggcaagtgtagcagagcagggccaagcgccagggtgggtggggccgtctggctgtagtgtcgtgggaagagtggctggaaatgcagataggagccaatctctgtaggatgttaaacaggagtactcggatgacctgggttccctgctctgcagggttactaatacctgctagaggcttgttttcaagccctgaaagatgggtgtcagtattcccattttacagaagaaactgagtcagaccaagtggtttacccaaggtcacacagctagtaaatggcacagttggaatttgaaccagccagtgtttcatctgctatattatgccatattatgcttgcgttctctctgaaaggacaaaactctcacatgaaacaatgaagacactcaatgtggtgttcactattaggttgaaccacatgcaggtgccatttttgtaggtcaatgtggtcaattatcagcagtgtcccatgggtcagcctaatacagcagcagccggggttcggacagggaaacctctctgcgcaggaatggtcagtagaggtttcatggcggagctgggaatggagcagggccttgaaggctctgtagactctggatggatagaaatgaggtgggagaggctgggtgcggtggctcacgtctgtaatcccagcacattgagagtgcgaggcgggcagatcacttgaggtcaggaattcaagactagcctcaccaacatggtgaaaccccgtctctactaaaaatacaaaaatttgccaggtgtggttgcgcatgcctgtaatcccagctactcaggaggctgaggcacaagaatcacttgaacacgggaggtggagtttgcagtgagctgagattgtgccagtgcacttcagcttgggcgacagagcaagactccatctcaaacaaaaaaaaaaaagagagagaaagaaatgaggctggagaggttgggtgagaggtggagtggtaaggagacagcccaaagggcaggtgctacgtggctgtcgatcagggtgtacatgtgaccttggagcaccaggaggtgattgcaggtaacgcttggggcctggagacccctcccatgcagcagacagggtgggatttggcctgcagctcgctctgctggtccccactgtgctgtttctgtaggaaacaggtgagcagattgccatcaagcagtgccggcaggagctcagcccccggaaccgagagcggtggtgcctggagatccagatcatgagaaggtgagggcctcgcgcatagggacccaagggaaagctggagcagcagcccccggtgtgtctagaaaggagagtcttgctgggtgcgtggctcacgcctgtaatcctagcactttggaaggccaaggcgggcagatcacgaggtcaggagactgagaccatcctggctaacatggtgaaaccccgtctctactaaaaatacaaaaaattagccgggcatgggtgggcgcctgtagtcccagctacagagaacaccagggaagggggaagggcatgctgcacactctgctgggattactccaatgacaaggaaaccccgtctctactaaaaatacaaaaaattagccgggcatggtggcgggcgctgtagtctcagccgctcgggtggctgaggcaggagaatggcgtgaacccaggaggcggagcttgcagtgagccgagatcaagccactgcactccagcctgggcaacagagcgagactccgtctaaaaaaaagagaagagagtcttaaatatctgcccctccatcagggcgccagcctggcagtctccacggtgactctgctgcttctaaagacaccagaggaagagcagctaaagtccacactgggccttgtcaagggctgttcatcaatttcattgtattaaataagttaacacagttatcacagtgacttttcttttgtcagcaaaaaaagccttctttcctcctatatttccagttccaaggtggtatgtgaccgttctctgctgtcatgctgtcgctgacatttattcctctagtgtggagacggggctgtccatctgcctggtggctgctgaccccctagctagtgaggcgtgaggtgggctccgaaagagccagtgaggaggacaccaagcaggggctcctctgccagcctcttaaaaagaggaggtgctatttggttatgtcatggttccatttggttacatgagttccttctcagacccttctctgtgtgtccaccttggggtgatgtgtgtgcgtgaaccaacctgccgaaaattaaacagacaaaagaaaaaaaatatgaaaacaaaaagagcaggcaccaccttgtttgcctgcttgcgtgtgtgacacatcctccccatgtggagggcatgagattgaaaggtccttgtaggagcagtttggcagcacgatgaggacttgggatgtggcacgcacaaaaaactgaagttacacgcagttgtgccctcagggtctgagttctggtgctgtgagtggggctgggtgagcgccactgacccaggcattgcggttggccacccgtcctgggctctgtcttcctctgtttcaaagccctgggttatcctgggcctttgttgctgagacctggtgggggtggtggggatgggtctgggcaggagcctgggtctgctctcatcggttttcctcctcctaggctgacccaccccaatgtggtggctgcccgagatgtccctgaggggatgcagaacttggcgcccaatgacctgcccctgctggccatggagtactgccaaggaggagatctccggaaggtgaggctcccacggctgccaggtgcacagcctgtctgggcaggtgggacaccaggaagagggatggggagacctttcacttctgtcatcatcaggaagcttggggagccccagtgactccagcagggctgctttgcctctcagatcctctgttccctgcccacctggggctggtgtgtgtgtgagtcagaggcgcttccgagaacaccagggaaggggtaagggcgtgctgcacactctgctgggattactccaatgacaaggaaaactcatcacaggtctgggcgtggggaaggactgggcaagttccaaaacaaatgcttcctccctgggcatgttagggccacgttaggcctttggtgccagtgccactgctctccttattaggagggattttattctagagatgggacagcaccacacacgggggcagggagcatagcagagagggagcaggattcatgatcagagagccgggccagggctgcagacccgccccaatccatccgatccacctgacccacctggactcatctgtggggctctattctccaccttctcaccacaccacctcctcttccctagaatgttcacttctggtgggtggatggcagcccctcctggtctcaggggcagttgggtgccctcctccccattgttccctatgacagtaccacacagcctgctagtacatgttacctcattcgatttccaaaagctcacacatgggtgcacaggtatggttcccacatgatgggtggatgtcatggcccagagaggttgggcctcacacagctgtagcagcagagcctgggtcccagcccacacagacccagctgcaggccacctctccatctctgaggctgaataaggccatataacattatgaaaactggaagctctgaacaaaataatttttttttttgagacaagagtctcgctgtattgcccaggctggagtgcagtggcgtgatctcggctcactgtaacctccatctcctgggtccacgtgattctcctgcctcaccctcccgagtagctgggattataggcgcccgcccccacgcctggctaatttttgtatttttagtagaggcagggtttcgccacatcagccaggctggtctccaactcctgacttcaaatgatcacccacctcaggctcccaaagtgctgggattacaggtgtgagccactgcgcccagccaacaacaatttttattttaattgaaaaagaggtcggttgctctgcgagtgcacctcttcactccagaagggtcacaatagtgggggcgggagcccaggcgtttattcctgttcagtggccattcccagacacacttcaggtgctgttctcactgttcctccaggcccttgtgcctcttaaaaaaaaatttttttttccactttggaaagctgagacaggagaatagcttgaggccaggagtttgagaccagcctgggcaacataccaaggccctgtctcctcaaaaaataaaaaatgaaaaattagccagatgtggtggtgtgcgcttgtggtccctactactttggaggctggggtgggaggatggcttaagcctgggaggttgaggctacggtgagctatgattgtgccactgcatgccagcctgggtgacagagcaagactcagtctcaagaaaaaagataatcctgtctcagaacaaagagacagataaataaaataaaagaaactttccatggggcttggcgtgctggagtggctctccctggagataggcatgtcctgggagtggcactcacagcaggatatgaacacagcccttggcatcacccacaatgagagatgggggaactcaacagcacttcgattttctccttatttttctaacctttgacagtcacccattactaactgcagctgtgtagagataaagccatgttgtagtcaagtggagacttctcagagggcagtctggaagtaggtgggatgtggccagattacagagggctctgaagtgaggcagaggcttttagacttggtcttttaggtggcaaagagccaacgagccagggaagaagagatcgaaagtttaacatgactggcctggcgtgggttgcaggatgattgagggggaggcaggaagggctcgcatcctaagggacccctgtccttgctgtcacccagcggggttgggggaggacactgttgcccagtgtcttgttatgtgttgtttcctttgttccctctaaaaagttcaaatctataatacacccgtgggcatggagaggcaggcttggccagcacatggggacatgtaagagtcgatgttaaaagtctacatgctgggtacgtaaacagatgagtgtttatgaatatgacgtgaattccaatggtgaggctcagatgggaagctcctctctccgccctcctcggaggccagctcccagcagcacacagagcctcttgacagtcgagggggccaggaaggcaggggattaagggcttgggcttgagtttcagattgacctggcgccgcattccagcactgccctctcacagctgtgtgagctgacaggtatccgaccgtgtaacctcagtttcctcctccaacacggggattccacccgtacttactcagtggtggtggttagtattaaatgaggtcacgcagggaaggctttgctgagctaatctgtgcagagctcttccggcccctggcacgtagtaagtgctcagtaactgttctctactgttaccatcacccacatggctaggagatggcagggcggtggtcggagggtggtatccagtcatgccctcccagcctggcccgtctctaggactctcatgcacagagaattcctatttcctgtgcttagacttcagcctgccttgctcagaactgcagcagctggtgagaatcaaactttactcacctcagaggccccttgctgtgaggatgtgagagccctggggtggtcaggactgcttcctctttctcctcctcctcctcctccggccaatccctgctagttctgcagccctggcttcctcaaaagcaggtcccctaaagaccagggcccagggtcagcactctggtcacatgggctggtaagagacatgtgtggatttccggtggtttgtgaccaccagctctgatgctgcttttcactttcttgacagtacctgaaccagtttgagaactgctgtggtctgcgggaaggtgccatcctcaccttgctgagtgacattggtaaatcccagtcccggaattcaggccgtgtccttcagggagagtgtggtgcccctgtgagtccctgcggagccctgcaggcagacacttcaatcctttggtctctgtggaaggggaatgggagcccagggacgggggaccctggtggagtagggaggtcaacaaggagtcagccagacagatgctgaactcaaataggtttcccttccttcctgattaactcatcaggtgaattatgatgtatagggaataacagatttcctttcccattataaagctcccctccctcctttcctggaatggccggcgctggaataagttgtcattcgaatgagttttgtcccttggcagtgaatttttccgctcccacgtaggcagttctttgccaatgagaggcgtaggaaaaactgtcctttttaatcccttgggtactgttggcttccccaaatgagggcatctgcggcaccctctgagaaggccaagctggccattcatggagaagagtgacctcagcctgcagaggtcagtggagcctcctagaccctggcgctcactcaggaggggtctgagggctgggcgctaaaggtcagcacctggccccagcctggggagacagggagagggacttgctcagagctttttgttttttttaaaaaataatctccagggttgttggtgcaagttgatagttggggtctaaggtttagagttatcagaatttatctttgactctttgcctccagatttggagaatgatgccattttcatccctccactacctcaacctttcaaagctgtatacattttttctttttgtttgctcaagtttttttggaaaattgtcaaatatatagaaaagttaaaagagtagtacagcaaaactcacataccgttcccctcggttcaccagatgttaacattctccctcatttgtaaagctgtcttctctaagccagggcctggaagggttgatggtccaacactgtcttgctagtgtgggtctggtctcttcctgactgctgcttttgacagaggagaagcaagaaggaaaggaaggggaaaagtcaagcaatgacatatttaaggttaagatccaaatagtctgacacagaaaattcccatcttgctctgtgctgtgtcttcgtccctttgggtggagttcacatggaggatacgttgacattacatcagttttatttgactcgaatgagcacccagtgctggcccaagggatcccctgcacatggcccgcatgagtctcttctctgtctacctagagcataatccatcagttagaaattccacttgttttcttgacaccctgacccaaggctcacccatccatgttttgcttggaggcttacttgattgtattttttacctcagtggccagattcttcatttgttctctgttgaattgggttgaaggcaggttagcaggttggggagtattctcttgcttttcttgggtgatttttattttgtttctctttggttaaagctttgtcaagttattattttttttttggatgtttttctctcagatatttttctttcactccttaggctgttgatgactttagcaagtagttattacgaaagtcttttttttttttttttttttgagatgatggcttactctgttgcccaggctggtgtgcagtaggcgacctcagctcactgcaacctctgcctcctgggtccaagcgattctcctccatgagcctcctgagtagctgggattacaggagcacaccaccacacctggctaattgttgtatttttagtagagacagggtttcatcatgttggccaggatggtctcgaactcttgacctcaagtgatctgcccatctcagcttcccaaagtgccgagattacaggcatgagccacagcacctggccaaaagtctttaaattattggcacaagtgccgggcgcagtggctcacgcctgcaatcccagcactttggggggctgatgcgggtggatcacaaggtcaggaagttcaagaccagcctgaccgagatgctgaaaccccatctctaccaaaaacacaaaaattagctgggcatggtgacgggcgcctgtaatcccagctactcgggaggctgaggcagaaaactgcttgaacccaggaggcggagaggttgcagtaagccgagattgcaccattgcactcccgcctggtgacagagtgagactccatcttgaaaaaaaaaaaaattattggcacaagtgcacataactctcagcttcctcatatggttgtttattctgcaggtgttttgctgctgatattcacagaacctctctggttacgtattcttttggtctgggtccactttgaattcagttactattgacttgtgtggtagcttttatattattttattcaaattgtgtgcatgtatgtatttaagttacacataaattagaataatgaaaacaggtgcttcttcttaagtgcttgtgtgctataggtctcctatagatagataggtaggtgaatattaaattctgtaggttgctgattctctgtctgtcttctctgtgaccctgagttggaaataatttgactttgaagtactaactagtacactacagttaaacttcttgagggcacaaacttcagtcactgcttatcttcagcatctagaatagcagtatataatcttctctataaatatttgtcaaatgagagctggatgcggtggctcacgcctgtaatcccagcactttgggaggcggaagcggacggatcacctgaggtcaggagtttgagactagcctgactaacatggagaaaccccatctgtactaaaaatactaaattaggccagacgcggtggctcacgcctataatcccagcactttgggaggccgaggtgggcagatcacgaggtccggagttcgaggccagcctggccaacatggtgaaaccccgtctctactaaacgtacaaaaaacccaaaaaactaaaaactaaattagccaggtgtggggcatgcctgtaatcccagctactcggggggctgaggcaggagaatcacttgaacccaggaggcagaggttgcagtgagccaagatcgcaccattgcactccagcctgggcaacaagagtgaaactccatctcaaaaaaaaaaaaaaattgtcaaatgaatcaaataaatcctaaaggaaattaaaataagtaaggacctagtttttttttaaaatcaaatgtccacacatcatgaacagctccaggtccaatactggctcctttgcttattagcagtgtgaccgtgggcacgttacttacacccttttattagcggtaaaatgggagcgttactcaccttgttagaattatggaataaaatgaggtgatataaataaagctcctagcacaatgctctgttcctgcagaatgtgcagtcagcaagtgttagttccttgctcatttccttcccgctctggattttgatttttggcctctccttttggaaaccttcagtgccttctttagggcatgacctgaggctggatccagggaaccacacgggtgggtgccttctgagactcccatcctggaagaggccagccttcctcagacctgttcacatctccgccaccttttgggtgcagtgcagccccggttttgtttttgaggctgctgatgagctcgtattttacttttatccctgtttctgatttgtattctaaatccattaaatttctttttgcaaggatctggtgactgagccggagttcatctaacatagctcttttgtattttggaacatttcctgagcatattttgttccagtttgttccaagtgctggcctcacatttcctttgttggagttgccactgctgttctctgccaggttgacttcagataagtggcagagccacacccttgaccgctgggtccggattcattgccttttcttctggattaaactgttggcccctactctcttctgtgccgctaacctcccagagacacccgctcagaacagtgtcaagataacagacatggataggatttttccactgaatttcaaattgcccaagaagaggctgcagagtgcctgtgagaaatgagcagatggccaggcgcggtggctcatgcctagaatctcagcactgtgggaggctgaggcagatggatcacctgaggtcaaaagtttgagaccagcctggccaacatggtgaaaccccatctctactaaaaatacaaaaattatctgggcgtggtggcgtgtgcctgtagtcccagctactcaggagactgaggcaggagaatcacttgaacccgggaggcagaggttgcagtgagccgagatcgcgccattgcactccagcctggcaacaagagcgagactctgtctcaaaaaaaaaagaaaaaagaatgagcagctgcctggcgggcacagaggtgagccccctgcatcctggccaggactcttctgccagaccatcactccatgctgataggagacctgggacccatgtggagcagctggaaatgatatggactgccacgtaatgtgaccctaaaatagctcaaggaagttatatgtgagtggactctatttaaacagtcttgctcattatcctttggaaaacattggcatgtgttttcttttgtcaagggaggctcaaaattctgggcactcaagattgcagggcaggctgtggtgctctctcctgcctgatggggtgtggctctgctgggcgggcctgggtcttatcagatcttagattggaatcagcctttcctggattctgcaggtggccagtctgctgtggtgacaccatcctgtgctccaggcctttcgggaacccacccctctgttgctgtccctgcttccttctcgagctgctcctagcaggcatccaggacttcagcgttaaagaacagagggtttcagagaaaacatttggctttggggaagagagctccattccaggaactgcacatcaggtgcactgtctagcattgtggatcttctgactggttccattgcatgcatccatctgactgaagtgtggattatagcaaaagatcatttgcacataaagctttttggaaagcataagtaaccaggttaataaatacagtaacaatgagagagaagacagcaggccctcagtcatggctccaccattttatagctctagagccttgggcgaggcatggaatgtcatggccgcagcgtccccttctttaggatgaggggtttggacctccgagtgctctctagggccccgtctccctctaacaactccatttcactgtccagaaatctggttttcaggatggtggccccgggacatctctgacatccgccagctggtggcctaactgcttcccacaggctctgtgtctcatctccactgcctgcccctgcattcgcctgtccgtccttccctccctgcccctgcgctggctgcccgctgctcctcgacgttctgtttccctggccgttcttgtggcctgtttctcaccatattgttcccagaatctggaattcaaccctgaactcatcctaaagtcatatccatgtctgccaggtctttcttccaaagtcaattccagtagaagctctggttgtcttcttcagccaggtccctcctgccatcccctttcttgtgtcatggtgccactttctgcccgctgcccaggaccaagtgtccgtgtcgaacctggtctcacagagtcagcccccgctcctgctcatagccttgcattacggaggctgcagaccgctgcttctgctgattcaatgtcagagcaaatccctgcagcgacctcctccctggcctccttaaccctgtgtgctaacctacccttctgtcttggaagggcacttccatcacagtccactcttagataaaggcccagccccttcgccgtacctttctcccactcagccctgggcatgacccacaggacccacccgccaacctctgtgtgtgacccttggaacccacccgccagcctccaggcgtgaccctcagaacccacccgccaatctctgtgtatgacccacagaacccacctgccagcctctgtgtgtgacccgcagaacccacctgccagcttctgggcatgatcctcggaacccacctgccaacctctgcacgtgacccacagaacctacccgccagcctccgtgcgtgattccaaacccacctgtcccttgctggccttgcacgcgttgccccttgtggaagctgttcttgcacctcccagagaccctgagcctgcccgtcctttgggcacagctgcagacctgcccctctgtggggattgcctggcctggggtcacggggattttcctgtgggtctttctgctgatgtcacctcatttgctcctttgacgcttggcattgccattactgctctgtgatttctgtctgtgccttggcagtgagggctgacttccgggtttggggccagttgaccagactgtgcaggaagttaggaaaaggctttgattcagtggcatgtttcccattgtgtgcagatagtggacactcaatagagcctcgctgagtgaattagtgaagttgtcgcactttcgccttggcacccaacgttactgccttgctgcctcactgattaattgaaggctattttagccaagtaacctttagccagactcagtctctctccccatgtccacagctggccttcaagtctgttttttttgggaagcccagtgacattgaagtggctggcacagtaggacccaggcagtaggttttactgagggaacggacatcctgttgcctttctcactcagtgatgacttggattaccagccagttgacaaccaaccatctttgtacccttctaacctctatctcagcctcttggaccatttctctttccacctgttctctatggaatgtagctcaaacaaaaatgttctgaagggaacttagtcatccctctaaacttgtgatagatagagattcatggacccacccttataaaactgctttcttctcggaagtcttgctgctcttatctgttccccagtttgtggtttgtcatctgaaaaaaatacatagggctgtggggctgtgattcggagctgtgattcatcaataagacccacaggattgtcagcgttcttcagttatgtgtttgtgccttcctcatgagccagggaaaggctggggttaccaccggggcacggcttctgaggagggtgagagaaggaggctgttatcttcctatggcaagtctgccatgtggacccattctgtggaaatgtactgtgtcatttatcttagtttttgtgtttttcctgcatacactgcactgtgtcgtttattttagtttttgcatttttctagaggcagggtcttgctctgttgtccgggctagagtgcagtggcacgatcatgtttcaccgcagccttgaattcctgggctcaagtgatcctctcacctcagtctcccacgtagctgggatgaaggcatgcgccaccatgcctggctaattaaaatttttttttttgtagagacagggtcttgctatattgcccaggctggtctcaaactcttggcctcaagggatcctcctacctcggcctccgaaagtgctgggattacaggtgtgagccaccatgcctggcctcactgtgtagttgtgaatagcttaatagtttgcaatgtggtgcttctcacagctcttctctgtaatgggaacatgaaaaattacctggtacagttttatgctttgtggtgtggcttttaatttttataaacatgtcttactgctattgccagggatttagatttttaataaacttccagatacaacagtatttttcttcatctcaatgtctcatttttcatcaaatttaaacaaagttagattctctgggcttgaaacaattttgattcatttcactttagctctgaagtactgttttgtaaaatgtagcacagtgatactgaaccaagctttttgaaagcttattctctgcagggtacatttaagaggacttgcctatcagaatttttacatttcagtcccagaaactatgtgtaacaatacctgttggattctttaaatctggactttattaagttgacagaggtattgaagaatagatgaccaccccgaaatgaggaataaagtttgttttgtacagttgtttaagcataaaaatagacagatattaatagtagtcagagtattcagttaccaacctcttgtccctcctcactgaagatctggtgacaactctaatccacgtggcgtagagagcggtgcctttggtctaatccgaatgctcctcctcttcactggggggttctggggacatctcacctggttgtgccctgggttttgccctgagatgttagcctccagctctgggggccttgtctcagtctgggcatgtgtacttgctcaaattacagtatctcaacttccatatattctgctttggaaaaaactaacctacacttttatgtattacatcctgatactctccagcagtctgtcatataccaaaacaggtcttttgtgaacctatcagttaacagacactttgagttattgcatggccttgctctctgccagccagtagttcatattcaacagcagtgccatccctgtctgcaaggctgtgttagtgcagctattttttatacttcatttaatttattatgctttttcatttgctttgatttttaataaaagtaaaacaaaaataaaagtgctgatgagaagcattggtcttgaaacattaacacaattgagaacaagatgaaatataattttttaggcacatggaaagcagcgagtctttcacctcatctggacattaattggacctaagctgatctactctgtcacttaggaaggaaatgaaaagtaaggaacagtatgatatgttggaaccacatggtcgaaggctggacttaaaagagcagatgcaaggagagatctggcaccacagatagagcatccctaatcccaaagtccaaaatctaaagggctgtaaaatctgaaggtttttgtacactgacatgatgccagaagtggaaaattccacacttaagtacttaacacattgttccatgcacaaaattattaagactattgtataaaattaccatcagactataaaatcatttataaaaattcagttgtttcatataaggtatatatgaaacaaatgaattttgtgtttaagcttgggttcattaggaatatgccagtattccaaaatccaaaaaaaaaaaaactgatcccaagcattttggataagagatactcatcatgtatagcttaatgttctgagctggaactcctttaataaggtggaagtcagttgttcagctctcagtttgactcttaaatatgttttcagcaaatgttcagcttagagtctttgcagagaatgtttgcttactcagtttctgtggaaggcttttccgttaccctgcacagagggccgtacccatgacagcagataggatcgctgcctgggcctcaggggtcttcccctccccggcttgccgagagggagagagagagagagagagagagagagagaatgagagagagagagagagagagagagaatgagagagagagagagaggagagagaatgagagagagaatgagagagaaacagagagaatgagaatggtggtggcggcgacggcatacagagggttcattgttaaacctctgaatgttactgcttttgactttttaagttttaaacaagaaacaggtcataccattaactatccctctgagtcagaaaatatagacccaagagttgcctgttctaatgtggcactaccataatttgttctaacatttcctaatgactgtctgtttctaattatttcattcaagatatgcagtaagtatccttgggctaccagtgaagtgataccatttgtatctcttcttctgtgctttctcaccacttgacattctttgcccatttttctttttctttttctttttttttttaggtagagtcttactctgtcacccaggttggagtgcagtggccatgatctcggctcactgcaacctctgcctcctgggttcaagcaattctcctgcctcagcctcccgagtagctgggattacaggggcatgccaccacacccagctaatttttttgtatttttagtagatacagggtctcaccatgttggccaagctggtcttgaactcctgacctcaggtgattcgcccacgttggcctcccaaagtgttgggattacaggcgtgagccaccgcgcccagccccatttttcttctgcattgctttcttattgatttataagagctttttatctattaggtatctttactctttggtgtatgtgttgtagatattgtttccccacctctcttatcttttggctttgtttatagtatcttttgccataaactttgaaaaccttttaatgttatttgcactgttctatttataccatgtgactttcctgcatacactgctctttttgctacatgtatcccatggtgttttggagtttttgttgctaatgtgaatgggattttttttcctttccactgcaactggatatagctaacatagagaaaagctattgacttgtgtattcttgttcgtttccagacaactggctaaattttatccagtgtttagtctgttgagctctctaggctacatctccaaatctatctccatctctagtcatagcatctccaaataaaaataattttatctcatttcagtactatttatttcatttctttcttttatagtgcagtgaactagatgtctgtcaaagttattcaccctctcttgagggtaaaatcatgtccttcttgccatctgagctgcaggcgggtgcctcctcatgtgacatcatcacgttgcctcctcacagcagaagctcttggtatcaaatgcttccgtagccagtgttgtgcagtctgctttcttccaactagattctgagctctttaaagttggggatcatgccccttattttatgtccctcacagaacctcccagagaactgggcatgtagtaagtctgtgtagggctgtctgtatgtgtgggaggtgtccctgttctcctcttctgcctccccgctgcttcctggaagccagttctgacctcttgggactgtcgatcatatgaccataggactctgtccccaagggcccttcctccttgcccaccctatagaatttagatttttgagcctctagaccaaagaaacttcccttctcaaaactttattggcgtcagcatcacctggagagtttgttaacacagatcgtggggtcatccccagagacttgaatccagaggtctcaggtggagcccgagaatttcacattttgaacaagcttgtttgctgctggtccaggtagtatagtttgagaagcactgctctaggctgcagttggtgacctcatggatgcaaggcaaagagtgctttgcgcaagtaagccagattcctgtggaagtttaagcctcacgtagcagggcccctgccctccaccctgaggtattgcgctacaagtcagagtatgtttcaggggcatgcggcatttatcttttgcaggataggagattctgtcatgaaaagcattttttaggcctaagaaaaactcacccccctcttcctcagcctctgcgcttagataccttcatgaaaacagaatcatccatcgggatctaaagccagaaaacatcgtcctgcagcaaggagaacagagggtaagtgacctcctgggactgggaaagcctcaggtgggcgtgccgggaagtggcctgggaggaaaggagcacactctgcatatttgtgtgtatttgcatttccttgcctgtgctttgattctctgggaatgctgtttgatttgaaacaaaattgagcaaaaaagttgttgcagattgaggcaagtttaaatggattacattgttagttgctcaagttgcaggaatctgataaggaaaataatgtttgccttcctacctccacccctagcctctgggactagcgcttcttggaagtcgactttttgttttccatttgctttaagagcctcgcctctcgactctaaatggaaaccagtggtcagttggttgtggatgtggctgggaagaggcactgggagctggcctctgctgccaagcctggtccagcctatagtttccccagagctctttgtggcctcctcagtggccacccggctcagacgtggtgttgactgccccacaagcttgacattgtggtctttacccacccactctatgtgttcagctggggtggtgagcacaggctcagctgagtggaatacagtgaatgagttcttagatcacctaatcccttcccatacagctgcccttagcacctaggcctggcctgtgactaccacagggctcgcccttgttccagttcaccctcactcctgtcagtggtgctcagatttgagaactgagggcatttactgagaagaggctggcccggtccttcctgtttcaagtctgggtttagctgtcttgagggctggtgcctgttctgttcattcagcttccctctgatgatgcgtggcagagtgtgggaggacacgtgcctagcatttttacaatatgccttttcttttagccctgaatctaccgtgtcgagggcattcttttgtgtatctggtggctcttaggagtttgggatctaatagtacctgggaattcagaaatacctctgctctaacaccaggcagtcagaatcctcgtagaaggacattgtgttcttataaccctcagctttctccttccttttgttttagttaatacacaaaattattgacctaggatatgccaaggagctggatcagggcagtctttgcacatcattcgtggggaccctgcagtacctggtaagaagtgggccttgcctgtttgcctgtcagctcctccctgctgctgcatttgtggggctcctgtcctgccttgctcccagcacctgagtcccaccggctctctgaatgttttggagatgcatgaggtcacacccataacctggtcgagtcagcattttttgccaccagatgccctgtggagggatgtggtcgtcttctctgatgtccggagggctctgctcatgcgccttgcaccatcccctagcctctctgtgcttcagtgtcttctctgaaaggaaagggttttaaacagatccatgctggtctcgagcggtcctcccacctcagcctcctgagcagctaggactacaggcaggagccactgagcctggccgaggccacactttccatgaggtatttcaggggccactgagtaggggtcagagctctgagctccccaccctttgtttacgttatttggtctgaatattaggtttctgtttgagtcactcattcattcaagcatattgatggagtgtagtctgtgtcaggcactgtgctcagggctggtgatgcagtggggaaaaaagacaagcccttttcggccttcagagcttagggtttagcaggaaagcaagcattactgtgatgcttacacagataactaagaaattacagttgtggtgagtgttacaaagcaagagtgcagggtgttgcaagaatatatattgggtggcctcagcctggtctgggacttgaagggtaaggaggtgaaaagggctggaggtgggggacggcagggggaattccgtgcaaagggatcacacacaggaagacctgcaggtgtggctggaaccgagcacaaaagggaaagagagtcttgagttgaagctgagaacaaggtagagcacagattatgaagggccttcagggctgggctaaagttctagactttatcttaaaacctctgcagagattgatgggttttaagtgggagaaggagcaactctttggaaagcccactcctgacactgtgtggagaaggaatcacactgaacaggagggaagagtgggtgaggtaggggcagtgaagatgtagagggcaattagattccaggagggcttagcacaaatgcccagcaagacttgtcataggttgcttgatgatggcagtagccaccacaattgggagtgactcaaggagtctgcggctttcagagtgggtctcacagagggctgtgattcaggcgcctgtgtccatatggcatgtgatttggtagatccttctggagtcctcctcagctcagcagcagtcgagcaagggggaccccatgctctaaccaggagctgagtcaagtcatgtactcacatgagctaaaacgtctgcccataaccagacatagaggttgacctacccatcccggaatgtcttctcttggtttggtctcccgggcccttccttaagcttcacatttccaaccagaccatgcaccaccctgtctctgtgcttttgcttgccccagtcatttctgtctccacccacctgctaagcccagtctgcacccccagcaccccgtgctgccgccccttcttcggtcaccccagcgctctctgcctcagcagcagccatgcatcacactttccctgcctgtttctaaatatcctggccctttctgcaaccacatggtacctggttcaggggttcaaccagcacttaatgcgtgtatttggtgtggacagcctggcatcattttcctttaacatttgtagcctctcttcccatttctacacagtgcccacgactgtgtcctgccttaagctagttttcaataagcgcctgaaatgctgcaacccttttttttttttccttttttctttctttctttcttttttttttttagacagagtctcactctgttgcccaggctggagtgcagtggcatgatcttggctcactgcaacctccacttcccaggttcaagcgattcttgtgcctcagcctcctgaatagctgggactaaaggtgcacaccaccatgcccagctaatttttgtatttttagtagagacggggtttcaccatgttggccaggctggtctcaaactcctgacctcaagtaatgcgcctacctcggcctcccaaagtgctgggattacaggtgtgagccactgcgtccagcctgcaaccctcagttttaaaggagagaagttaaagcctagcgatgggtgtgtgatgtactctggccctgaatctttagcccctccatcagtacctactggagtgagtgggacatagaaaggtcttagaaatggtagcatgatatacccgctaaacatgcctggggtgccctcctcgccctgcatgcatgtgccagtgccctctaggatgaagccaggggtgaaagcagatgggctggccgccccctcctgccgtggtccccccagagaggagcagctcaggtgtaccccctcctgttgctgcaggccccagagctactggagcagcagaagtacacagtgaccgtcgactactggagcttcggcaccctggcctttgagtgcatcacgggcttccggcccttcctccccaactggcagcccgtgcagtggtgagtgggcccggggcacctggatggaggagggagcctgtctgttcctttctcttcacgtaccctgtttccctggcgccccatcaccgggcctgggagatctgtgttgtttctcttccgagaggaaggcctgtcaggacctagcacgagtaggggagtggtctgtgctccaaggacctgttaatagatagagtagctgttaagtcttcatgtggattctgagccttcacatctttaaatacaatgctgtgtcagtgtcatctgctctgtgttcagaagtaagactattgtatgaatatacgcacttacactgagaatgctgtgtgttagtaaacaaataaaacacgtgtacacatgacaagtcaggaggaaatatgtgaaaatttgttgttgacaaatgttactacaacctgaatataaatttttgtttttaaagcgtaagaatgtggccgggtacagtggctcactcctgtaatcccagcactttgggaggccgaggcaggtggatcagttgaggccagcagttccagaccagcctggccaacatggcaaaaccctgtctctactaaaaaccctagccaggtgtggtggcgggcgcctgtaatcccagctactcggaaggctgaggtgggagaattgcttaaacccaggaggcagaggtcgcatcactgcaatccagcctgggcgacagagtgagactctgtctcaaaacaaaaaaagtttaaaaaaaaaaaaaacaacagctgagcataaagcataagaatgtagctgaaattgtgaacctaataaattacacaaaaatttttccagtaaaaattaaaggatatgatgaagatttgtagaattaccctgtattctttagcttttgttttactgattaaagaaataatgcattgtgcaggatatgtttatataaaagttaattatcaccaccaaaaatggtatgtgaggtaatgtatatggtaattagctcaatgtagccatcccacaatgtgtacatcatgttgtacaggataaatatagaccatttttatttgtcagtttaaatcaagaactgggggcagaaaagaaataaaagttaattattactgaaagccataatttaaaaatgaatattcccccaaatcagttagatttcatttaggattgttccttgagaggccacacactagtttaaatgatgctactctgctcaaaatttacttacttcaagttttattttttttggaaccgtaataagttcatgtggctcaaatttccagaagaataagggagtatgcagtgaagtcataccagcctcccaggccctcatttacctccccacaggcacctgctgtcttccaagaatgttttcatatcttccaaggtgttcgtatcttccaggggtgtttgctacgtgttccagtaaattggcatatatttgtttatttgtacattgatgtttcccctcttttttatcccaatggtagcattatctgaacacggtcctgcacatgctttcaagcttttcacaccatgagaatttctttttgagccaatttatctgcaacacaaaaaattattattttgaacttaaatagtactgcatagtttaattaccccctcatttttgccagattaactttgtttcatttttgtgttttggaaaatatggaaacagtaaaaaagcaggaatcaactgtcatcccataattggaaaacaatcactatgaacagttgtgtgtctccaggctcttcagcgttatatttttgtactttttaaacaaaaataggttactataatcttcatacaacgtgcctttcaaactagatatcaaaaatgctgtatgtttttccttattatttgtaatgtctgttatttcactgaatggctgtgctgtggttcatttaacttatcccccgtggttggaaggacgttgataatttttacttcttaaaataacaccaagaataacatccttgtagggaaattcttgcacacagttgtttccctaggataatacctagaaagggaaataacagattaaagagtttgcacgttgtaaaggtttttgatgcatattagttagcaaactgctcaccaggaaggtcatataaatacacgtctccacctggagtgtggacactgcccctttcaccacatccttgccaacactggctattgtcaccttctggaagtaatgaaaacaaaacatgaatgttttcagaggacaagtgtctacatcttgagagtatttgtttataagaataaagtgggccaggcgtggtggctcatgcctgtaatcccagcagtttgggaggccaagatgggcggatcacctgaggtcgagtttgaggccagcctggccaacatgatgaaaccccatctctgctaaaaatacaaaaattagctgggcatggtggcacacgcctgtaatcccagctacttgggaggctgaaacaggagaatcgctggaacccaggaggcagaggttgtggtgagccaagattgcgctgttgcacttcagtctgggcaacagagcaagactccatcttaccaaaaaaaaaaaaaaaagaaaaaagaaaagaaaaaaagaataaagtgtatcctttgaaatcaattccagaaaagtggtcttaggtgatggcagtctgttcaattccacgtttacctcccagtgagggaggtgtctgccctgagttttgagaagtggcaaagtatgccccactatggtgacttattttaaaacaggcattgctcctttagctacataggttctggaatattgaggaatttgttcattaatttatagtcacactttatagtatacgcattataaaaatagctttaaattgcatgtacatctatagtgggtttttttgtttttgcttttgttttttgagacagaatctcgcttttttgcccaggctggagtgtagtggcgcgatcgcggctcactgcaagctccgcctcccgggttcatgccattctcctgcctcagcctcccgagtagctgggactacaggcgcccgccaccacgcctggctaattttttgtatttttagtagagatggggtttcaccgtgttagccaggatggtctcgatctcctgacctcgtgaactgcccgcctcggcctcccaaagtgctgggattacaggcgtgagccaccgcgcccggctgtagtggttttaactaaaggaattattgcatttcttcaggtcacttgttgagcatgtctcttatttatgacaagatgagttaaaatccattagaactagaagaacaggtgctttttgaaaatacattcctaatggcccagcgtcttcataggaaatctgttgtctgcagagccatcttcctagagcttccctcatcagtgctggaggaccaggtggccagtttcaagtagatttctctgaaacccaataaggagctgttttgtggactatctagtttttaatgctttgggaaacttttaaaaaatttcactatcttatctcagatggcaggtaaatagtaatttccagacaaatgcaatttgggctttacaattctattataaagccactttgaaatatattttaggacaagcccaagcaataagcatcttattttgggtccttttctaatttcccatcaacagcctaagttttctagcagaggcttattccacacttacataattagaaagtcttggagcccccgacttagagctgtcagagtttcagcccaagctataaagcaccagcctctgccacgcaccggctcttctagctttccagtgccagtgtgctcccgataggccggttcaccacttgccaatgagaattgtttggagcaaagcattttttatttgaatttcctagatgttttgaggaaaaaccgtagttggacattcagacagaatagaaagaacaccagacattgggtttgagcccctgattctgctactctgttgtgtgaccttggacaaatcatttgatcatcatttcctttagtccaaattgggggactaaaaataatgtctgccacatgggcctgtcacggcaataagtgaataaatgatctgtgtcagagtacttggttatctatgaagtattattcaaatttactcttcttattaccaagatttgaagccatttgtatgtagattatttttactggccgggcactgtggcttacccctataatcctagcactctgtgaggccaaagtgagcgaattgcttgagtccaggagtttcagactagcctaggcaacatggtaaaaccccgtctctacaaaaaatacaaaaatttgctgggtgtggtggcgcacaccagtagtcccagctactcaggaggctgaggagggaggattgcttgagcctacaaggtcgaggctgcagtaagttatgattgtgccactgcattccagcctgggcgacagaaaaaaaaaatttttttaccttcagatactacttcacataccccaagaagttccctaagttgggaaatgtataagttcatttatccttagtatttagctgtgtacatttagagggaagtatctatgtgtgtgcgtaggttttgcatattttatgtaaatgtcgtatgcatgctgtaatctaggtttggaagtcctaattttaacctctgtcaaaacacaagagtgtgtaatagatgaaatagaaggtagagcaagggagaaggaaaagccaaggatgagataaggaggcagtggtactatctgcagaactctgggcacaagatggtcagtgactctgctaaaggttgctcttcaaaaactcatccaggcagtcctgaccagtcttaaactctcaaagaatctgcctgactcgatgtgaatgaactgactgctattccaaaagactggggctataagtctcctgtatagttgtaaacttatattacaaatgtaaaatggctcttgagtgctaagtgtcgtagggatatgtatgactgtatatttcattgacatcccagtcaacaattgactgcatagatgacagtggtctcatgagattataatactgtatttttactgtaccttttctgggtttagatatgtttagatacaccaatacttaccattgtgttaccctggcctacagtattcagtaccggagcatgctgtacaggtttgtagcctaggagcaatagggtgtacgatacagcctaggtctgtagtaggctaaaccatctaggtttgtgttatgttcacacaaggactaaaatcacctaatgacgaatttcttagaatgtgtccccgtcatagcaacgtgtgactgcacctaacaagattcatatttgcaggcattcaaaagtgcggcagaagagtgaggtggacattgttgttagcgaagacttgaatggaacggtgaagttttcaagctctttaccctaccccaataatcttaacaggtaaggcacagcggcattacacgaatacatatctttcttgctttttttagaaatacaagtcttggctgggcgtggtggctcacacctgtaatcctaacagtttgggaggctgaggcaggtggatcacctgaggtcaggagttcaagaccagcctggccaacatggtgaaaccccgtctctactaaaaatgcaaaaattagccaggagtggtagcacgcacctgtaatcccagctactcaggaggctaaggcaggagaatcacttgaacccgggaggcaaaggttgcagtgagctgagatcgtgccactgtactgcagcctgggagacagagtgagactccatctcaaaaaaaaaaaaaaagaagaaagaaattcaagtctgaagtgacatctgataacttttaaacaggctatcaggatatcgtcctgtgactaagaaattaacatagtccttcttaatcttaaatctggaatgggttttcctcccttatctccctagaaatcatctcttttctaagttcacataacaatttatctatacctcttattacccttaatagcctctaccttgtatcacattcggttttgcatagggtttatctctgattcaacagcagtccttttaagggtagggaattataccttatttctctttccacccctcatgtggcccaattctgtgtcacagtcaacaaataaatctttgtcatttgaatggcattacaatccagtctcagagccagaatctaaacaattaataatattgtataattgtacagaattgggtaacagtgcaaaagaaagctacaaggcagtcacacataattgagtgacatggataatgattaccatatttagagggtggaagagatgattggatggattagtgctatatggaatgacgtgggataagctagaactttttggaagggtctagacagatgtacaggacatggatagatgaagagaaaggaggaaggaaattctaaggggaaagattgaggtgagcaaggcacgtttgggaggtggtgagtagctgtgttggcctcagggaagggtttgagtgctcacaggaggcaggctctgcagggccaggggaaggagtttggagtttgtcatgtgaaccgctatatctggcagcatgggatctagattctgtaggggtcacctaagctaggatgtgcctataaagtgtatttttaaaacctcatgggttattctttttccccttctttcttcctttctttttaagacagagtctccctctgtcacccaggctagagtgcagtgtggcacagtcttggctcactgcaatctctgcctcccaagttcaagggattctcccgtctcagcctcccgagtagctgggattacaggtgtgcatcaccacgcctggctaatttttgtgtttttagtagagatggggtttcaccatgttggccaggctggtctcaaactcctgacctcaagtgatccacctgctttggcctcccaaagtgctgggattacaggcatgagccactgtgcccggctctcatgggtcattcttatgcagccatttggaggtcagcaatctctgatttgggggtattttagaattcaggagagaggtgtgaacacctgaataattgattggaaatgtttatactgtttctgataaacccattttcattttcaatcaccgtctactggctgccgtctgtgtgtatactgggagacgcacactgtagcccaacattggctggaagtgtctcctcacacactatgctcctctccacagtgtcctggctgagcgactggagaagtggctgcaactgatgctgatgtggcacccccgacagaggggcacggatcccacgtatgggcccaatggctgcttcaaggccctggatgacatcttaaacttaaaggtgagtgtggagccaagttagccctgaggcaaaagctggggtccccagtggaacatgcagttcttaggacagagcaggggatggggccagctgacctagtgaggaaatttaggctcctgcatcagtctttctgcataagtaaagaaaggacagttgtgctaattgacattggctatgaggtcatagccacagacaggattatgaaagatgcaaatatgcgaaacatggcacatgacctccctccctcaagctaggcccttgctttgtgtggttgggaaatgttgggagtagcagagagaggacctaggcaaatagatgggcatttccttgaagaaatcggttttccagtaacatctgggttgtgttgcagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaaggtgagccctggcttcgtacacaccatcctgtttaccttggctgtgcctcctgggaaactcaacacactttcagatttcaattctgctttgtcatgtagtctgttaatcacacagtgcggatacctggctggtttttaagttggagtatggtgtcctctgtgtggcctgataggaaacacaaatctccttgctggacttgttacttccaaaccctccaagaccggtctcttgcctttattgcaaaaaatgatgctataacactcgaatctctcaagttgcctgcttggccctcttccaagtgtactaaaaaaaaaaaaaaaaaaggatgctgcactttcttgagtcaactgaaagtatttatgatggcctctgtgtacagaactgggttaggcacctgtgttaactatagctgtgtaagacatgacctctgctcaaaaagaccttctcagctgacttgtggagctaaagttatcatatgagaaataatcattgcatagggaagtatatagtgaatttctgaacttcccagggaagacagagagtaaaatagaatgtaatacgtttgtaaataaagagtgtgttcagacagtaagtgtggctggaaacgttaaacacttcatggatgcttcctacttgctggctgaagatgatgctcttgctgaacagtggggaaagctgtggaacttcttcattatcagttagaaaagagagggttggatccacaagattcattttgtccttgtccctttgcagttaaatgagggccacacattggacatggatcttgtttttctctttgacaacagtaaaatcacctatgagactcagatctccccacggccccaacctgaaagtgtcagctgtatccgtaagaatttgttttgttttgtttttctaaataatccgttataatatgtgggacaaggcagggaagggagactggactaaggaagggggagccacgtaaaggaaattaatatcgccagtcctcagggcagccttccttatttaggacatgcaaggagtagccaggcaagagagagtacaggaaaccattagttaatttcaacctcctaggacgggcgtggtggctcacacctgtaatcccagcactttgggaggctgaggcaggaggatcacttgagcccaggagttcaagaccagcctgggtaatatagtaagctcgcaagtctactaaaaatttagaaattagccagatgtggtggtgcatgcctgtagtccagctattcaggaggctgaggcagaaggatcacttgagcctgagagttcaaggctgcagtgagtcatgatcacccccactgcatgccagcctgggtgacaagagcgagaccttgtctcaaaaaaaaaaaaaaaattctattgaaaatatatggccctatatacatatgtgtccaatggttcgtaaagtgttccttcaaatcaacagctacttattgaccactggtacatgctgttggtacaaatacatgtatgtgacagtaaccaggcataacaccctccaaagttacatgatcctatagtaggtacaaaacgtgaaagtgccagtagtgtcgaaggcaggatatggttaattgtaggagagttattgtggttattctttgacaattgcttgtgtctctgtctccagttcaagagcccaagaggaatctcgccttcttccagctgaggaaggtgtggggccaggtctggcacagcatccagaccctgaaggaagattgcaaccggctgcagcagggacagcgagccgccatgtagcgtgccaggctttttttttaaacttaatttatttaaaattccttggtggctttggccacagggaggtggttgaggcagggacccagaagcaaccgttatgagcaacaaaaggaagacactggtttggatggacgggaagcggttgggtgggctggactgacggaggcccctttagacctggcgaggtgagtgtggttggcacagggtgaggagtgtggaactgaagctgggctggccaagctgtggctggtttgggaacccagaggagctcactaccatgtggattagcaaaactcccctgaccgtgctgctggggacttacggactctttcctcattgtgactcgtttgccaacattattggccttttgtgtcttcctttgcctgatgtcaagtttagtgcagaacctcaggcattgctgagggctaggaaattgtccttgggttataagtggctgctataataatagtgatgatgataataattatagcagggacctcccttgacatttgagggggttttgttattgtacaggaaatggaatttggatcccagagatgctccaagactgttccttgtggtccctgcaggatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcagtgagtgtgcactttgcaatgagtttaaagacaccatttttttttctttttctctttctaaggtttcttttgtcctattataattgagttgcttatttctgtttcagttttgtggtgtttttattttgttttgttttgtttttccttctcaattttttttcagcatcagataaactgctgctggcctggagggaaatggagcaggctgtggagctctgtgggcgggtaggagactcattttgggtttcggaacttaccaagggggtgagattttgtgctcccacttttcactttctcatcaaacactgggtcgatctctgtcaaaaatcaggtgttcctcaccatgctttgagcttaactggaccagctgaaaagaggccaagagagtagccagtgaagggagcccctctgtggccagatgcaagagctgcatgaatggacagagatggtccaggtttaaataagaagcaagggttaggttcccttggggaaaagccaagaccatttcctgttaggaagggcattggatggatgatcaacactccctcttgtcgaaggtttttgactaattttgttgggatgctaaatccataggaaataaaaggtctaggcagaaagtctcagggcagcgtaaatcagatgtcaccaaaaaaagttaattatgaaggcaaaggaaatacatgtgacttaatgaacctcacacaaactgaaggttgaagtcaggctccggggctttttcctggacttatcctctgttttcccctgtgtacttgggcaaggatcttcacctgtgtcttagtatcgatttttatgaatcagtactgatggagtatatgtgtgtttaatggtgaatattaaccatagaagggctgagtgctcctccccatcttgggactcataatctgtgaaataaaacagtctgggcctccctgcccgggtagcatcaggatagacagatgaagagaagagaaagtaatgtgtcttgggcatcttctgtatgccaggcaccatgccagaggctttaagtacttcatcttacttgactcctcagatggccctgttagaagcctattttatgcaaaaggaaactgtagctgggggtaagtaacttgccaaggggtcacacagctagaaagcggtggaccctagatgcaggcgcagccattcagaccccacagtccacattcctttgagccagtccattgagggtcctcagggaatgtggcgggtcccctggtctcgctcccccgcagatcttgcatctcagcatgcgcctaccacatcagttgacattagcacagcttttccattaggagaacgaagtgaaactcctggtagaacggatgatggctctgcagaccgacattgtggacttacagaggagccccatgggccggaagcaggggggaacgctggacgacctgtgagtactggctggggggcccctctgtgcccagcacacacagacagccctggagcttcggtgtgtgtgtcaagggcaccctcagtggctgtgcgggaccattctctagagcatgcttccctgtggggtcacttccagcaaatcatcactgagcttcagtttccaaatctgttcagtgacaagaaaaacagtcttaagtcacgaagttgtaaggatgaattcagataatgcatttgagacgcaggccataatctgtaaaggctgtaaaatgcaagcagcctctacccctgtagcagactcccctgatttgttccacccaccctgactcaggcatagctcagagcagaaagtaaaacagagaaggaagaacctgatgaggcttaggagtttggacctggaaactattcgtttgagtctttgtcaggtatttggcattggctccatgaggggcggaggggtctaggcagatcactcctacctgaaggagatcacatgtgctcctggcgtacagatggagggaaccaggcaggccgcttgagggctgtgtcaccgtgagctcagcagtgttccctgattctctcactaggattcttaggacaggagctccaaatgtcagaactttgattctgtattttctctaattaaccctttattctcctctagttcttttatttgtatttgtattatttttttaagagacagggtcttgccctgttgccaatgctggagtgcagtggcacaatcatagctcactgcagcctcgacctcccaggcttatgcagtcctcccatctcagcctcccaagtaaccgggactacaggcgcatgccaccatgctcagctaatttaaaaaaaaaatgtttttggctgggcacagtggatcacatctgtaatcccagcaccttgggatgccaaggcaagaagattgcttgtgagcccagaagttcgagaccagcctgggcaacatggtgaaactctacctctaccaaaaaaatgtaaaaattagccatatttgacctcaagtctagacagaacttctttgtatattttagagaggagcaagcaagggagctgtacaggagactaagggaaaaacctcgaggtaagtggggttctgtgtctgccttgggcttctccttatctcatttatggggcatcactactctctgctggcttccttgaggaactatgctaccctccctctctccagaccagcgaactgagggtgacagtcaggaaatggtacggctgctgcttcaggcaattcagagcttcgagaagaaagtgcgagtgatctatacgcagctcaggtatgagccccgaccttcctgctctggaggaaggactgggagatgcaggtatgaggtcaccttcctccctcctctctgattcgctggacctcatgaagagagtttctgcagctgctgactggatgcacagctgccacaggttctgctttctccagcccaaatgccattagtttgccatgtttattctttgcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtgtgagtgagtgctgtggtcccgggcccttggcctagcagcctcctgtgcctttccacctctgtgcactgccgccatcccacacgggacaccacagagccaccagcagcccactcagctgctgctcgggcttcacgtcgctgttctttgacttggtgtaagcggggaggtcagaggaagggcctgtgctaattgttttcattcatctgtgtattactttcgtgtggctactgtaaagattagcacaaactgaggggctaaaacaacagaaatttgggctaggcatggtgactcatgcctgtaacgccagcaatttggggaggctgaggtgggaggattgcttgagcccaggagttcaagactgcagtgagctgtgatcatgccactgcactccaacctgggcagcagagctgtctctactaaaaacaaaaacaaatgtgttatctgagctctagagcccaggagttgaaagtcccgtgtcagcagggctgagctccctctgagggctcttggggagggactgtccttgcttcttccagctcctggtggttccaggcgttctttggtgtgtgactccagtctctgtctctgtcttcatgggacccctgtgtcccttatctgggtgactcttacaagaacacttgtcattggatttgagtcccacccaagtagtccagggtgatgtcatctcaggttctctaaagacgctttctccaagtacggtcacactcacaggctccaggagttgggatgtgggcatatccttcttagggccaccaattcagcccaccgtcatgcacggcagtgcaacttggttgaccatcgtctgcgtctgcactgccctcagtgcagtaagccacgctttctgtgcacaccgtcttaacgtagctgtgagtccatgggatgccacatggtggggaaatgggaaacaaaacagccaagaactgagacgggcaggcctggccgtgttgtgggagccagagctgttgggactgcaagccccattgtgaaaggctgcagagaaggtgacatggatgaaagagtgatttaggtgtcagtttcccttaagagcaaagggaaggagagagggagatggttgctcatggtggaagcaggagatggtgcattaggagattctcattgtcaaaggcagaggggacaatccacacacagtgcagagaacagaggggctggggtcgcatgccagagcactgagcatgccttgggagcgtgattgacacatcctcctgtaagaagagaggaacgggagaaaacaggatgacgaggtagagaggatctgaagaggagagggaggtgcaggtatgcgcaggtgatagcctgatgtgccatctacatccattgagcatttactgaatgctaactatatgcccagcaagacacacaggtgagaaggcatggcacctgttcccaggagggcctgatccttcaaggggcacagacagaggcatgagtgagagccgttcagggcaggaagggctaggaagcagctccaggaggcatgagctgcagtttctgtgcacagggggagctccagcttgtcttagaggagagggagcaacaagaaggttcacaaggagctgttccagctgaagagtgaggatgttccaggacagagacactgctttatcaaaggcagagagcctggggagtcagtgtgttctgagtggggacaggctggtgtgtgtggggaaggccacaatggaggatgaagctgctgaggtaggcaagggtgagcttacgtgggccacgcttcattttctttttttttcgagacaaagtctcgctctgtcccttaggctgaagtgcagctgctcaatctcagttcactgcaacctccacctcccgggttcaagtgattctcctgcctcagcctcccaagtagctgggactataggctcatgcccccacacctggctaatttttgtatttttagtggagatggggtttcaccatgttggccaggctggtctcgaactggcctcaagagatctaccccccttggcctcccaaagtgctgggattacaggcatgagccaccgcgcctggcctatgtccattttcaaagcacacaggacacatggcagtatctgtcttttcccttgatattaaaggaacttgagtgtagggatatgatcacatctgggatttggggaagtccctctccaggcagctggaggatctgagtccctggccaacctcagcactgagacgggccgctcagcgaggctggagttgagccgccgctgtgcagcacagaacagggtggggcaggagctggggcagggcctggctgggagggagccaggcagtgcaggagccatcccctgccatactttcggtccagggcagaagcacaggaggccaatgccgggcctctccccaggcatggtcagcagggaaggtgcagcaggaggaccaggaacgggaggcttgggtgcttaacatggcttcttgatgtgtgggccttgaggtttcgctggaggggaggatgtggagccaggatggttccacggcctgagggacacgtgaggggatgaaggactgcaggccgaagtgagtgtcaggtgtggggcctggggggctacatgggtgggttggggaccatgcagggcagagatcagcagaggggtgacctgaagattggccggcggtcgtgggctgtgagctgaggaggctcaggtagctggaatgggaacccctgcttgacccttcgggctgggaggggcagtggctgcagccccttgggagtcagggtgtccttgtttcttctcagccaggtcatagaggatgcaagccacaggaattcccatagcctttgtgtgtgtgtctgtcttctacctggaaaacagtaagaatactttcctgttcttttcttgtaaaagttcattaaggggctggatgcagtggatcatgaatcccagaactttgggaggctgaggcagatcacctgaggtcaggagttcgagaccagcctggccaatatggtgaaacaccgtctctactaaaaatacaaaaattagctgggtgtagtggcacacacctgtaatcccagctacttgggaagctgaggcaggagaatcgcttaaaccccggaggtggaggttgcagtgagccaagatcgcacatcgcacttcagcccaggcgacagagcaagactctcaatcataatcaatcagtaaagctgatgaaaataaaaaagcctgcaaattaatgtaggcacccaggtctccttaaatttagaatcctttcctcaaaagtctccgttgatacagaaacacttttgaagccagatgtgaagcaccagttgacccgcaggtgggggtgccaactggtaggctgtagggttagctctggcctctggcagccagccagttgtctcctaagaaaatactgtggcgtgaatgcaaaatgtgattcatcacttggctcctaatttcttttgattttgtcccctagagcaaggtccgtggtcctgtcagtggaagcccggatagcatgaatgcctctcgacttagccagcctgggcagctgatgtctcagccctccacggcctccaacagcttacctgagccagccaagaagaggtaggtcctccttagcagtgccaagtgtgaccatcaagggcacgtcaggagatcggggatggaggcgtttgtcactggtaaatgtctgtctgatggtattaccacctctctggatgtttgttgcatctgctgggtcctgtggggacaaaagtgatacatgtttggctctcatagtcccttgaaacttactaactagtttctttgtccaaggcttggatgactaactgcttaatgagaacattggaaatgctggtcaggcacatgctgttaccctttatccataggaagccacattcccttcagggaggccctgaagccatctgcccccactcaccctaccagtaccttgagttaccgagtcaccaccctcctcccggtgccactgaccttcccattcttcccgtcctctccctcctcttgcctgaaccatcgcagcagaggtgggggcagggctttctgcctcctgcctcctgcctttctgctgccaggccctgtgtggttgaattaatcttcacgaaataccactctgaccaaggtgttccttagtcagtcataaataacagcttctccctccattatagatgctcaggtctgagctttcgtcaagtctcatctgggccagcagtgcatcatcaaattctcaggtcctgctggagacctcacttgagagctcagggttggggcccagcagtctgtgtctagcagccctccgcccgttctccagcacactgcaggccacttctgctcccacgcccatctcttcctgtgttttgttttgtttgacaccttctgtgtgcagggctctatgggttcctgcaggctaatctctaggcatgggaaacaccgatgattacctggggcaggggaggaggttgggagtgactgataattcaaggtttcttctgaggatgacgaaaacattctgaaactagatatggtgatggttgcacagctctgtaaatacgcgaaaacccttgaattgtacactttaaatgggtgagctttatggtatataaattatatctcaatacagtctgctttgaagaatcttgttcttgtccttgggagtttgtagcctcttttggtgtttatgtgaccttggatacttaattttctcttggctgtatggcacgcgcttgtaatcctagcactttgggaggccaaggcaggaggttcgcaggagttcgaggcaagtctcctgggcaacatggtgagactgtctctctctctctcttttttttttttttttttttttgagacagactcttgctctgttgcccaggctggagtgcagtggcgcgatcttggctcactgcaacctccacctctcaggttcaagtgattcttctgcctcagcctcccgagtagctgggactacaggtgcatgccaccacaaccggctgattttttgtagttttagtagagatggggtttcaccgtattagccaggatggtctcaatctcctgaccttgtgatccacctgcctcagcctcccaaagtgctgggattacaggcatgagccactgcacccagcctttttttttttttttttgaaatggagtttcgctcttgttgcctaggctggagtgctatggcacgatctcagctcacctcaaactcagcctcctgggttcaagcgattctcctgcctcagccttccgagtagctgggattacaggcatgagccaccaggcctggctaattttgtatttttattagagacagggtttctccagcctgttggtcaggctgatctcgaactcccgaccttgggtgatccgcccgccttggtctcccaaagtgctgggattacaggcgtgagccaccgcacccggccctttttttttttttttttttttaaataaaaattatttccccaacctctcatgagctcctggagtatagtagctagaccgggagcctgttccattcccttctggggcaggcactgagcctttaggctagctagaggccccatagatgaggcttggcagaaatgtgctctgagctcctgccatcagattgtcacattttgcagagtgagaggagttccagggcagtcttcctttatgtggcttattcccttcagtgatgtcctcaaaggtctagaaaggtggacctgggtatataggatgtctctcgtctccccacagcatagagctgaggttagaaaaagacggatgttttactacatgctgctctttttcactgtggcccagtcctcagaggaaacatgggtttcttattatagaaaagagagagatcagattagatggaaccaaatcccagaacttgattttcaacagattccaaggaactgtgaaccctgataaattccttggccttttttttgtctacttcaaaaattggaaaacaggtgatttggagaatatctttagattttggcagtttgaaaattaaattcagctatctagtaagtcagaaagcagaaagaggtttttttgcttctgacttttattgagatctgtttgcttttttgcattttggacagtaacgctcatatgtggaaagtgcataacaagatgaatgaaagtattagtcaatgggttggtgttttaagacactcaggatcaaaataattgttacttcatttaaaaagtattatcaaaactctctagcatattttaaaacagcagtgttagctctgataactaataatgaccactttctaataatttgatcattttctttagtgaagaactggtggctgaagcacataacctctgcaccctgctagaaaatgccatacaggacactgtgagggaacaagaccagagtttcacggtaacagcttgtgtgagactcctgcgattccatgtcctttctttctatggcaaaatagaagagaaaatggaaatgcaatctggcattatcctcaacctcagtgtttgtttgtttgcttgtttatttgtgacagggtctctctctctcacccaggctggagtgcagtggcatgatcttggctcactgcaacctccgcttcccgggttcaagtgattctcatgcctcagcctcctgagtagctgggactacaggcgtgcgtcaccacattcagctgattttttcagtgtatatttataattttctagtacacattttttattattcataataatagtgatgtctaacaattattgaaggcttacaactacatgtatgcattatcttatttaatccttggaacacttaattccgatgatgaggaagaaggtagcattgttcccagaagcctgtccccacctgcaccattggtactactgctgagtatttgtgtgttgagtgctgggctgggagcaggaaccagccatggccttgtcctcagggccttggagcttagtggtaggtagtactagttatgagaaaactagccaagttacaggtacattaagacaaagcttccattgttgagagaatcctgcatcatttgcttagatctttacatggcctttacctgctaatcacttgctaacctcccctaactttaagcttttggaagaattacaagggataccactgtgaattgcagcctttgctgatgtagtcgcatgtcctcctccagtctgtggacattctatatctcttgctgctctcctcctcctggcatgataatgttttgatcagttcattgcttacttgcatgtctgtgggaggaagaggaagtctcatcaggccaagtcatgtggtgaggctggaaatccataactgagattagctacccacagtgagcatgggagtgagtgctgtgagccacagtggtactgacatcgactttctaattcccacagtcacagaatctcaaggactctgagccaattcaaagaaaagatcctgtacagtttgaatatgtaacttagcttaagagtaccctgcagtcacaagatttattaataaaagggtttggctttttaatttgtatttgtttaatttatttgttttatgcagcctgggtcttgctatgttgcccaggctggtcttgaactcctggcctcaagcgatccgctcgcctctgcctcccaaagtgctgggactataggcatgagccaccatacccagccaataaaggggtttcaatatatttctttttattttttattttttgagatggagtcttgctcttttgcccagggtggagtgcaatggcacgatctcagctcactgcaacccctacctcccaggttcaagtgattctcctgcctcagcctcctgagtagctgggactataggagcttgccaccacgcctggctaattttgtatttttagtagaaatggggtttcaccattttggccaggctggtctcgaactcctgacctcatgatctgcccaccttggcctcccaaagtgttgggattataggcatgagccactgtgcctggctgggttttagtatatttctcaattgtcctgatttcctcctgaagaggaaaaataacctgaaatgtgttggtggctgttgtttttttaacatgtctgttgactttcaggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaagaaaaaaaatggaaaaaaaaaaagtttatggctgaaacagtgtaattgattaaaaagtgaaaatccaggccgggcgcggtggctcacgcctgtaattccaacactttgggaggctgaggcaggcagatcacctgaggtcgggagttcgagaccagcctgaccaatatggagaaaccccgtctctactaaaaatacaaaagccaggcgtggtgggacatgcctgtaatcccagctactcgggaggctgaggcaggagaatcgcttgaacccgggaggcagaggttgcagtgagccgagatcgtgccattgcactccggcctgcgggacaagagtgaaactctgtctcaaaacaaaaaaatttgtaaaactgatcccacaattccctacatttgtaacttttaaaattcagaggtaaatacatttttatttaaggaggaataattcttcagagcaaaataatctgaatatcacctggaatagagattggacagaaaaaagtgtgaacagggaaaactaggacaagtcatatatgtaaatgagagtataaagagtaaatgagagtggtcactgctcactgcagcttaactaatcagatagttaagttgcaggcataaagtttttttaacttttattcctcaagtaataaattgaggaaaatacaaatatgtacaaaatttttacaaaagctatccataaaagggcaagtagtaatatatagaaaagatctaccagattagtaacaaactacccccattaggaaaatggtaaatgatatgaataggaaattcaaaaaaagaattacagatttccaataagcataacttaagatatacactgatattgtaaggaaacacaatcaccacaaccttgctaatcaaagaaactaatgatatttattggaaaataatgggaatttttaatagactgggttagaagactagaagtgtacgtcccaaaatattaatagttcagctgtagggtgagatcactgattttaattttctccttttatacatttttccagatttctctacagcaactacgtatcattttgtaataaattttaatttttcgatgcacaaagcaattgcctggaattgcagttcgatatgaacccaggagttacgcttgtaaaataaactattgctgatgtgacatttccatttctcaagcagactgtaaatttctcagatgtaggtcatcatgttataattagggttccattgctcatgatctagatgaaacacttctccctttcttgtggtctcttcattaatttggtccctaccgcaaaggcagggggattaaaaataaaatatcttttgacactggttggcaggtgtactaacacgtgtgcgggaggattcctgttctcggcatggttcacgccgggctccggcagcgccctagtacgtaaggggctgcactggagtgtggactgcccggtatccttagagaaagttttgacagtgtgacgccagtgtcgcctctaaccacgtacaaaacgcgccatgcattgggtagctattacagtgcacatttttgtgcaggaagctaccccaccagcgcaagtatttcagaatcaagatcgcactcccgtttccccttctagggaaaggattccagataaacactgagaaaacagatttaatatcttaggtcaaaactccaggtcttcccataggaaggcccctgggctgtcattctgaggtgcctatttcccccgcgccgtgtccacgtccacgagtccacgaaccctccgagttctctctcctcacctgccgagggctcgcccctctagccccgccccgccccgcccaggacgcgtgacgtcacaacaagcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacaggttagcaccgggccgggccccgctggctttcttctttccttccagcctcttcccctgccttccttctctcccacaccgacagtccagtgggtagggtaggttccttgcagcgggtcgtcttccgtggggatctccctccggcgcccctggctggttgtcagtcctgccggctacacctgggccatcgcttgggctgcttttggtctggcccttggaggaaacgggtggtcactgtcttttagaggctgccatatccccttccagaaaacagttctcgtttgtttactcgtggttcttgttcacccgagccttctgttgcctttcagaactcgcaaactttgagaagaacgtgagccaagctatccacaagtacaatgcttacaggtgggacagtgcagcattctcgggtagcatacgttctgggataccctgtttagtgtggcaattaacaggactgagggcccagtggatatttggtccatctgcaagagcgggaaaaagcaagaatcgaggctggtaccttactatttcttgaagaatgtgggcagtgcgttataggatcagttcagataagttcccaattctgattgcagatagctgtagcctgatacgtattttgtcatcatcaaacatgaattactagaaatgcggtgtaattttaaccgtaatgaaagacagcggatgaagtccatactgtgaaatatatgtggttcaaggaatcacattttttcttttggttggtctaaagttgatcctgtgggatcctgatcctgatccttgttccttgttcatgggatcctgtccttgttcatctcaccaggggccttatcctattcattctttccacatccacctgcttctactccttagcctatatttatttatttatttatttttatttgagacggggtctcgctgtggtatgatcatggctcattgcagcttcaaccttccagcctcaagtgatcttcccatctcagcctcctgagtggctgggactactacaggcgcacgccaccacacccagctaatttttttttctttctttttttttctttttttttttgtagagaccgggttttgctatgttgcccaggctgatctccaactcctaaactcaaatggtccacacaccttggtctcccagagtgctgggattccaggcatcagcctcggtgtcagctctccttagcctataaatatgtgcaagtccctcagctcttaaaagcaaaaccaaaacaatcttaacttccctctagctagcaccttccctcttttctcactttatggtgaatcttcttgaaaaatcttcattccttgcctggacttcttaatacctaatcatttactcaagaagtcccagtccttgcctggacctaccagtgctctgaaaatccgctcacctacgtctcatcttattggactctctgtggcattcacccctggctcatgctgtgaatatctcttgacttctgtaatggcactctttctggtctttcatctcttcttctgtcttaccttttaatgttggtataggttgagcctccctaatctgaaaatttgaaatgctctaaaatctggatgattgccgacatgatgacacaagtggaaaattccacatccgatctcatgtagtaggtggcagtcaaaatggtcaaaactttgtttcatgcacaaaattattaaaacgactatataagattaccttcagggtatgtgcgtaaggtgtgtgagaaatatgactgaattttgtatttagacttgtatctcccatatccctaagatatcttattatgtatacgcaaatattccaaaccctgaaaaaaattcaaaatctgaaacaatgctggtcccaggcatttcagataagggatagttaacctgtggttccggggagtctgcctgcccttagccctcttttcttacttctgtagtttccctggcaatcttgccattcttgactttgaaatgccacttatgtcagtgactccaaatctgtgtatcactggacttttttccacatttttagccctatactgtctttatcccaagtcagctcccttcttccattcccactccacacagttcagagctgattgtgctccctcctttccttacttctgtgacttcctctgtaaagtaaaataattgtattatcatccatacatttgatgattcaaaattacagagatattcaactttgtattctatttggatcacagcaggtctcagaaaggaggtgtttagtttgaagaagctcatcgggataagtgagagggccagcagtctagacaaataaaatgtgccaaagcattgagacatgaagggtataacgttttctggaagtcagatgttcagtttgcttaacgggtatggtatgagtgggaaataagtctggaaaagcaggtgattccctaccactcctgcatgctcctccctaccccagtagacatttctgttgattgtggccaaagtattcttttgaaaatagttatctgatcttgtcagtcaaataattaaataatattttctctttaccttgataaaacccaaatacatcatagcatacaaaaggcctttcatctgattcttcttcccttttaggctttgcctcacagtgccaatgacctggaactacttgcctttcctgaaatgatcccctccataaactgtgtttgcctgctcctttacttataaatatgtcttttcagattcatcatcagtcatgtgcttagagagaagttcaaatccaaatataaagggttatttgtgctataacagaatgcaaatccaaggttccaaagactatccagtgtttatgcttttgacttagctgtactgtcacttctcatcagcatcaactctgaattacattttgcattgaaattatagacagaataccgtcagcgagctcccagggtgtatccaatctgtcaccagattaacaaactggatatgtgtggaggtgggcaagaattacaggtcaccgctttatgctgaactgcagtgggaacaattttttttttctgtccataagtttattgtctttatctgaaaaatcctcgtagaaaattgtttggtttagctctcagcagccccctcctgagccgtggggaagcttgccttcttttgagctatgcgatctttcttctgagcaagggacattttgggatggttccacctctttttaacttctttcttgagcttcttttcatagactggattctctcctatagcagcatgagctttcatctccttcatcatgtctgaagttatgctattctttatgtattgagagaactgtttcttgtaagcatctttatcttccattaagtagtgcatgtaatctgcaacattctggcctatgttgtgcttctggtgtaattctgcattgaattccttgctttcagaatcataaccagggaatcatttggtactttgagggatagacaagcctccatccaggtcaccaaaaactttattgccagtggtagttctggcaaggcctgcatccaaatagcaggtgaaagcacctggctgaccatcaatgctttctacattgtattatcgccagtcacctccacttggccttcatagatcttgtccatgccaaacctattgagaagcctgtgggccagcagcaggccagtacaatatgttgcagcataatttgtcaggccaaccttcacaccatattttggcagttcgtgtgcatatgctgcgcagactatcatatccccctctatacgggcataagcaatctgacaattgatatctctgtttgttatatgaactatcatcctctatttgggtgtgttgtatttatttttatcctgtattaccaagcgtttctgagcatagtaatcagttttaccatcttgtcatctttaagtttcatttggtatctcttaaagtaggccttattcttaacaactttaacaaagtccatcctgtggaacagagacctgcaggcccagcagcactagggggtggaaaggcgggagcaatttttaaaaactgatgtaggggccaggcacagtggctcacgtctgtaatcccaccactttgggatgccaaggcgggtggatggcatgaacccaggagttcaagaccaacctgggcaacatagcaacatcccatctgcattaaaaaaaaataaattgatatagggacataagggaatgcagtttgaaactatgaattttaaaatagctatccaagggctgcgtgtggtggctcatgcctgtaatcctagcactttgggagaccgaggcaggtggatcatttgaggtcaggagttggaaaccagcctggccaacatggtgaagacctgtctctactaaaaatataaaattggctgggcgcagtggctaacgcctgtaatcccagcactttgggaggccaaggcaggcagatcacgaggtcaggagatcgagaccatcctggctaacatggtgaaaccccgtctttactaaaaatgcaaaaaattagccaggcgtggtggcgggtgcctgtagtcccagctactcaggaggctgaggcaggagaatggcatgaacccgggaggcggagcttgcagtgagccgagattgcgccactgcactccagtctgggagacagagcaagactgcgtctccaaaaaaaaaaaaaaaaaaaaaaatatatatatatatatatatatatatatatatatatatacacacacaaaattagccaggtgtggtagcatacacctgttatcccagctactcaggaggctaaggcaggataattgcttgaacctgggaggcagaggctacagtgagtcaagatggcgccactgcactccagcctgggtgactccatctcaaaaaaaaaagtaacataggtatccataagcagatctggtgtctaataattcaaatgtggcacatttttatgaggaagttatgaacaatttctaaaaactagctattttaaaaagggcccaatgatgatttctacttactcccaaagaaagacagctggtctccccatcccttgagtattatgtatacagtttaaatcactttgttactcagcacaaatcaaaacaaatcactttgttactcagtacaaatcatactctttgacgtatagagtttaaattcagttattctcaaatgtggagcttttcaagatactttaaaagttagacgtaggccaggcgtggtggctcacgcctgtaacccagaacttttggaggccaaggtgggcagatcacaaggtcaggagttcgggatgagcctggccaacatggtgaaaccctgtctgtactaaaaatacaaaaaaattagccagatgtggtggcgcatgcctgtaatcccagctactcaggaggctgaggtaggaggattgcttaaacctgggaagcggaggtgacagtgagctgagatcacgccactgcactccagactgggcgacagactgggcgagactccgtctcaaaaaaaaaaaaaaaaaaaaaaagtggccgggagtggtggttcacgcctgtaatcctagctggttcacacctgtaatcctagctttctttgggaggctgaggcgggtggatcacctgaggtcagagtttgagaccagcctggccaacatggagaaaccctgtctctactaaaaatgcaaaaaattagccaggcatggtggcgggtacctataatcccagcaacttgggaagctaaggcaggagaatcgcttgaaccccagaggcggaggttgtggtgagccgagattgcgccattgcactccagcctgggcaacaagagcaaaactccatctcaaaaaaaaaaaaaaagttagacatatattaggtggtctgtcagctcatctgagttttaagttccatatggaggtagaaaattaggccaggcgcagtggctcactcctgtaatccccgcactttgggaggccaaggcaggtggatcacgaggtcaggagatcgagaccatcctggccaacatggtgaaacatcatctccactaaaatacaagaaggcgcgcctgtagtcccagctactcgggaggctgaggcaagggaatcacttgaacccgggaggcggaggttccagtgagctgagatcgcgctgctgcactccagcctggcaacagagggagactgtctcaaaaaaaacaaaaaaaaagaaaattagttatcttggtgaaagcataagcatagatatttgcttgtatatgtattccagtttaagaaaaattaaggccttgatggatttctaattggttttccttttcttctttccttatagaaaagcagcatctgttatagcaaaatacccacacaaaataaagagtggagctgaagctaagaaattggtaagtttagttagcatgttgatcgaagagttcacacgtgtccaaatttggtgggttcccaccaaaccaaacttgcctgtctgaagcagccttgacccacacaggctgatttcactactcctgatttcttggaataacattcatgctgtttcatacacactttttcaagctcaaaatgttttcatttgggagaagatgggttaaaatttttaaaaatatatgtaattacagttttctttctctctgttacaatatatacatgtactcacgttgaatttcaacttgagtgttggtttttaagaagagtgaccaagtggcactagcatatctggtcccacctatttttctctgatccccaggtgtaggaacctatgtgagttagtgggagtgcgtgttccccagagagatcttactaataagcacatgattaagacccttttgttttatggcatttagccctgttctctgtaatttccacgaagccttgtgtactgtgtcacagtttctagagggtcacatgcctcgttaatttgtaatataataccccttatctgaaatgcttgggaacagattattttggattttggattttttttttgaatatttgtatttggttgaatattcctaacccaaaaatccgaaatccaaaatgctccaatgagcatttccttttgagtgtcatgtcagcactcaaaatgcttcagattttggacattctggaatgtggatttttggattagtgatactcaacctgtaatatcactgagaatatcctgagatggtctatctattgacaatcagattgttgtctcatctaaatcttactaaatgattcaaagttccttaaatttaaggaccatatcttattcatcttttgtgaaagatgtcaaattatcatggcttttttgtttgttggttttgagacagagtctcaccctgttgctcaggctggagtgcagtggcacgatcttgggtcactgcagcctccgcctccagggttcaggtgattctcctgcctcagcctcccgagtagctgggactacaggcatgcgccaccatgcccagctgatttttgtatttttgatagagacagggtttcactgtgttggccaggctggtctcaaactcctgacttcaggtgatccactgccttgagcctcccaaagtgctgggattatagtcgtgagccactgcacccagcctgagatgccttttgagtagtccaggtcctgatagttatcacctccttttgttctttacctattaatgtttcacaaatgtcctctggaatttaagaattaatatttgattatcttttaaccttctcaggagatgagccataattgcccttttttttcttttttctttttttttttttgagacaggattttgctctgtcactcaggctggagtgcagtggtggcataatcacagcttactgctgcagccttgaccctcccagccaagcaatcctcccacctcagcctcctgagtagctgggactacaggcatgctccatcacactcagatattttttttttaatttatttcttttgtagagattggatcttgttatgttgcccagg

SEQ ID NO: 1757 - DNA, 4154 bp, Homo sapiens
gaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctgagaggagcagctcaggtgtaccccctcctgttgctgcaggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaa

SEQ ID NO: 1758 - protein, 769 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLRGAAQVYPLLLLQAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 1759 - DNA, 28027 bp, Mus musculus
  misc_feature (1)...(28027): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctgtcttgaaaaacaaaacaaaacaaaaaaacccaaatattaaaaacatcatttttaattattgaggctatacacttgtgagttcaggttcctggaggccttggagttataagcagtcatgaaccacttgatgcaagggctggatttgaatttgggcccttggcaagaatggtttgtgctcaagggaaaaaggtgtggtgtaataaagcaggacactcaatggccaccagcctctgtacatgtgcgtgagacatacacacacacacacacacacacacacacaccacatacactcttacatgcacacaaagagctggagcctggaaggccatggcccaccaccaggctgcttccattccaggtcttgtctgccaggcttagagtaactggcatatggtgtaagttggtgggacaggtggatatgcaccttcaagaaagggcctgctgcccagataacttgtcagtgtacagctgttagcagctgcaggattcgtcttggctttcagtctcaagccatacttctctagtggctgaagaaggggatgcagtagggtttccccttagtggtgctcctctggcaggtgacaaagctggaaccttgtattaggcagtagtcaggtctgcatcctccaacactgccaactcaagcaggtgagctggcccagggacgctggtccctatgggttccttttttatccccatcagcctgacaggcaagtaccagggggtggtggcggctatgcacaggctaagcagcacctcttgggcctggcttctctgacctctctataccacacagtcctgccaagggcatcacaaaggccatgccttgaacacgtcctaaggagttgtgaggtgggctcggggaagaggtagcagggtaaagttgctgttctcataagtcttgagagggctgggtggatgtacagcagtgccgggcaggcgagggtgtgtgcagctgtctggctctcctgggtggggctgggtgaaatgtttggggataggcagtggctgtcacatggtctagctgcaggtttgggaaggaagccaagacacatctgtgtgccagacacatctaatcatttactgggttagggaagcagaaccgaattgggctctagagaaacttctgccttggtaccagatgtacaggagagaaggtgacgcttggaagattttcaaaggctgtacttggcacttggtggagaatggagcccaaaggcatggaggggagtgggcagggccgggccatcagactgcaacacggagatgcaaagggagcaagaagtgtatgggtggccaggtgactgagaccccagacactgcaaccgaacatgtcaagcctggcattcccctctccccacgggagctgaggcagggttccacatctttcccatctacccccaaaggttcctcccctgatttcctgtgagggaagaagcaggtgatcttcctgcttgcgtcacccatggccaagggtggcagggcaaagcagagagaacgcctgctctcagatttcctttctcgtgcctgtgaaatcacacaggaaaacaaatacagggagggcttcagtgtagcccagtagtagaaagctttatgtcaggcacgacctatgaaagctgtatggtggtgcacgacttcaatccacaagctcaggagacaggcaagcagatgtctgtcaattaaaggccagtcaggtctacataacaaattccagatcagccagggctacagtgagacccaaggaagtaaatatatttagtgtgggtaaagccctgggctcaatttccagtaagcccccaaataaaagcatagtaacagcaatagaaaatgtcttccctgccgggcagtggtggcacacacctttaatcccagcacttgggaggcagaggcaggtggatttctgagttcgaggtcagcctggtctacagagtgagttccaggacagccaggactacacagagaaaccctgctggagggggggggggtgtcttccctaagatgtttatggatgaaatgctgttatctggaatttgtttggaaacaacccaggagggctgagggtgtagctggggatatactttggtacagaggtttatcagatatgaggccctgtcttcctttcttaggaaaaggggataaacaaccacctgtacccccagccacttggggtgctgacgtaggatggcttgggcctagggctgctagttgaaggttatcatctacaaagaaaaaccatgactttcacgtagcccaggctggcctaaactcatttgtagtcaggaacgacacataagaatccaaggtcactttattgagctgatattttccctttccttttaaagtactgaggtaaatacacttaatataccaagtgccaccatcttaccccgctggagtgtgctcagtagggttgagtgtgcccgacactgccttataggccagacccctaccccaggtcctaaacccttgagagcctggggcccaggcttccatagcgatggagcaaagtgctgtggccacttaggctggcagctcctcctggactggctggtccagttctctctgtggcctagctgggcagcctggacttccggggccgggtctcacccttgagtcctggatggctcctgcaggtctgagctgcgggcacctgagcatgtcctggcaggtctcagcttccacccacagcctgcctggggctacccaggtcaccaggtcaccaagggaggaagggctgcaggagaggagccaagtgaaggcgcctcccagctctgtcggctcaggcagggcaatccaaatctgctttcaggccaagatgagagggaggactggacccaggagaaagacagtcacctatggcccacgaggaagctgcggtatcgagcagtatccgtcagccagctctttgcaaagactggggtccttagtggcctccaacagagcccaagtcttctctctcaggttggatgttggctcagctccaaggggacaggagagagcaggaaggagggagggtgagaagtgaagggtgggggctgcagggctgtcaagtccctgtacatcacgccagttcctgcacctgagtgaacttaagccagtgatttatcctgttctacaaagccaagaatccagggctcagaaaggtcaccaggcaattacaaaaccagggtccacagcaagaaccacctctccttgttctcctcttccttgttagaaaacagccacgaagttcctttggggggcagacagtgcattggagaggagcccggccaactgtcaggccccagaggagactggagtgaaggcaagacatctctctctgccctcctaaaagatctttgttggtctactaattaagatatccttagacagatgaagatgaggaaagctggggcgggagaggtgcacggcgattaagcacctgctgctcttacagagaaactgagtttggttcccagcacccacatcaagccatttaaagctgcctgtaactctggctaacttgggtactgcatggacatgaggcacatacacacaatcaggcacacacgcctacacagcatttctcttacaggaagaaactggaggtgtaactcagttagtagagtgcttgctgcgcatgtacaaggctctggactcaatccccggtaccagggctgggcatggtggcaaacctctttaatcccagcactcgagaggtagctgcagaaggatcagaagtttgaggtcttctgttagccacaagctatgtttaagtccatcctgaggtgcatgggacctccatctcaaaaaagaagaaaaattgccaggtgtggttgtgcaagcctttagtcccaacactagggaggtggaggcaggtgaatctctgagtctgaggccaaacaggtctacatagtgatatccaggatatccagggctatgtagagacaccctacctcaaaaacaaacaaacaaacaaacaaacaaacaaacaaacaaacaaacaaacagagaaaacctgtggttcattgcaaaaccgttggtgctatagaaaagaatatgggctctgggctcccgggatggaaggatggctaagcgacaaattttgggaaggtgaacggaggagctccatagagattaaacattgtcttgatctttacagaagctagacatggtgggggcacatctgatctgtaatctcagcactatagaagcagaggcaggattatgacttccagattaatctaggctagagagcaagacccggtgttaaaaactaaaacgagagctgcccagactgttcactgggtaaaggctctcctgcttcctgtccccaggcctcaattcaaaggagccagcatagtcaagcgtactgtgttaggatggcgtttccaaaactccttcaagaccttgggagaatctgtactgggcacctatgtgctcagggcttgttattttctgggagtgacaagacaggacaagtgacccagtgataagggtgcatggtgaaagagccactggcagggaagaggctgagagtggcaacactgtgatcaattttatgttgagggtgggaagatggactctgaagatggtgggtcacccccaaaccagccagttacaaggaggaggctgagacagcccccaagatgtaggtggcccggaggcagtagctgtgtctaagcctgagggggtggcagggccagtcttgggcctgagactctacaacacaggcttcagatggctggagacaaatgtgtgcgctataagtttcctctcaggcaggttggagaggagcctaggaaggctgttgcaactgtcaagaggagaggtgacggggccaggggtgacagccagagagcggatgaattcctattcaacatgggtagccctaggacccttactgacttgggcacttgcaggcaacagataactgaaggaaatcaaattgtcccagggtagccaattcaggaaataggtacacccagggaatctggtttcacttcagccctggcctggtgccccaagtgcctcactccttggcattggaaccacatggcttgcatgtcaaatccatagttctgtcaaatgtggggacaagatactcacgtatgcgtgtctgcatgatgaactcaagaggcagacagttcagtgggtacaccccctccttgaggccagctgcctgcacgaatctagtctcgttcatgttgtgaggcgagcctgcgatgggagggaagcagcctgacctcttgatggcctctgatccccaactctgtccagcccaccttctctctaagacctcagaaaggcagaccctttcaggccctctagctctgaggtgtactttgggggtggtagatcatgtgccccccactggacgccccccaacttttttatcagagaaagctgaaccaaggacatccaagagtccagtggcatgtcccatgccttgttgacacagaggaaggcataaggggggtaggggaagagaaggcactggatggtgtctccacctacttctctacagggtcagctggtcctacctgccttgccatttcctatcaaggtaacaagagtaacaatacacacacacacacacacacacacacacacacacacacacacacacacacacaaagagtaacaatacgcaaaggctcaaaagccaggcagtatttgtcgggccagctcctccctaggggcaggacagttgtcttagcagtctgtggagtccccagcctgtgcaaaggatggggacaagtagcctgcctcctgatgtccccttgcttccctgaatgacatctttgttgagaggttagcagcaggctctctccctccactctagcccctcagatctgcatcccagccaggatccttacctgaaatgccagttctgagtgttctgttcagccaggagcctctaacccagtccttcctgctgggatgcccgggatacagccaccatccctctcttctgatagcctggtaaagggaaagaacactggagggggagggaagaaggaggaaaccagaacctggataagtcactgcatttgcaaacatagaaggggatccaggaaggggagggaggtggccttgggtgtcactgaacctgactcacttagagatggggcagctgaaatggttcgctgggcgaagtctttgctgtacaagcccgaggacctgagcttgatcctccgaagccatgtaaaggtagagagagagaaacagactccacaaaccgtccactgtcctccacctgcacgcaaatgcatacacgtcaacatacaacaacaaacacacacacatacacacaccaagaataacaacagcagtaatcattgctaagtatttacagagctagggaatttgtaatcccagtatttagagtatggaaagcaggaagatcaggagttcaaagccatcctctgctaccaaatgagttcaaggacagcctgccctacaagagactgtttcaaacaaacaaacaaacaaaaaagaatttagggggctggagagatggctcagtggttaggaacactgcttactcttccagcacacacatggtagctcacaactataactccaagatcggacaccttcacccaggcatacgtgtaggcaaaacatcaatacacacagaataaaaggatttagaattagttttgacttttttctcctcaagaatgttctcacctcttttgcctgggtgcccataacccatcctccccgcttctgttggcaagcaagacttgtgtgcacagcacagtgcatagtccagccttgtgcaaccttctccttagccagacagataaactcctgatttcccttctctctctctctctctctctctctctctctctctctctctctctctctcagataaactcctgatttcccttctctctctctctctctctctctctctcaatttatatgagtacactgtagctgtcagacatgccagaagagggcatcagatgtcccattacagatggttgtgagccaccctgtggttgctgggaattgaactcaggacctctggaagagcagtcagtgctctttacggctgagcctctctccagtctgatcttcctatttttctaaactctaaatactgggattacaaatgccctaactccacaaatacttggtaattattattgttgctgttattcttgtgtctgtattgcagaggctctgcaggatgatccatgaggcagttctgggacaacacctgtgtgccacctttggggaactctccaggccctggcctcccttcagagctcctctacatctgaacatgtccagatttctccagctctgggcctcagaaccatgaatacacctccctgaggaaacatttgaattctgggcttctgtcaggctacttgcccagagaggcatttcctcaggtccccaagaccatacgtgtgctcttatggtcaatgttcatctgtctcaggcaaccccgctcccccatatacctgcagtccctgcatgactgagataccaagtgctgtgaatgaggtttcttaaagagaaaaatccattgttaacatttgactacggtagaaatagaaaacagaggcggcaaatcggtacctgctgggccacagtaatgttttgttgtttaaatgaagttgacttgcctgatacaaaattatccattttaacttaaggtactgggaattgaacccagggcctcaagcagcctctgagagaatgctctcctactgagtcacaccccagccctctgtaagacaatgtaaaaggaaagtgctgtcaccaccacctgattccaggacaaaacccgataacttgcaaggatcatcctcatttctccctccctgtggcttctagcactagcctgcattctgtccataaaggttcacacatggtctctgctgggtttctttgacttaccatcacttgttagaggtttgagttgtagcatgaaatggcactatgccttttctgtggtaagtaatattccactgtatggttggaccacactgtttatcctttcactaattgctggagggtttgacctgtgtccttcttttgactgttatacacaggattgctatgatcatctgagtgcaagcacttgttggcatacctgatttctttagtcatatacccaggagtggaaatgctatcatgaatctgtttaacttactggtttggttttttttttttatcttaaaaacaacaacaacaaaattacgtgtatgtgccagcgtgagtaaatgtgcacccagtgcgagtaatgcccccaggggccgggggtgggggtgagggggggggcgttccataccctggaactggagctgcaaaggattgtgagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttaactttttaaggaagaaaaggtgttccaacttcttactcttgaacgtgtctgagtgtccagccttcggtttccgtccccgctactggcttacccaacccatatgactcatttacactatcagtctggcccctaaaggcatctgaacctgccgcccctagaaggctgcacaggtaaatcaacctccctccaaaataaaagtccagcggctaactactgtagacgcctactacacctcttcggctcttagagcgcgtcttgggtttattctcaaacgaggaaagtggcgcttacctgagaaagaggcggcagagacctgaccaacccatcccagcaagccagtttggaagctggttctggaaggaaaccgggtgaggcgggcgaggccccgagttggaggaggaggagaaggaggagcagcaagcagtgcggcgcgcgctctagagcctcgtccgggctggggtctgcagagctgctgcacgtgagcgagcgaacgagcacgcatcgcggtggccgctgcaccatgcgcggctagcggtggggtcccggccccgcagcacccgcgagcccgggcggggctcaggtcgctcgggggcggtgccggttcccgccccccacatccgggggccgggctgggcgctggggctcgcgccgcgcgggtgagtcaggccgggttttccctccgtctctggggccagcggacgagtgtcgcccagtgcgtcctttgcccgccgatccggctcccgcgcgttcccgaagagcctgggaagagaaaggttcgagaccgagctggggactgcagcgcgccctaggattcacggagccagcatggtaagtgggtagggcgggtcgctgaggtcgttctcggacacccggcgggggttggcaggatgctgtgcgcgccccggtgtcctctgctcccgcgcacgaggctgacctgtaaatgcattttccgtggagcatcgccccgatccccacgccgcagctaggaggggcaggcgcccttggcgcaggagtctgacctcggcctccgccccctgcaccagctctaagcaggccccacagacggcgggcgggagacgtgcaccccaccccgccccctgggtagctaggagggcctccggtagttctgggatcccttgcttcctctacagccttcctgggcgcagttccaccgggatgtccaacctgtcttctctgccgccttcccggggacaccactcacctgccctcaccctcagggtaccctcttcctgcctcagccccctactgtgtctggtcctcacctggggacctgcgaacaggggacgtcccaaggtctgggactctgttccagtcctgactttagcctttgacaaaagtaaggaccaggactcttaaggtatctcagtattaagatgggagcttgggacatacccaacccaaagatacagattgggaatggttgtccttgggcgggagcagaggcgggaggccctcctggacctagagatgagcctcctcccaggctctcacaagcagggcttctctgccgactggctgcgtgtgggtgtgtatgtgcaagactgaatgaaagcgaccagctagttcccgacaccgcctctagcagtttcctgagctcaagagtccctaaacctgcgccacttccactatttcttcttcttacctctttccccagggcgggcaggagggatctctgggaggggggttaagttccatccctctcaaccttgcccttgggagaaacaagcatggggggctgggcaggctacgtagacagcagagtatactagtggaaggtgacccctagctgggacagctgggtgtagtatagagggctttactgtgggaatccagattggtcctcaaagcggagtcttctttcagcgtgtgattccttctttcaagcctcagtttccctatgtgtagatagggtcctttatgccgtgctccaccgactagtgtggagacgatgtgacattgtgaaatagaagagctcagaaacactgaagcactggacatagagcaaaatgtggataattctgtccagggggtagggtatgccagctgcccccatcgcctctcaggctgtccccatttttggagttgggacattccagtgtcattcctctgtggcagctgcaggcacacccctcagaaaggctgatccccccagcaggtggtgtgaccctcccctggggcactctggtgggactagtggcagttcaggttgaactgtaactcctgcctcggggaggatgaggtgccctaacctgaaggaaatgcagtgaaagctgcctcccatactgctgaacatgaccttgggcacctcattccacctcctggatgtgctttgaagaggcatccagggtctggtgctggggtgccccgctgggtacctctatttgaggctttctgcactgctggctgatcctggggccagagggagacaggaatgaaggggtactgctgtggctggatgagtaatggtgtgttcagctccttacagagccctgggcattaagatagacaccctactgtggcagcacagccctagcatttggtggaaacccccccccccactcccactttctgtactgctctgatctcccagaggttatgaggctcttgctagctctctcctacacacacacacacacacacacacacacacacacacacacacatcacaggccagagagcctgcacagctgccctggcccaggcaggcaatcccaaggctcctaagcaacggaaaggaaggaatgtgtgtgttgggggaggggcaggggtaggttgggttctctaggaaaagggttagcctccaaactaagaccagggatggcctcagcccagcaggtcgagcagacagtgctactgagtgagacctggtctgggtgggtgaccttgtataagccatattgtccgttgttggacaggactgtcctcactttggtctcgtaacatacatttgtctacaggacactgttttccgtatgaggccatttgcatagtttggctcacggccacactggttcatccctgagacctgagaccctttttgtgggtaccacatagtgtcagttgtttctcatgagactgcaagcgagtgactgcacacaggaaagtgagggtctgtgtgtttggggtgcaatgggtatatctgacactgtccccagtgggcatccaggacttaacagttcacaaagccctttctcctccgcggcctctttgtcagttatcctgacagagatgacgggggtggggggggggccgaggggggggggagatggctggagactagatcttgttccttgaggagcaactgaatatttcacacgcggtcatgtctatctagctcgtcaaggtgaggcagtgttgaatggggagacaaggtgaccaggtcaaattcttttgattgtgggtgacatcctgagtcctcctagacacttggcagtcctggtggtgctcggatcccgtgagtcttcatcatgaccagttctgtgaccttaggtaggtcattccatctttttgagcctccaagggcttaccttttttagagggatactgagctggggggtggcagcacacgcctttaatctcagcactctgtctcaaaacccaagataaataaatgaattacattttaaaaggagagctattgacgccatattctccttgagactcctgcaaaatgccatgttactgaaagagccccagctccagtagtccctatctcttgagtttacatagcttgtgatatccctagaagggtccgactgttcatatggagctgggctgggtgtttaaactaagacttgcaccccaccttgagtggtgtgttttttaggagcagagcaggccattacagttatttattgcctagggtagagttggctgtggagtgggggtggggaccaggctgccctccctctcccagagagtcctttgtctttcacaaacacaaaacctggaaatggttgaggatggagcctcctaaccaccattgtttggggtgggagtgggtgtcccggaagctcattgggtgggtggcggtgggtactcccagatgcagcctgcctgccagacatctgcctggcactgggagcagctgtgtgtgggtggatgggaagcatataaggtgccattcactgctggttgtttgcacctaccgtgtgctgggcagtgggtgtggcacacacacccgcctcctgagagttaggccccagaacatgtgggagacagttcagaagcctggtcccgtggtgtggagctgaagtgtgtagtgaagctcagccttggtgttctgtgctgactgtggcttcaggccagtcctggtcacattatcttaccccgtgctctccggcatctctacatgataaatgctgactatcgtagcttttctgctcctgaagtaggcacggctcatatgggctaggcatggctaaggtcacaagctgctagctgccagccccggttctgtgagcctggctggtggcacctaacaacagaacacagcgacattataaagtctgtctgcctctcttccctctgccgccgtcactgcctagacctggacacctgttccggaaacagaggccattgttcctccccttaggcccttcctgtgtgtatcaccatccttcctccccttgggcccttcctgtttgtatccctcccactgtatcccgcctgcccccaacctcacccactccagatgtttccctgggggacctctgaccctttgagggaagaggggtttcccacctagagaagccagaaggacagacctgcgttctggttctcagttcttgttccttccccaccccccaaatttgatttagagcccatcagaagtaagcaaggtcatgggtcagacaaaacctgagccaccctctgccctttgctggctcgtttctaggaagaaggcccttgccctacaacttgagggcctcaccttcctgccttgcctctgcattccgcttcagacccctgtctgggagctgtgcctttaggtgttcccgtggaagtcccatttcctttgctttagactcagtctgacagtagtcagtgtaccctttccatcgcttgccatcctgtgactcccattctgttcacacatatctgcttctgacaggcctgggcagagcgagttgcttacagatggcaagtgtctggttttagtgcatctgggaactcgggtactgagtgcccacctgccactaatggagccttctgattcccagaatcagctgcccgagccctgttgaaccttcatggccacaacctcaggccctgctggcattgccatgggcagcgtaggtagcctgttggaacggcaagacttttcccctgaagaacttcgggccgcactggctggctcccggggctcccggcagcccgatgggctcctccggaaaggcttgggccaacgagagttcttcagctacctgcatctccccaagaaagatggcaagaccaccaagcgagcccctcggaacgagccagactatgccaccctctactaccgggagcatcctcgggctggtgacttcagcaagacttccctgcctgagcggggtcgctttgacaaggtgcatctgcgtttcaggggattgggcccagctcagagactgtgatgctggggtggttagctgggaggccctgaccgtgggatggggcagattgaggtgtgggaagtctgaagcctgaccaatgcctccttgtgatactaccctgtattctcagaggggattccctagggccttcgggggcacgaggtagaaaaaagtggccaactcaaccttgctcacacctacgttctcttcctgacagtgccgaatccgtccttctgtgttcaagcctcctgtgggctctgggaaaggcttcttgtccatgcaaagcctggcagcccacaagggccagaagttgtggcgaagcaacggcagcctgcacactctggcctgtcacccacccctgagccctgggcctcgggccagtcaggcccgtgcacagttgcttcacgctctcagcctagatgaaggtggccctgagcccagcctgtcggactcttccagcgggggtagttttggccgtagtccaggtactggccccagccccttcagctcctccttgggccacattaatcaccttggaggctccctggaccgtgctccaaggagccccaaggagtctggacctctggcggtcctgagctgcctgcccgaaccacctcccccctatgagttctcctgccccactactgaagaggtcgccgtgttgcctgaggcccgtgaagagctcaagagggacctcggtgaccaggatgtttctaactcctttactcaggtgaggggacccctgccctggagtgctttgtcccttgcattggtatagggaccagattcatctctgacatctggcataacttgaggtagggacaaaccgtgagcgaggcctaagcatggtatgatattgggggccggttgcgtggtagaggcagcagagaatgagaccagaggctatggccctgatggggtcctttctctcattgtgcttaaggaaagaaaacatcaaacaaaccagcaaaaaccgcctgtaaactggcagtatgactcagtggtagagtacttgcctagcatgtgtgaggccctaagtttgaatctcaccactgaaaagaaagaggcagctccccttagccacccttcaactacatggagggattccatggccccttggtcctgcctgggaactgtgtaggaaggagggagactgtttctgtgagttgcgtgtagtaagaacagtgtggagagcctctttgggtatgaagcgtgtgtggtcaggaccctgggttctgtagcctaggtgcataagacattaatggtggctggctatgggcacaaatgaatgttgttatggggaaggccaagtatggaaatctgagcgaggctgtgcccattgctaaccagttagttcctctttcctgctgcaggtgctagaggagcgccagcggttgtggttgtctgagctgaagcgtctgtatgtggaacgacttcatgaggtggcccagaaagctgagcgcagcgagcgcaacctccaactgcagctgtttatggctcaacaggagcagcggcgcctgcgcaaggagctgcgggctcagcagggcctggccccagagcctcggacgtctgggtcctccatggaggctgaccccaatgctcggccagaggaagaagcccgatgggaggtaggacaccatctgaggcatcccatgctgtctctttgtcctgatcccatgctctattccatcagacagccggccccagtgtcatacagtgtttggcccctgctcacggtttgtcctttaccccaggtgtgccagaagaccgcggagatcagtctgttgaaacagcagctccgggaagcccaggcggagctggcacagaagctggcagagatcttcagtttgaagacgcaacttcggggcagccgggcacaagcccaggctcaggacgctgagctagccaggctgcgggaggcagtgcacagcctgcaggagcaggcaccgcgggaggaagccccaggcagctgcgagacagatgactgcaagagcagaggactgctgggggaggcaggaggcagtgaagccagagaaggggccgagcagctgagggcagagctgctgcaagagcggcttaggggccaggagcaggctctgcgctttgagcaggagaggcagacttggcaggaggaaaaggagagggtgctgcgctaccagcgagaaatccaagggagctacatggacatgtaccgccgcaaccaggcacttgaacacgagctgcggctgctgcgggagcctcctacatcctggagtccccggctggagtcctccaagatctgaggctcgccaagtgtgctgacagtgggcatactgtcagaagataccctgagatggcaggctcctcccttgcactggttggaggcagaatctgtagaggccagatcagggatgggacgcccgccccgtggagggctccagcgggcaatgggatggatagggtacctgctcccgaagctgtggcaaagtcttgctagcagcgaaccacacccagggagggtctagccctgcttccaacagtgggtgtggcctggtaaagtaggttggagccgtccaagcttcagccccacgatgcagaagagcaggagaggaggagggtggcatgtgacctggcctgaggtcttcctccatggaaggagccagggttgggaagattggccacctccagaataaaaagcacgtttttatgaggaggcctagttgataagattgtccttggcctgaggccagaggctcctggatggtcagtgctccaggccttggacctaggctgtagttccttctatgttcccaacaatggaaagaatataccccattgcagtctctggtcttatgtgtttgaaaatggaggaatgttattccttgctcccatacccccacaggccttagctgctgtgtgggctgcaagcgctttcttcgacaccatcggatgtttgagaagaaacaatgccaggggaaacaaaaggattggtcgacaggcatttgcagaacatgaagtatttttctggtgggatgtctggatcctgggtgcccaggcagctgctgggtttggagccagctcaagacagcttcctctgtaatatgtaaaagctcccgtgggctctgccacctccagctgtggtgtgcccctccctccatggcatgggggccagaggcaggtgcaggaactctggtcatttccaggattagcggtagaggcctgtggggtattttatcttgcattagtactgctttgtgttctagagagttctggggaaagagtccctcattctgtacctggtctccaagctgaccttttaaatctccgcttccagctaaagctgatcccaggtccctgaaaccctcagacacccctaccttagcagtggcgagcatcctatgggctttgttccccttgggctagggacggatgcagctgatacctcctttgcctaccacctaccttacctgctttcttctttctttcttgtttgtttgttttggtttttcgagacagagtttctctgtatagccctggctgccctgaaactcactttgtagaccaggctggccttaaactcagaaatctgcctgcctctgcctcccgagtgctgggattaaaggtgagcgccaccatgcccggcttcttctttctttctttctttcctcttttttttttccctttgagtcagggttttgctatgtaggcctatagcccagacggacctgattctgctgctcacctgttggaattaagagacctgttccaccttagcctgccgcctttccttttccttgtgttagacagggtctcccagtatagcccagtctaatcttggactcaaaaatcctgcctctgcctcttaaacgctgggcttataggccttgtatctccacttgggctctcttcctctagagagaaaccacttgctacagatgcgtgataggagtagctacttagctaccacaaacgtacatactgtctgcctggtattatgttgggcacaggtggtcttggggacacaagacaatttcagtgtgtttccctgctctgagtggggggagggagggtctaatagccatttttcttattttgatttttgagatggggtctctctacgtagctcttgtcctgggatttagcttgtagactgtgatcaccttgaactcacagagatccacctgcccgactgaacacagccactcatttgcctcctttaccttccttggaaccattcaagaatcctttgttccgaagtgtcacagatctcttgatctcggtccatgtctgtgagcctctgaggtccagcaagtaggtggcccggtttagatgcccagctgtggcctgtgacacctgatctgactgatgggccccacctttcttagggtgtgtgactgggtgtgtgagttgtttcgtgtgtggaagttgtgtttacgatctgtgagtggcaggtgtgtgtagatgttcttggggatggtgggtgtgtccaagggggggggtgtgtgtgtgtcactttggctctaaaagccagctcctgggtggaagccaggcgcgcttcctgaccctctgccttccattttttcctgactgttccagccctttgtactggtcacactaggtagatccttcatcccagatagtcctctgggagtagcttgagacacgtaggcccacacctgagtcctggttcccaccagaagttgggggttaggtaagctaatccccacagtccatgatacccacttccatttcataggtccctgcaaacaggagtccctgggctactaggtcccgaggaggtctcccctaataagtcagttgttagcctaaagtctgagttacttcctcagcagggccagaagccagtcaggccaggtgcccacgtgcccaccttttggagtacccactccacagtgcagttccccacccagcaattacgacctgggttggccagtagagccagcgggggtgggtgggcggtaccaaaacttggcagtggtgccagaaaccagggccaggcccagatgtagagggggggagggcagcccagaaccagatctcttgttagctcatccttccttggcaaaccagttccctggtccccaagcaggctgggtggctctggggccagttggtcatagaagtcactgtcacagctaccggaggagcccgtccctgctgcttctagaagacccctgacccagccgtttatgtggaaatctagtgagcatctcacacttcccagctttctgcctcagatccctccagttcacacgacatttcttcctgttagcctgtcacttgatgccagcagccttctaggaccttccaacttcagtgatcttggcagctgctcttggctctctggtcagaccactgtgggctgtcccagcccaaaaccaaagttgacaggaggaagacactaatttctggagcctttgggaaagggaagaagagggggtcctgagtaggtcctgagcttgactgggaagatagcttgggctcccttagtggagccccgattccacggtcccacatagaggtagccagcacttgcttgttgcttcttagaggtttgaaactgtagagcccctccactactgtctcccccaggtgtttctagtgctctaactgttcgcttgcctgactccactgggctgtgaacattgccaacactgggttgtgacctccattttgcttccgagtgctccggctccaaccccagaaagtaggggtgagaaaggtggaccatggaagcagggtgaccagactcctccacagtctagcttttatttatttatttatttatttatttatttatttatttattcgagacagggtttctctgtgtagccctggctgtcctggaactcactttgtagaccaggctggcctcgaactcagaaatccgcctgcctctgcctcccaagtgctgggattaaaggcgtgcgccaccacgcccggccacagtctagctttaaggtgagggcctgggtcatggtttgattctgagccattcatgggcactggttctaggtcagatcagtgacaagttcaaggctctagcacttagtcactattgaaaccacgggtcaaatacagttcacagggaaggaagactgtcttctgttggaggagggagacatgtctacactagtgatcatactagtgaatgttgttctagatagcagacccagggaggggatgcagaggacacaggtctggagaaatagctcagcagaagaaccctgactactcttccagaggccccagttctatacccagcacttacaaagtggctcacaactacctgtaactccaagcctggggaatacgatggccctcgtcgggccttcactggcacagacatatgtgcagagaaagcacctacacacataaaatacatagttttaagcagaggataggtaatccagaagatcttaaatatggtgcagtgggatcaacagaggcctccatggttgatacaactcaggagaacaagaagaaaggtagtaagaacctgcctaagacgaggagattgtgatcctgaggggggcgttcctccagggaggatgcaggccacaccatgatgcttcagctgccttgtgtgtcactgggtgctttgctcctaatggctgaaggcatataccattctcccctggctcacatgtgcacttttgtttgttttcaaggcagggtttctctgtatagccttggctgtcctggaactcactctgtagaccaggctgccctcgaactcagaaatccgcctgcctctgcctcccaagtgctgggattaaaggcgtgcaccaccactgcccggcacatattcattcactatgttcacttttaacaggattttatttttatatgtgtgttttgcctgaatgtaagtgcatcatttatagtccccaggctactttctcaaaatgctttgtaggttttttttttttaatgagtatttaatcatacacacacacatacacacacacatatatatataactttacacattgcaaaacaagaaaaacaatagaaaaatggtgaagtacaattatgaagagatccagaaataaatcatatttttgcaaaaatcgcacaggataaagggaaggcctatggaaagaacacagtttaagcagaactgtttggcttgatttctgaatatggcgcaaagtaagccaccatttgcactaccttgtaaaataaaataagcatcaacgttttttcctgtttgtgtgtgtagaggtcaaaggtcaacattgagtctattcttaaattgctctccatcttttttgagagcggggctctcactgaatctgtggcttactgatttagctatgctcatcagctatcaagacccaggaacctactgtatgcctccccagtggtttgcgttacaggaagttgttttgttttttgcttttttaatgggcggcagaaattgaactcaggtcctcaagcttgcatgacattttagcaactgaagtgtctccctagtttcgttttattcttctttttaaattaaaaaaaaaatcctaggaaactggtccaaaagaaaggagatactaaagaaacagcttttggttattccacttaaagcaagttcctccaacaaaaaccaaaagtccagtctgaacgagggacgagcaacagaatcaaacgaattggaaaactcgggcacaggaaaagtgcagaataattcagaacgcgaggcccgccacgcctcaacaagggttcaaaagcctaaatgtaagccgctccaggttctggtagaagccggctttgttcacaccctgcttgatggtgaggcagggtgggagaggaagtgggaaagcctggggctttctagaaagcttgtgaggtcctgccggctggggttcgggttcttcagctctggcttttcgccctaagcagagctcattcaactcctcgcccccgcgacttccgcgtagggctgggaccacccaagctctgagacaccgccaggcatctccaggatgctggggtcacgatgcccctgcgggctaacttccctctttgcaccgccctcttccctgctgtgtttcagcaggttgtgagccacagcttcctcttttattaagcagagaatgttggtcagctcccagcatctctgtggctcactatgttccagtagcgatgaagacaaagtcctgagcccaatggagcttttattctaaaagttggggaggcggagataggggcaagaaagcaaaatcaacacataaacacatgatttcaagccaaggctgtaaagaaaacaaagctagattgtgcaaggtggaggaggcggaaagaggagcatgtaatggctgtaggaaaacctgcagtaaaaaagaagctgggggctggagaggtggctcagcggttaagagcaccaactgttcttccagaggtcctgagttcaatttccagcaaccacatggtggctcacaaccatctgtaatgggatctgatgccctcttctggtgtgtctgaagacatcaacagtgtactcataaaaacaaaaaacaaacaaacaaacaaacaaacaaaaaaccctgcctagctggcgtggtggcgcacgcctttaatcccagcacttgggaggcagaggcaggcagatttctgaattcgaggccagcctggtctacagagtgagttgcaggacagccagggctacacagagaaatcctgtcttgaaaagccagaaaaagaaaggaaaaaaacgggggcggggagaggggagtgcatgagttgctggaggaccccaggtgatggtgcacacacctgtaatctcagtacacagaaggtagaaagaggtccttcgtgatgtaaggagttcaaggccagtcctgggtaggtatcaaagaccctttctcaaaagattctctctctttctttctctctttctttctctctttctttctctttctttctttctttctttctttctttctttctttctttctttctttctttcgacagggtttctctgtgcagtcctggctgtcctggaattcactctgtagaccaggctggcctcgaactaaaaaatccgcctgtctctgcctcccaagtgctaggattacaggcatgtgccaccactgcccggttctttcttcttttcttttctttttttttttttttttcctggtctcaaactcagatctgcctgcctttgcctccgcagtgctggaattaaaagtgtgtgccattacacccggctccttcattctttttagttagggcatgtatacaacccctatttcattttgcccctaaagaggggctatttacagagagcagctgggctgggggctatggatgcatagggttaggtgagcccgtaagaacaaaaaccgaactcttaaaaattgtgtgtgtgtgatgtgaacgtgggtgtgcttgcctgtacaagtgtgtgagggccagagaaggatttggggagtctcgctccaacactctccactttattctcttgatcctagagctctgctttttagctacattagctggcaggcaaacacaagaatccttaagtctctgctaaccccactcctgcaattacaggcccgcgccagtaggtgcgagccagctttctaacagtacctgggatctcaactcagcccctcacacttgttttgcaagcactttccctgttacctcagactcttcctttaacattatttgctagttcaaaatgcatcgcaggaaatacttaatcactggaccacatacatgtaatggtctcttaaaatgttcatttttcgggtgctgggggtggaccaagggacctgcgtgtactttaaccctccccctgtcctccccctctctctgtcgtagctcaggctggcctaactcactttgtatccctggatctctgatcttcttataattataagattataggcgggtaccacaatacccagctttgtttattttctgagccagagtgtcgctttgtagtctagactggcctggaactcccggcgctcgtcctgcctccgtgtcccctatcccagcctggacatttaagacctagtttactgtggttgggggcccggattaggcaggtgcgccagctaatacttccggtagaaactcgtgacaacccgtcggtggttctgacgcgcggaaacccaggtttgctccggatcgcagaggccaggcgtcccggcactgcgcaggcgctaactgttgcctggctccggcgaacgattcattcggcattccttgcaaagccgcgggcgagacacactgtctccccacgctccgcgacaccacgcatgggcgagcccggacccacccgagaggcaaccgccgcgccttccggttccgatgacagcggcgccggaagcgggctgagctgcaagactaggtgacagcctgccggctcccggtcccggggtgcggggcgccccgaccaaagcctggagcagtcgtcggccacaccctccaagggctggtggagtcgcccggactccgacgtcccgtcctagtgcacctgactgagtcagaggtaagcagccagtgggtggcggggttccggcagggcactgcaggagggtctctgggaggataagtaggagtttgtcagtctttgcactactatgcgggtcaagtcggggtcgtggcatgcccctagggtaaatggtgggctttcctgtcctttcagttttaggtgaagaagtgacaatgtgaaactttctagtatttgtagggatatgatttgtttgagtgtaaaatacagggcattcgatactgtggtttgaaaagatgacacgtgtgtggagacctagataaggagccagccatgggaagatgtgagagagtgttccgagaagaggatagaggcagaaataaactggatgtaccctggaacagaaaggctggtggtggtagagtgtggcaagtgatggggagagtcattggagtgagcatcaccagggagtttgtttggatagaacttttgtttttcttttgtttgtttgtttgttgtctttgagacagggtctcttatagcctaggctgccctggagctttctaagtagaccaggctggccttgaactcacaaagatgcatctgcttctgcctcccatgtgttggggggtggggtgggttaaagtcctgcaccaccatacccaacctcagatttatttattttcttttataatgatgacgatgatgacaacgacgatgacgacagcatttctctacatagccttggctgtcttggaattcactgtgtagaccaggccagtctgaagtcagacagatctgcctgcctctgcatccttagttctgggattaaaggtgtgagtcaccacacccaacagatattttttttaaacttcttatttctaggtgtatggggaccttttgccttcatgtgtgtctgtgcaccacgagatgcagtggatgaagagggcttcagggtctctagaactggacttacaggaagttgtgactgccatgtgggtgctgagaacagaatctgggctatttgcaagagcagcaagtcctccttaaacaccgagccatctctccagcccctctagtgtgaagttttaacatttccttcatatctctttctatccactggaagcttttgattcaggccttcttagccaaaggctaggaaatggaggtattgtttaatcagttaggcctactcagccccgtgatgggctaggtcctgcagggagggaggggacaagaccagtctccaggctttgtttagctgctagtccagttgagacacatctgaagaagcagtcaggaggatgtggaagtgtgtggaaccgacacatcagatttgtgatgcagaaaagaagggtgcacaaggaagatagagccgtgagaagaggcctgagctggagcccaggaagccatataaaatggtggatgtgaccagggacgtagcacaagcctttagttcagcaggtggagctttgtaaattcaaggtcagcctggatttcagagagagaggtgattggtgaccttttgggagcctgggtttaacttgagttggcagaggtgtgaagagggtgcttatgggagtgagtgggtgtaatgaaataaagaagagaagcagggctttgggtgtaacaccctctgtggctccgcacttgtccagcatgtgtgggggcttggccctgaaaaatcaatagattaattaaaaatgaatgcattcctgatgatatgtaattccagctactcggaaggctaatgcagaaggattccaagttcaaggtcagtctgagatacagaatgagctcaagggcagtctggtcagtctagggagttcttgactcaacacaaaaagctgaggttggaacagggtggtggcacacgcctttaatcccagccctcagaagacaggggcaggcggatctctgagttccaggtcagcctggtctacagagagagagagagagagatctgaaaacaaacaagtgcacagtagactggggtgcagctcagtcggggtgggggttcctgggggagggcatgcttggtgttgaggccagcatgaacccatttcaaaacaacaaaatagcatcatcaagatgtctcagtgagtacagatatttgttacatagtcctggtgacctgagttcaatccctggaacccacataaaggtggaaagagagaactgactgcacaaagttgtctgaatgtggcttctgcccagatcagaagcacgaatacatccgtttttaaaaagcagaacaaagccgggcgtggtggcgcacgcctttaatcccagcacttgggaggcagaggcaggtggatttctgagttgaaggccaacctggtctacaaagtgagttccaggacagccagggctacacagag

SEQ ID NO: 1760 - DNA, 2602 bp, Mus musculus
cgcgctctagagcctcgtccgggctggggtctgcagagctgctgcacgtgagcgagcgaacgagcacgcatcgcggtggccgctgcaccatgcgcggctagcggtggggtcccggccccgcagcacccgcgagcccgggcggggctcaggtcgctcgggggcggtgccggttcccgccccccacatccgggggccgggctgggcgctggggctcgcgccgcgcgggtgagtcaggccgggttttccctccgtctctggggccagcggacgagtgtcgcccagtgcgtcctttgcccgccgatccggctcccgcgcgttcccgaagagcctgggaagagaaaggttcgagaccgagctggggactgcagcgcgccctaggattcacggagccagcatgaatcagctgcccgagccctgttgaaccttcatggccacaacctcaggccctgctggcattgccatgggcagcgtaggtagcctgttggaacggcaagacttttcccctgaagaacttcgggccgcactggctggctcccggggctcccggcagcccgatgggctcctccggaaaggcttgggccaacgagagttcttcagctacctgcatctccccaagaaagatggcaagaccaccaagcgagcccctcggaacgagccagactatgccaccctctactaccgggagcatcctcgggctggtgacttcagcaagacttccctgcctgagcggggtcgctttgacaagtgccgaatccgtccttctgtgttcaagcctcctgtgggctctgggaaaggcttcttgtccatgcaaagcctggcagcccacaagggccagaagttgtggcgaagcaacggcagcctgcacactctggcctgtcacccacccctgagccctgggcctcgggccagtcaggcccgtgcacagttgcttcacgctctcagcctagatgaaggtggccctgagcccagcctgtcggactcttccagcgggggtagttttggccgtagtccaggtactggccccagccccttcagctcctccttgggccacattaatcaccttggaggctccctggaccgtgctccaaggagccccaaggagtctggacctctggcggtcctgagctgcctgcccgaaccacctcccccctatgagttctcctgccccactactgaagaggtcgccgtgttgcctgaggcccgtgaagagctcaagagggacctcggtgaccaggatgtttctaactcctttactcaggtgctagaggagcgccagcggttgtggttgtctgagctgaagcgtctgtatgtggaacgacttcatgaggtggcccagaaagctgagcgcagcgagcgcaacctccaactgcagctgtttatggctcaacaggagcagcggcgcctgcgcaaggagctgcgggctcagcagggcctggccccagagcctcggacgtctgggtcctccatggaggctgaccccaatgctcggccagaggaagaagcccgatgggaggtgtgccagaagaccgcggagatcagtctgttgaaacagcagctccgggaagcccaggcggagctggcacagaagctggcagagatcttcagtttgaagacgcaacttcggggcagccgggcacaagcccaggctcaggacgctgagctagccaggctgcgggaggcagtgcacagcctgcaggagcaggcaccgcgggaggaagccccaggcagctgcgagacagatgactgcaagagcagaggactgctgggggaggcaggaggcagtgaagccagagaaggggccgagcagctgagggcagagctgctgcaagagcggcttaggggccaggagcaggctctgcgctttgagcaggagaggcagacttggcaggaggaaaaggagagggtgctgcgctaccagcgagaaatccaagggagctacatggacatgtaccgccgcaaccaggcacttgaacacgagctgcggctgctgcgggagcctcctacatcctggagtccccggctggagtcctccaagatctgaggctcgccaagtgtgctgacagtgggcatactgtcagaagataccctgagatggcaggctcctcccttgcactggttggaggcagaatctgtagaggccagatcagggatgggacgcccgccccgtggagggctccagcgggcaatgggatggatagggtacctgctcccgaagctgtggcaaagtcttgctagcagcgaaccacacccagggagggtctagccctgcttccaacagtgggtgtggcctggtaaagtaggttggagccgtccaagcttcagccccacgatgcagaagagcaggagaggaggagggtggcatgtgacctggcctgaggtcttcctccatggaaggagccagggttgggaagattggccacctccagaataaaaagcacgtttttatgaggaggcctagttgataagattgtccttggcctgaggccagaggctcctggatggtcagtgctccaggccttggacctaggctgtagttccttctatgttcccaacaatggaaagaatataccccattgcagtctctggtcttatgtgtttgaaa

SEQ ID NO: 1761 - protein, 539 aa, Mus musculus
TFMATTSGPAGIAMGSVGSLLERQDFSPEELRAALAGSRGSRQPDGLLRKGLGQREFFSYLHLPKKDGKTTKRAPRNEPDYATLYYREHPRAGDFSKTSLPERGRFDKCRIRPSVFKPPVGSGKGFLSMQSLAAHKGQKLWRSNGSLHTLACHPPLSPGPRASQARAQLLHALSLDEGGPEPSLSDSSSGGSFGRSPGTGPSPFSSSLGHINHLGGSLDRAPRSPKESGPLAVLSCLPEPPPPYEFSCPTTEEVAVLPEAREELKRDLGDQDVSNSFTQVLEERQRLWLSELKRLYVERLHEVAQKAERSERNLQLQLFMAQQEQRRLRKELRAQQGLAPEPRTSGSSMEADPNARPEEEARWEVCQKTAEISLLKQQLREAQAELAQKLAEIFSLKTQLRGSRAQAQAQDAELARLREAVHSLQEQAPREEAPGSCETDDCKSRGLLGEAGGSEAREGAEQLRAELLQERLRGQEQALRFEQERQTWQEEKERVLRYQREIQGSYMDMYRRNQALEHELRLLREPPTSWSPRLESSKI

SEQ ID NO: 1762 - DNA, 38234 bp, Homo sapiens
  misc_feature (1)...(38234): n = A,T,C or G
ggcccgggcacagctgctgcacgccctcagcctagatgagggcggccctgagcccgagcccagcctgtccgactcctccagtgggggtagttttggtcgcagtcctggtactggccctagccccttcagctcctcccttggccaccttaaccacctcgggggctccctggaccgggcctctcaaggacccaaggaggctgggccaccagctgtgctgagctgcctgcccgagccaccacccccctacgagttctcctgctcctctgccgaggaaatgggagccgtgctgcccgagacctgtgaggagctcaagaggggccttggcgatgaggacggctccaaccccttcacgcaggtgagggagcccctgccctggagtcctgttctgtgcctcagcactggggtacaggccagagagaggggccccagccagttcacccacgtggccgtggacacaagagagcaagaaagggggagctggcttggcttccttcctctgcatcccaggtggtggggatgtcatgtcactgggggtccttgcctgggagttgtgtgggaaggagagaggctccctgggagggccatgtgatggggacacctcaccctggagggcatcccgggttaaagcgcatgtgtggctgggtcctgtggtgtaggggcacaggatatgatcagtggctggagtatcaggtggagctctgagtcgcctctagggggcagggccacggtggatgcatctcttccccttgacaggtgctggaggagcgccagcggctgtggctggctgagctgaagcgcctgtatgtggagcggctgcacgaggtgacccagaaggctgagcgcagcgagcgcaacctccagctgcagctgtttatggctcagcaggagcagcggcgcctgcgcaaggagctgcgggctcagcagggcctggctccggagcctcgggcccccggcaccctcccagaggctgaccccagtgcacgaccagaggaggaagcccgatgggaggtgagagatgacacagggctccgagactctcccatctccattgccggtcccttcttctgcctgccccctcccaaaccggctccccacaccctactttgcttgcgtcctccccatcccccaggtgtgccagaagacagcagagattagcctcttgaagcagcagctgcgtgaagcccaggcggaactggcccagaagctggcggagatcttcagtctgaagacacaacttcggggcagccgggcacaagcccaggctcaggacgcagagctggtccggctgcgcgaggctgtgcgcagcctgcaggagcaggcccctcgggaggaagccccaggcagctgtgagactgatgactgcaagagcaggggcctgctaggggaggcaggaggcagcgaggccagagacagtgctgagcagctgcgggctgagctgctgcaggagcgacttcggggccaggagcaggcgctgcgctttgagcaggagcggcggacttggcaggaggagaaggagcgcgtgctgcgctaccagcgggagatccagggagggtacatggacatgtaccgccgcaaccaggcactggagcaggaactgcgggcactgcgggagccccccacaccctggagtccccggctcgagtcctccaagatctgaggccagcagagcgagctgacagcagcaacactgtcagaaggtgccctgagacggccggctcagccttcccttgcactggttggggtggaacctgcagaggccagcccggggctggggaggcgcaaggagaggagggatccagtggggccgtgggctgggtagggtgccttggcaggagccaggacaaggccctcctggcagaggagcacctaggcagggcccagccctgcttcctggagtggatgtggcccagagaaggaggctgggggatcaccagccccaaggtcccgaagggcaggtcagagggagagaggctggagacctgggctggggccttcctccagggaaggaggctggggtgggaacactggcctcccccagaataaaaccatgttttctaccagaggctcagaatacgctgagcctgtgaccagaggatgatggatggtcgggattgaggctgttgacctgggcagtagctcctcccacggccagtggtcagtgggagggtgtgccctgcgcctgtctgcatggccactgggcatgtgtgttgggagcagaggagtcctactccttgcctcagccccacacggttccttagctgccgtgtgggctgaaattcctttctttagcaccagtggagttttcagaaggaacaacaccagggaatgccaaaaaaacaaagggcaagtcaaccaaggcattttgagaacatgaaatgtcttcttggtgggaaggctgggccccaggagtatccacaggctcaggccatgcccctccccgcacccacctcctgtctccctccctccctccataggagtggggggcccctagaagtgctctgcctcattccctgttcgtaggaaggtgcaggagaggaggtgggcaagcttatgggtttcttggtaaagagcctttaccacagcaaggaatgggaacatttccccatcagcaacggggctctagggcattattaagtaggggtgaaatatgattgatttgcattctggaaagctctcccaggaggaagcattccccaccccaccttgcctctgtcctgcgctgggctccaggacggtcagtcctcccagatccctgctctcagctaaggctggtccctaaaacccacacctgcctttggtctctcagaggcctggcttgccctctgggcctttgctcccccgctgggtgcccggcctggaacacaggttctgtctggctgtgtgagtggcgtctctcccttcctttgagggaagctcagctttcttacgcgctcatcgttggacaggctgccatgcattgcgtgcttactgggcgccaggtgctgtgctgggcccttgtgagtgtgggggcacaggctgaattagatgagctcctgccgcagggggccctgcacactgatgtcagctcaccagtctcttccctgacagggcagctcagggaacttctgagaagttatctgcagagagccccacctcactccctttggctaccctggccgtgcctggcagcccctcaggccccacaggtgggtcctggttgtgaagtggagttagtgcacatggatgtcaggggacgggtgtgaggcatgagctgggggggccccctttttcagggcagagaatgaggcgtgtgcactgtctgctgtggggatggtgtgtttatggccatgtaagtggcaggtgtgtgtaaagatgtgcttgtgggtggtgggtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccaagtgctataaagaaaacaggtcggctgggtgcggtggctcacgcctgtagtcccagcacttcgggaggccgaagcaggcggatcgcgaggttaggagttcaagaccagcctggccagcatggtgaaaccccgtctctactaacaatacaaaaaattagccaggcatggtggtgtgcacctgtagtcccagctactcaggaggctgaagcaggagaattgcttgaacctggcaggcggaggttgcagtgagccaagattatgccattgtactccagcctgggcgacagagcaagactccgtctcaaaaaaaaaaaaaaaaaagaaaacagggcaaggaatggtggctcattcctgtaatcccaatacttccaaaggctgagaggggaggatctcttgaggccaagagttcgcaaccagcttgggcaacatagggagaccacctctctattttgaaaaaaaaaaaaaaagtaagatgtgcaaaggggagggaggggaaggcatggaggattcaaggggaggatggcctggaatgaggcccaaccaaaaagggagcagaagtgggcaacacagagacctggctttttctccagggctgttcctagtcccagctgaggcctgaggaggagtggggacttctctactctttccctccagagcagagggtccgggatagaaaattcaatctggggctgggtgtggtggttcatgcctgtaatcccagcaatttgggaggctgtggtgggtggatcacctgaggtcaggagtttgagaccagcctggccaacatggcaaaatcccctctctactaaaaatacaaaaattagccgggcatggtggagcatgtctgtaatctgttactcatggagctgaggcaggacaatcgctcgaagcttggaggtggaggttgcagtgaaccgagatcacaccactgcactccagcctgggcaacagagcaagacttcatctcaaaaaaagaaaaagaaaattcagtctggacctgggtttggggtcagtgcctgttccctcctccttcctaaccctcacccttcctccttagggcagatgggcagctcccatcttctccccttcccccgttccccaggacagcgaccaacacagggcggcagggtagggctggaccccctcctccgcagaactgaattctgttgaatacccagtgggcagattaagttcgggctaaggggaccagaaaggctgggacaggaaaggagttttcttttcttttctttttttttttttttgagacggagtctcgctctgtcgcctaggctggagtgcaatggcgcgatctcggctcactgcaacctccgcctctcgggttcaaacgattctcctgcctcagtctcccgagtagctaggatcatgggactacaggcgcctgccaccattcccggctaatttttgtatttttagtacagacggggtttcaccatattggacaggctggtctcgaactcctgaccttatgttccgcccgcctcagcctcccaaagtgctgggattacaggcgtgagccgcccggcccggagttttctattctttttttttgagacggagtctcgctctgtcgcccaggctggagtgcagtggcgccgtctcggctcactccgagctccgcctcccgggttcacgacattctcctgcctcagcctcccgagtagctgggactacaggcgccccccacctcgcccggccaattttttgtatttttagtagagacggggtttcaccgtgttagccaggatggtctcgatctcctgacctcctgatccgcccgcctcggcctcccaaagtgctgggattacaggcgtgagccgccgcgcccggcctggagttttctttttttttttaagcatcacttcatatttcaagagctctcagttctcctgagatttctaggctctgtccaggatccctaagcctgttcacagtcctacttgaagtttctaatctttcttttctcattaaccaaaactggagagaggaaaaagcccatcattttccctggacagcagcgcctactgggagtttcacccgcattaacatgcaaacgacaggcaaactcctagtcatccttccaaagaccctgctccacagccctgccgaggccggtgcgcacctagcccagccactgcccctcacggcccccgcgccgccctcactgagcagggcgggcagcgctgtaggcgtaaccacttggggcttggggcttctgacccgggagtcgggtgctgggttgagtgcgaggccgacgcctctgccgggtggggaacccgcccgccggcgaggagcggtcgcggccaggggcttccgccgactgggaggcccggggccgggccggagggactcggaacctggaaacgaccaggcgcgaccccccagaggactacaggcgcggcttttctggccgccgcccggttcccgcgggcgactccactcggcatgcgcggcggggagcctcggcggtgaggcgcaaagccgcgggctcgtgggacggccacccctccgcaaaaccgccaatgggcgggcccgggccgccgatcgcccgccgcggcttccggttccgatgacagtggcgccggaagccggggccggggctgcggggcgaggtgagagcgggcgggcttgggagccggcaggtgcgggccgagggcgggcacagcggccggcggagctgaggcgcgcggcggggaaagctcggccggcctcccgggccccagccttctccagaacccctgctacccacgactaagccccgaacaatctgcccttgggcttgttctcttcgcagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggtgcgcaccgggctcggcagggctatggagcagggtctttggaaggatgactaggagtttgcctgtcgtttgcatgttaatgcgggtgaaactcccagtaggcgctgctgtccagggaaaatgatgggctttttcctccctccagttttggttaatgagaaaagaaagattagaaacttcaagtaggactgtatagtaaaaaaaaaaaaaaaatggaggagggcgatatgacacggtaactggtgtgagggtggggcggaggggtcagtattagatactgtggtctagcagagcatctctgaggacgggacatttgcgttgagacccaaattaggaggcaggcttaggaagatacgggaagagagtggtccaggcagcgggaacagccagtgtgaaggccctagggcagaaatcaactgagagtatagtcaaggaacagaaagcaagctagtgtggctaaagtatggtaagaaagggaaagagtggtaggagatgaggtcggataattggggtttggtcacatagagtctgtaggtcagagagaggaatgtggagttttttctaagtacagtggaaatcttttggttttaagcagaggagtgacatgtagggtagagagtggatggaggtcgcggctgcaaaagcataagaattggctgggcacggtggttcacgcccgtaattccagcactttgggaggctgagactggcagacggcttgagctcagcacttcaagaccaacctggccaacatggtgaaaccctgtcgctccaaaaaattaggccgggcgcagtggctcacgcttgtaaccccagcactttgggaggccaaggcgggaggatcacttgaggccaggagttcaagaccagcctggccaacatggtgaaaccccgtctctactaaaaatacaaaatttagccgggtgtggtggcaggtgtctgtaattccagctacttgggaggctgaggcaggagaatcgcttgaaactgggaagcaaaggttgcaatgagccaagatcgtgccactgtactccagcctgggcgacagagtaagactctgtctcaaaaacaaacaacaaaaaaattagccaggtgtggtggggagagaggggaagaatagggacaaaagggaatacataaataaacacaaaggagaaaaggccctgcatggcccccttacatgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaatggcgaaaccccgtctttactaaaaatacaaaaatgaaaaaaaaaaaagccaggtgtggtggtgcacctgtaataccagctacttgggagaccaaggcataagaattgcttggacccggggggtggaggttgccagtgagccaagatagcaccactgtattccagcctgggcaacagagcgagaccgtctacaaaaaaaaaaaaaaaaattactgagttaatcacactcctcagttcatgatacatttaactggtccatgcagggcctttttctcctttgtatttatattcccttttgtccctattcttcccctctcttctcaccacaggaaaccattctgatgtgtttggtgtatatcttctttttgttttttgtttttttgagacagggtctcactctgttgctcaggctggaatgcagtggcataatcatggctgactgcagccttgacctcccgggctcaagcaatcctccgtcccacctcagccttctgaggagctgggaccacaggcgtgtgccaccatgcccaggtaaatttgccgtgttgcccaagctagtctcaaactcctgagctcagcagtctgcctgccttgacctcccaaaatgctgagattacaggtgtgagccactgctcccagcctatatgcatatacttttaatttacataaatggattctgcctagacctcatttttttccacctcagtgccatgtgtggagcttgtcgatgttgctctgggtatatttgggatgcagtttctaaatgctccacaggtttccatagatgcatcccccacattttacttacttgattcctctagtgatgaggtccctagattgtttcccactccttgctacaatgcaatcccgtacccatctccttcctcagctttgtaaatagaattttatcgcttctcagccttttcgctgagatcaagtgtagtaaatacaatttcaagatgctgatttgagcttggctttgataagcctggtagctcttggtgtctgacagggccggattgtttgaccttcatgaggtcctggcttttttgagccatgtttatttttgataaattgtgattctagttcccagacactcttggccaacattctagtgtcctgccatcttccccagttgatcattctcacgagctctgtggttaattttctgtttctcatcatcattaatggttgctgtacactcattccaacacagatatttgctctttcctttcctggtgaaacagtggcctgtgaagctggtcctgggagtacctgtgatgtgaagtacgtagagaaggactctgaggccagagccagactgtctggcttcagttcagttcccagctcctccacttcccagacgcctgaccttgggcaactgatttaatctttgtgtctcattttctcatctgcaaagtgggtctaatcattgtacctacctcatagtgttttcgtgagcattaggtaaatgaattaatgtatgcaaagtcattagaacggtgcctggcacataacaggctcctatttggaatgtcagctgttaataatagcaataataataattacgtcatttcagataggagaccctgttatattttgccataatgggtcacattcagttgcagggtgtttgttcagaggggatggtggggggtgggtggcatagcttctggactctctgactatagattccagcgtaatagcattagctgtaaggaaaaagggaagaaacacagcccccaaggccctgggtgccttttcactgtcacttgttgcctgtcaggttgggagacagtggctacagatgggtcaaggtgctgaggccgggactcatgctggtgggaatgagggaatgagtgaagagagcctgtgaaactgggaggatcttggtggtcaccttggacataggattctctttctctttgatgttcctctgtacccttcttgagaatgggcattgggctagatcagctctgtcactgacattctgaggtttgcccacgtgttcagtgtcaaaggctgctctgaaatggaaaggagcagtggcccagggtagaaaggacacagaaggaagccccagtggtagggagaggagataggacaagaaaagtcaactttctttcaatggtataatgaggagggaaggttgtgttgcagcaagagaggttctggtctggtgggggaggcaggcccagtgaccaaaactgaaatagaagggtgcaaagtgagagtagagggagctaggtgggcacaggctagagacagctgctgaagacgctgacgtctgagctaactcagaagtgatgggccagcctctcaagtagtcgaggaggtaagggtgatggagagcaggccaggtgaggaagcagcatgtaccagggcacgcagctatgagacagcaagggttctgtgcctgtcctcgggtgtgcggcgggtgagggtgaggcaggagtgctgggcaagtccgtcaggccagcatggttggcagttattccccaagctgtgtttccaaatatcagccactcaaggacggcctttatggtttatgttactatagtacgtagaaaagcagttcctctaactgtaagaatgtggccataataactctatgaaaatacacgggccgggcatggtggcttatgcctataatcccagcactttgagaggccaaggtggaaagatcgtttgagcccaggagtttgagaccagccagggcaacacagagagacccgtctctacgaaaaaaaattttaaattagacaggtgtagaagcacactcctgtggtcccagctagtcaggaggctaaagtgggagaatcccttgggcctggggggatcaaggttgccatgagctgagtttgtgccactgcactctagccagggcaacagaacaagagcctgtctcaaaaaaagaaaatacatacgtgtaatatgacattatgcagtatatggatttctagttagatagtattgccagctaagggctctgtgaggcctgctctctattctgatttaaaagggagatgaacaaaaattaaggcatgaaaagagttgaaaatggaataataattttctcaccatgattaagaaaaacctcgtcctcacaccagcctgcatcctccactgggcaccccagtggagtgaggagatgggatgttatatgcttaccaaaacataggtacatatatacatatatgtacaaaacatataacattgatacatgatgtgggaatggtgagagggatctgaagaggtggtctgggcaccctgcctgccatgccaccgtggcccagatggggcctgacccagctgaccctccccaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcaggtgggtggccacccttgcaagtgccctgcgacagcctccctgaggacatgggagacccgaagctactgagtgacagggttccggaaggacgatgatgaggatgttggtacctgcatctgtaggcctccttgaaaccgggtaatgacagtctctgagctacttcaaaaagcccaacaaattattaatttacctgagatgattcccatttacattttgttttcaacttacttttctatttttaactttttttcattttataattgtgtgtgtgtgtgtgtgtgtgtgtgtgtgtgtgtaaaaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccaagaacggtgtcgaactcctgggttcaagtgatcctcccgtgtcagcctcccaaagtgctgggattatgatccgctgcacctggcctgatcttcactttgatcacttagttaagatggtcgctgctaaggttttccactgtaaacttcctaatttttctttgtaatcactaagtagtttgtgggctgtaatcctagcactttgggaggctgaggcgggcggatcactcgagcccaggaggttgagaccaggctggtcaacatggcaaaaccacatctctactaaaaatacaaaaattagccgggcatggtggcacatgcctgtagtcccagctacttgggaggctgaggcatgagaatcgcttgaacccaggaggtggaggttgcagcgagccaagatcgcgccactgcattccagcatgggtgacaaagcgagactgtctcaaaaaaaaaaaaaaagtagtttgtggggagatactttgataccatataaatgtcctgctctttaccaaatttcagcctactagttttagtatccattaatgattgttgtgtgaattattactaagctgtctgcaacatggtgatttttcctgctttgtcattctttatacatttattagttgacattcaactgaaaagaagctttcccttctcctttcattattatcacttcacactcatattcttattttattcaataggttataatccattgcagttatttaatgttcaaattgtcttaggtctgaccagagggtgtccctggttcctatgtcttttttaaaaattgagctataattcacttaccattaaactcactcttttaaagtactctgtccaggtgcagtggctcatgcctgtaatcccagcactttgggaggctgaggcaggtggatcacctaaggtcaggagttcgagaccagcctggccaacatggtgaaaccctgtctgtactaaaaaatacaaaaattagctgggcgtggtgtcatgtacctgtaatcccagctactcaagaggctgaggcaggagaatcgcttgaacccaggaggcagaggttgcagtgagccaagattaagtcactgcactccagcctgggtgacagagcaagactctgtatcaaaataaataaataaagtacaactctggatgggcatggtggcttatgtctgtaatcccagcactttgggaacttgaggcgggtagattgcttgagtccgggagtttgagaccagtctgggtaatatggtaaccctgtctaccaaaaatacaggtattagccagtctcataactcggtctcaaaataaataaatacatacatacatagatgaaaatttaaaaaataaagtccaactcagcggttttcagcatatttacagagttgtacaatcttcaccactatctaatttcagaacattttcatcacccccaaaagaaacctaacccattgactgtctctccatttcctccctctccctagcctctggcaaccactaatctcttttttgtctctatagatttgcctattttggacagttcatatacaaggaatcataccacatgtagccttttgtgtccggcttctttgattaatagaatgttttcaaggctcatctatgctgtagcctgtatcagcacttcattcctttctatggctgaataatagtccactgtagggatgtgccatgtttttccactagctgatggacatttgggttgtttccaccttctggctattataaatattgctgctataaatattcacttacaagtttttgtgtggacatatgtttttatttcttctggtatatccttcggagtggaactgctggatcaggtggtaactctaggtctaacctggcagttaaacagaatcctatgcatgctgtagtccatgagttgaaataaacacttgacccatagtaagtgccagatcatcttcatttcacagcaaccagtaatttcacagatgaggaaatgaaggctcccagaggtgaactggcttttcccatttgagcagttccaagtcagacagttaaaaagtggcaggacctggaagagaagctagttctttcaccctggcattcagggctgcctcctgggctacggggctggcatttagaatagagctaaggtctgctgccaaggcaggtgccccagtctgcctcctctgtgtccttattccactttctctgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacagggtgagcacgtggccggctccaggcgtggggtgggagcaccctgaagctgggatgtacaaggactcgaaggagagccagcaagagtgcccgcatcaccaggccctgtctctcctccttcgtcagaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggtacagtcgggctgggcgggcgcaacaacctgcctgctctgcctttcacctgctagttttcactgtatgaagtccctaccattctcaaatccatttatttcctaaaggaaatcagcacctctgccagaagcagaaggtagctttaaaaacatatatgatgaaaagagaagttactcatttttagttagagttggttgccagccagggctctgagctgaggcctcatatccctttattgaaaagggagctgagtgaaatgacaaagtagtacttgttaggtgttaaagacacactggtggtaaaagtaaagattttccctactgtactaggaggattgaagaggagtaattttctcgccatgcaactcagtgcgtagcctggggactgtctccactgctacggttgtggggtggggtctgcagtctgcactcgaggtcagcatgtcatactcagcctccccaggactgagatgggaacaagagaggcccaagtggctggcaggagaccaagctcctcaagcaaagcccagctctctggcctgtctttggcgggtgagcttttattatgtgcatagcagagaactttggaaacaccatcttccagtggtgggatctcttctctctctccttgtaggaatcaacgctgaatgtggacttggatttcaagcagcctttcctagagttgaatcgaatcctggaagccctgcacgaacaagacctgggtcctgcgttggagtaaggaggcccttgggtgggccagcagcactctgcttcgacctctcagggcacagggcttgactgtggtcttcatttcacccagatgtacttgacttgcctgcagccctgtctcaagagcctcacacaggcttttggggccctcctctcaggtgctggctctcaggtcctagcccccaccagctctacactaaactggcccctttcttcccagatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcggggtgagtgcccaggcagctgggggttgtgctgcctggcctgacacatgtctggatgtggtaggttacatcaggctgccagtccctgcacccatgtggggctgtctgttacacagatgcctctccccaactagaaacttctctgacccctcgtgtccaggatgaactctagactcctcctctctcacatctgccatacctttagtttatagcttcagcgcagaccacccagggtcctcgtgcctgctatgcgccacaccacactcatttagagcatgccatgcccgtcccacctgttctgcctcgtatgcctccctgacctgtgtggcctatggaaaagtcctttaagaaaaaaaaaaaggccaggcgcggtggctcacgcctgtaatcccaatattttgggaggccgaggtgggcggatcatgaggtccatcttggctaacatggtaaaaccccatctctactaaaaatacaaaaaaaattagctgggcgttgtggcgggcgtttgtagtcccagctactaggctgaagcaggagaatggcatgaactcgggaggcggagcttgatcgcgccactgcactccagcctgggtgacagagtgagactccgtctcagaaaaaaaaaaaaaaaaaaaaaaaaaaaaaaaagacttgtctgggtgcgatggctcatgcctgtaattgcagcactttgggaggccaaagcaaagggcggatcacttgagctggagaccagccttggcaacatggggaacccctgcccctgctcccatctctacaaaaaataaaataaaaaagactcagttgagcactcttcctgtcttgctagaatttccaaacctggaatctgagtctcacctatgcttacaagtagtaacctgtactaacttgtttttttagttccacctcatatttattattttaaattttatctcaaaataaatatgaaaaccaagccatgatttattatttatttttgagacaaagtctcactctgttgcccaggctggagtgcagtaagtggtgtgatcccggctcactgcaacctccacctcccaggttcaagcgattctcctgcctcagcctcccgagtagctgggattacaaatgcctgacaccggccgggcatgatggctcacacctgtaatcccagcactttgggaggctgaggcgggtggatcatgaggtcaagagatcgagaccatcctggccaacatggtgaaaccccatctctactaaaaatatgaaaaattagccgggcgtggtggcgggcacctgtagtcccagctacccgggaggctgaggtaggataatcacttgaacccgggaagcggaggctgcagtgaaccgagattgtgccactgccctccagcactccagcctggcgacagagcgagactctgtctcaaaaaaaaaaaaaaacacacaaaaaacacacacaccaaaaaaaacaagtgcctgacaccacaaccacatctggctaactttatatattttttattagagacggggtttcaccatgttggccaggctggcctcaaactcctggcctcatgtgatgcacccaccttggcctcccaaagtgctgggattataggcatgagccaccacgcccggccccaaaacatgactgaagttttagctagatactgctgcctgttgaaagctcttaacctggggttgctctaaatggagattagtgtggagacaccagtgccaacctgaggacttatttgatccttgatgcagtgggggaggaaagagaactggaaaagaactgtcctcattcctgattctgtgttagtaatgcctgttctcatcctgcagaagcagcctggacttccacctccccagtggattttacagtcaaatttgcctgagggcattttcatccctgctcagtctcctcaggggcttgggagccaccgggctcagcatattgtgctgtgctgcacagtcctgctgcccgcttgggggtggacccagagccctgcaccccctgagctgccccctctggttgccttgtagagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcaggtacaacccagccctgtgagggcagcacaggtgggagggtagagaggtaatcatcatttgccaaggccctgccatgtgccaggaacagtgctcggtgctttcagagaccgaaactggctttcttagtcattcttcaggagaggaattacctgtttttacagttaaactgagactaggaagagttatggcccgaggtcaccatgaggtcagtggcatggtcaaggttcccattttgtaaggtctcctgaatgaggtccctgcctctcttgcacctcaccctggatcattgcaagaccttcccagctaacccacgcccctctgcagcccgccttcctcatgacctaatgtcttaaacaccacttgccttcaggggagatgtgagtggttgagtaatatgtattcagcactgctgctgacacctccctcagagctcccagcaaccctgggagggagagccacgttatcctccttctacagatgaggaaatggaggcccaagatgtgcacgcacttgcccaaggcctcgcagggaataatgggcacttgaacctgaccccagagccacacactccgccacagtggacagctgtcactgtgtatttagactgttgatggtgtctgagtacagcacctcaatatagtggactgattctacgctcatctgatttgttaccatggactcagtttatagaacgtcatttcccagcaagaacaacatcagcaccttaggatgattctgttgcgcaggactaccctgtgcactgtggggtattcagcacctgaggttccagccagtaggctcccttccccatgcaactgtcacgagaagggaaccccaacctccatttgttaggcggcctagttgatagccaccattataaagatgtgttatgactacacagcagggtacgtcctacaggcaggctggggccctttggaactgctcactgttccctagtcacaccaaggacttttcagtcattaggatgagcagatatctgcccctagagctataggaagtcttccctgtaggttctcaaattttggggtgcattagaatgagtctgtagagtcagacatacataagtacatatgtgacatcttatgaacaatgtgagggatctttgaggaccgatttgactgtgcaccattttagagccctgtctcaaggtccatgctgaagcatggcgcgctggccctttttgcctgtctgctgtgatctgagccactctagcccctgttccttgtctgcagctttgcctctggctgtgtggcgctgcctgtgttgatgaacatcaaggctgtgattgagcagcggcagtgcactggggtctggaatcacaaggacgagttaccggtgaggcctggtctggggaatcgtgggcaagaggtactggggaggacagccatgacaggaagtggaactcacccgcttcgctgcccttcccagattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagtaagttccccgtgctgtactccaccttggcttggctctcctactggccacccctgagacgttctcggttctcctccctttgcaggctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaactccataggagaaatccgtgtaatgggattcaggaaaatgaagtaacttgcacaacagggctcacagcttagaaaggagagagcttggagttttaaccagatctgaccctcaagcccaagctatttccagtttattccagggtgcctgaacttggctgttatgtatactgagtcctgtgcagggcctctgacagcaggaaggggccccaagtctaaaatacttgaagggattgggttactagggccattatgttaagcaagagagctcgggggaatgcattttagcttcatattcctatttaaaatgtgctgtgtgggtgggtaaattgcttccataagcttcacagtggcatttaaggctcctgggttaagttaggaatgggggtgttcctgatgtgggggctttaggcttccatgaagtgggtctgggccccctgccttacctcacagcccccatctaccctggaagagggagttgaaaatgctgggatagcagcaggatcagttctcagcttgagccaaagcacccggccctgggcagctgagcatcagcacagaaccctctgagtcctttgggctctctgctgaggaagactgcttcactcttcccgcccaccaactcgctggcccaaccagcagctgctgcttaagaaaacacccacagactcaccacattttagtcttagcatttactttccccaccccacattcttggaacagcctttagttctacaggaaatggcactgatggacagaagactagcattaccttcatgaaagggctgttagagctgcctgggaagaaggcgtgccttggggaactgggaagatgccgtcagtgtgggtgggcaggaggacagccagtcgtcctgctgccagcccaatagcttccagcggcaggtgcccaggtgctaccggagcccctcataggggtaggggcagggactgcacctcctccaggcactcatcgtaagcctcctggtactcctcatggggcttgaccattatcacacaggtggggcgcttggagcctgcggctgcacccaggtcctacagaggggaaagaagtgctgtttggaaaaaagctgtacaacctgtatgccaggaagtcaccaactgatgacccaccagcctaatctggcccacaaccatgttctgttcggtccatgttctatttaaaagcatcttgaattggttgccatcatttaaactcaatcagactttgaaggcatggtccagccacacagggcctacattcccacatggcaactatgaaagggctccagcccagcaggggctgtcccggtccctgccacccccacttcctgtgcctcagatctggcccctgctacgtaagataaggacagctacaggtccctctgagcctaaacccacctaaccggactaacatgggtgaagcatcttagcttacaaagctctttcacatacatctatctctttattctcatagtccacagataactgactatttggttcttaccatcaggccaaacggtaagttccttcagaacagggcctcctgctttatcccaagaagtgatactgtaggtacccaagatccacccccagcctctattttttttttttgagacagggcctcactctgtcatgcagtctggagtgtggtggtgtatgatcatggctcactgcagccttgaactcctgggttcaagtgatctcctgctttagcctcccaagtggctgggactacaggcatgtgccaccacacccagctaattaaaaaaattttttttgtagagatggagtctcactttgttgcgcaggttattcctgaactcctgtcctcaactgatcctcctgtcttggcctcccaaagcactaggattacaggtgtgagccacagcgcctgggctgggattcccactttacaagatgggaactgaaatgcaagaagtaacatatctgtagtcccaaaactaagaagatgtggagctgagaatccatccaggcctgtcttagctccaacactcctggctctttcccacactctcctgctatggcagactatcccagacaccccagtgctgagcaaggtcagggggccacgtgctccttaccgtcttagaggggatatagacatagggcaaatttcggtcctcacacatgactgggagatggcagtatacctcaatgggcagtgtgtctcctgccaaaaccatgatcctgaaatgagagaaaacactgtcatctctggcttgctccttccttctttcagttttaagtgctgccctgggctgggtcttagggatagagacaaaattgtgtttggtgagcacactatttgggggtgatctctacctcttggcaacatacaggtgccaccaaagtgatgtagtgctcggacaggtgaagtacaggatgggtgccaaggtgtatgagctcagctctctttggagagtcaaaaaagggttcaaccaggaggtgacacttgaacagcacgctgatggatgactgtgtggcaggcagcccacggaggggctggggcgggggagagcatgtggtgtgagaatcagaacggcaccagacacagccgagagactggcaggggacacccccaagaccttgagtaccaggctaagaagcatgggctctgtcccaagagtgacagtgaggcaatgaaagcttgccagagactcagccagggttcctagctggccaggtgtcaaggctggggggcaagggcctcaggagcctaagacacagaaggaaaagtctgctctcccatgctggataacaggcggacacacaaggacagagccctcggctgaaagaatgcttccgcactcctagtgctcctctgggccctgtgctggctccccttctgttaagcgcctttcactgtgagtgttcctcacagccttgtcctcggctgccctctcctctcaggaccttcttcctggctgaccggagccactgccatggggtcaggtgccatctatgtgctgaaaactcccagatgtactatctccagcctggccctctctcttccatgctccaaacccctatagccatctgcctgtttgacagttctcctggtgtggggaggggtggaagtcatgtgtctctacagcacctcaaaaacttacccagacccaaatttgtgatctttctacacaaatctggtccccctccactgttcacatctcaagattgggccctctgtccctccagctgggcatgtcagaacctagaagtcgtcaatacctccccattctccacatctgaaagtcctttcaaatctgtcccctttaactctgtctccaccatcacctctccaggactacagtagtctactacctgaactttcccaaacctactcgtacctctataatcctttcttcaattgtcagaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatcatgaggtcaggagatcgagaccatcctggctaacacggtgaaacccccgtctctactaaaaatcactctgtccagcagagtgatggagaatttcactcctgagaacccagttcaaacaaattcaaacaaatgggctcgcttgactgacctcactcagagcctcggttgtgaagtcccttcagctcttacatggaaggaaaaagaaagttaacatttatgtggcgagcatattatatacaatatctcattcagtgctcaccaaaaaatacctctatggtaaaggtaaagactttaccatccttttaccaggaatatataactttatattcacaatttactgacacacataaagatgaatagtttggtacagctcacacaaagctggatttgaacccaggtccacttgtctccaagcccagactttacccatacctgtgatttgacatttgacttcagctcaaaaggatacgtaaatagtgaaagtgtaggaacctcagcttggcccaggtcacacgtgtctgcattttgagccataagacaatgaagtgctgagaacaaatatgtcttcagaaaaccacagtgttttctttttctttttttttcttttttttttttttgagatggagtctcgcactttggcccaggctggagtgcagtggcaccatctcggctcactgcaagctccgcctcccaggttcacgccattctcctgcctcagcctgccaagtagctgggactacaggtgcccaccaccacatccggctaattttttgtatttttagtagagacggggtttcactagggtttcaccgtgttagccaggatggtctcgatctcctgacctcatgttctgcccgcctcggcctcccaaagtgctgggattacaggcatgagccaccgcgcccggcccccttttttttttaagacagagtctccctttgtcacccaggctgtggcatgatctcagctcactgcaatatctgcctcccagattcaagtgatcctactgcctcagcctcccaagtagctgggattacaggcacccgccaccatgcccagctaatttttgtacttttaggagagatagggttttaccatgttggccaggctggcctcgaactcctgacctcaagtgatccactcgccttggcctcccaaagtgttgggattacagatgtaagccaccgcacctggcctgttttctttttttgttgttaacacactgtgtatttcttatctttttttttttttgagacggagtctcgctctgtcacccaggctggagtatagtggccccatcttggctcactgcaagctctgcctcctggaatcacgccattctcctgcctcagcctcccgagtagctgggactactggtgcctgccactacacctagctaatttttgttggtttgtttgtttgtttgagacagagtctcactctgtcgcccaggctggagtgcagtggcacgatcttggctcaccacaacctccaccacccgggttcaagcgattctcctgcctcagcctcccgagtagctgggattacagacgcctgccgctgcacccagctaatttttgtagttttagtagagacggggtttcaccatcttggccaagctggtcttgaactcatgacctcatgatccacccgcctcggcctcccaaagtgctgggattacaggtgtgagccactgcgcccggccacgcccagctaatttttgtattttgagtagagacggggtttcactgtgttattcaggatggtctcgatctctgaccttgtgatctgcctgcctgggcctcccaaagtgctgggattacaggtgtgagccactgcgcccagccaacacattgtgtatttctaaagccagactcagaaatctgttctgaacccaggttgttttgcatgactttattactttatggattttgttggaatggctatttgagcttacttttttgtttcttttttcttttttttttgagatggagtctcgctctgttgccccagctggagtgcagtagcgcaatctcggctcactgcaacctctgcctcccgggttcaagcgagtctcatgcctcagcctcccaagtagctgggattacaggcatgcaccaccacacctggctaacttttgtattttagtagagacagaggttcaccatgttggccaggctggtctcaaactcctgacctcacgtgatctgcctacctcgaactcccaaagtgctgggattacaggtgtgagctactgtgcccagctgagtttactttaagcagtgtacagtggctgataacataaaaattaatggacactggtccagagctctaaatgacaaatgactttaggcaagtcatttagcctctctgggcgtcagtgcttcaccataaagtgagaaagttagatctagatggactaaggtccatcttttaaaaaattggggaggatttatttatttatttatttatttatttatttatttatttatttatttatttattttgagacggagtcttgctctgtcacccaggttggagtgcagtggcacgatctcagctcactgcaagctccgcctcccgggttcacgccattctcctgcctcagcctcttgagtagctgggactacaggcacccgccaccacgcctggctaattttttgtatttttagtagagacggggtttcactgtgttagccaggatggtctcgatctcctgacctcgtgatccacccgcctcggcctcccaaagtgctaggattacaggcgtgagccaccgcgcccggccaggagagaatctcttgagcccaggagatcgagactaacctgcaggaggaccacctgagtctgggagatcaaggctgtggggagctgtgattgtgccaatgaactccagccagggtgacacagtgagacccccacctcaaaaaaaaaaaaaaaaaaagaaaagaaaaaagaaacgctgtaccctttagctgtcaccctctgacctccttatctttcctgaactctaagctaccactaatctacgttctgtctctatccatttctgtgttctggacatttcatagaaatagaatcatgtaatatgcagtttttgtgactagcttcttttacttagaataacattttcaaggtttgtccatgttacagcatttattagtgctttattattattattattttgagatggagtctcgctctgttggccaggctggagtgcaatggcatgatctcggctcactgcaacctctgcctcctgggttccagcaattctcctgcctcagcctctctagtagctgagattacaggcacgtgccaccacgcccagccaatttttgcatgtttagtagagacggggtttcaccatgttggccaggctggtctcgaactcctgacctcatgatctgcccacctctgcctcccaaagtgctgggattacaggcgtgagccaccatgcccaacctagtgctttattattaaataatattccattgtatagata

SEQ ID NO: 1763 - DNA, 2363 bp, Homo sapiens
tggcgccggaagccggggccggggctgcggggcgaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaactccataggagaaatccgtgtaatgggattcaggaaaatgaagtaacttgcacaacagggctcacagcttagaaaggagagagcttggagttttaaccagatctgaccctcaagcccaagctatttccagtttattccagggtgcctgaacttggctgttatgtatactgagtcctgtgcagggcctctgacagcaggaaggggccccaagtctaaaatacttgaagggattgggttactagggccattatgttaagcaagagagctcgggggaatgcattttagcttcatattcctatttaaaatgtgctgtgtgggtgggtaaattgcttccataagcttcacagtggcatttaaggctcctgggttaagttagg

SEQ ID NO: 1764 - protein, 393 aa, Homo sapiens
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMGSLVYLRLGLEKSPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 1765 - DNA, 68370 bp, Mus musculus
  misc_feature (1)...(68370): n = A,T,C or G
accagaaggaaccaaaccttgttttggggttttggggtacctctatgtgaaggacttactatgcaccaggtacatgagtcaggtgctgatgagggaagcccagtggggaagaaaaagcactagtggcatagttacacagtggagtagttacaaacagcagccattacaaaccacacagcaaggtaattatgagcagaaatcatgagagacaatgcggtctgggggagaatgttcaagtcaccaagcgagagtctttaaaaggtacaatgttctgactttggaagccacaaaagactctcctctgagattacaatgaactcaaaggttaaaataggcggcagggttgagggagggtggttatccatggcaaaaagtaccttatgtgcatgaactgtgagtcaaagaagactgtgagctattctggaaataaagagccatcgtggaaagacataaagggaagggccagggaaacaaccatagaagattgccacaagagcttatgaggtaagaaatggcaagaattattaacctaaaagaatcagtggcaactggtattttaaatctgagtgggacctggttggatctgtatttttcagagaacactttaggggtcatggatgagagtcccatggtgacagaggccatctaagaaaggctatggtaagcaagtgagtttcctggagatggcccactgttttgcatggctgtgatgggtgcgctctgcagaggcacagctcctgagacttcatctcctgtcactatttcatagcctaattattcctggacatcagcctaccctattgggaaaatttcctgcagatcaacatgaacatgaactttaatgatttaatgctgtttagatgaattaatggcatcactttatggcattcctaatttgattaaaataattttaggaagaaattttaaggaggtggttttagttgtttggtgagaaagatgtaataaagctagaatcaagaatagactgtgccctctcctcatagaatagtagataaaggctgcataataagggacacaatgagctttcacaactaccctaagaagagaaatgggcttgggacagatttgtgatcaagcaaaagcattcattctagatcaggtccaaggatgaaaccacaggtgtgcaccatgataaagcaaggccatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacacacacacacacacacacacacacacacacacacatacagtcttgcatgcatgccctgactatcttttcttccttttcttttctcgctgcctcattcgaaacctcttggtaactaagcctttttttcttaatcccctgctgttatcagcaacagttaaactgccagaagccttaggcttttggacacagaatagcaaagagttaaagaaggtagaaattgacaaaattaagcagcctttgacctgcagtggctgactccaaccccctcagctgccttccttggggaagtggatgctgggaacctgcccacgccccgccccatgagaggtgattggaggcttgcctaataggagaatattttttattattcttcccctaaaatatggtgagggaaaaagacacaaaattctatgcaaaacctgtggagctgtaataacccagagttacctaggaggggtcgagggagtttcaaacctggatacctcaaacataaggacatcacaagttgactacctcccctctcccaacctgatgctctacagccagcttccctaccaccatgcctaataagaacgcatcaccctgacagttatcaggcttcactccttgtttgaccttataaggtcccccacaacacaccctatagttctagagcatgcagatgaagcatcttccaaccacaaagatcctggccacctcctcaggggcagaaatatccctcaacctcctgcgccccccatgggtgaaccagctctctgaagctgctcccaagtgtgttcttggcctgcacactcatcaccacactgcacacacttgaagctgactaagcttctcagcttcctgccctgcctggtgtgcaatgggcctggctaaccctagagagaatcgaacacatggcagcaaagacctgaagagcagaatccaaagaagctacccagtcactacaggggcaaacccagcattaaaggactctcctgatagtatatagagctttgaaaacctatggtgtgaactatttaaataactacttaaggtaaatacagtaattgctataattcctgactatgaatgagattgggcaaatacctcaagttcctaatgccctggcatccccaagatgaattgttacctggaatgtgaatcaagagaagctttctctattaagttgcttaaaatttttctttttacatcttccgctgtgtgtgtatgtgtgctgtctgtctgtctatctgtctatctctctctggtgtgtgtagtgtgtgtgtgtgtgtgtgtgtgtgtctgtttctctctttctttgtgtgtgtgtctctctctctttgtgtgtgtgtgtctgtctgtctgtctgtctctctctctctctgtgtgtgtgtgtgtgtgtgagagagagagagagagagagatacaatgatataatgatatatgggtaaagctcagaggactacttgtaggcattggttctttcctttcaccacagggtaggtgataggatgtaggatatatgttattagagctggcagacggtgcatttacatctctctagcccttcaactgcttttttcacagggtcatttattacagcaacaggaaagttaactaaagcacaaagtgataaagacaggcagggtttgttgttgttgttgttgttgttctgccaaaggactagcacaggagaattttaaaataaaaagacaaagagaaatacaaggtgtttcttttatttaaaaaaaaacaaaaaacaaacaaacaaacaaaaaaaacttagccgggcagtggtggcgcacgcctttaatcccagcacttgagaggcagaggcaggcagatttctgagttcgaggccagcctggtctacagagtgagttccaggacagccagggctacacagaaaaaccctgtctcgaaaaaccaaccaaccaaacaaataagggtaaagaggcaatcggtttggaagggtacgggggctacgggaagggctggagggaggaaaggcaaagggtgaagttattaattaaatttcaatttaaatagtcagtacaatttacaaacaagggaagaggaactctttcctcacagtatttacatcagaaaacctgtaatcatgaatgctttcctttttattttaatataatttttgtaattcttgaagaatttcatacaatataaaaataaacacctttattcttaaaatttagacattgttttaaaaaagcaataaaatcgacaaagtaaatatataaatgagaccaaaatggtaacagtgcacacctatgaccccagaactccagacagaggcaggagaatctcaagtttgaggccatcttaaactgggagagggatgagggtagggaggagggcagatatttatggcagataagaatgctctcttcctacgattctatatacaaactggctgtcccgccttccatcaaagggacaaatgcttgttgtcaatagagagtttccataattttaagtaattaaaataaaagtttctgtttctgtcacatctctcacacgccagggcacgtgtcctgctatggaaataaataggcatttgtaaccatgttttcctgaagctctgacagactcctatgtcacccctgattgtaagcaggttgaactttgaactccgaagttactacacccttttcatctttgtatatgatagtcactctacctagaattcttctgagtcctgttttgttttttatttttaacttcagtctcaacttaaatatgattttcttagagaggtaattctcaatattctatattggcttctattgtttcacaccctcatgacccttgaattccactcactaccctcaaaaactgctatggtttgaataaaaaaaaatgtcctccgtagactcacatacagggcatggtagtccgctgatgtgctttgaagaagtgattagatcttgaggtctctgacacaaccagtgggttaaatccttgatggcctcatgaaattacggaaactgttgtttaagatccaagtgctaaataatttgctttcattgcagtttttataacatgcggataatgctaccctcagaagagacactattttatatactagaatttgtcactgaaatgtaggcttggcttactctgaccccagacatctcttcatattcttatcaacattacattttctatagagcagactcttccggaaagccttctattgtcatcgtgttatgacttggatagagcccacactcccagcttcctttgattatttctccgatctctcttccttaggttcatctgttcttgatcgcctctcctctccccttggcattcattatggcttgagttccaggggtgctggttttccttctgtcactgtgacaatggaagcccttgccaccacatctctttagtactcagcatagtcttgttcagacataatttcctggcctccacggatccctcttttctatctggtgttactgctcaccattttatagatttcgtcaggaacatagttgtacctgacccgctatgacttatctacacttcccaagattaatgtctctatgtccacatgaaagcagagactactgttgagtgaaaagatcctgggccactggatatggtggcacaggcaggcggatctctgaagttcaaggcttgtctggtctacatagtaagttcaaagacagccaagactaagagagagaccctatgtcaaatgaccaaacaaacgaacagaaccagaaagtatcctggaccaccagaatagcgcacataatatacatccttcattaaaatgtccggaacacccgggacatacaggaggatggaatcaagcctcagaagccctaaagatggacaagaaggttccaacaggtctcagccatggtgctttcctaagtgtgtctggtgacctctgctggcctggctaacacagaatcaaatacaagctttgttatgctcgactcatcttcttgctccttttcccagactggcaaaatgcgaatacagctgtgaaactgggactcagcatcctccgagcatccttcttcctctgtctttgtcaggacaggtctcatgcatctgccagctccttgcttggtatttctcatgtaaacttcatagtttgtgaagaagagaactttgcttaatgcaatattccttccttccttccttccttccttccttccttccttccttccttctctctgtctctctctgtctctgtctctgtctctgtctctgtctctgtctctgtctctctctctctctctccctctctctctctctgtctctgtctctctctctctgcttttcgagacagggttcctctgtatagccctggctgtcctggaactcactttgtagaccaggctggcctcgaactcagaaatcggcctgcctctgcctcctgagtgctgggattaaaggcatgcgccaccacgctcagcccttcctttttctttctttctttctttctttctttctttctttctttctttctttctttctttctttctttctttctttcttccttccttccttccttccttccttccttccttccttccttccttccttcctttctttctttctttctttctttctttctttctttctttctttctttctttctctctctctctctctttctctccttccttctcctttctctctccaatctctctctcccctctctctgtctctgtctctgtctctgtctctctctctgtctctttttctctttcctgctcagattgctgccactctgaacatatatataaaagatgagacctcatgtcaatgatatgtattggtgaggatataattggcagtaatactttatatagttccatggatttcatgtctcttgcttgacttaagtaacaattttgaaaatggtattcaccactacaaaagcaaaggtttggcaaaatgctctcctcacatcaaggataagagtaaaacgtgttgtctgtctgtgcttcagagggcatcattaggagatgtccttgaacatgtcagaacttgaggtgagaaagtaagaggggaaccaggaactttttaaaaaggtaatcaaactggggtcagagagatggctcagcagtcaagaatgctggcctctccctgggttcctgactcccacactggttcaccacaacccataactccagttctaaggggtctgaagctctcttttcaactgtgtgggccctcttgcacacatgtacacacacatcaagccgcaaacaaaaacaaagtaaacattttaaaagttcaaaatagcaaagagtggaaatgtataaaataaccatgaggtgctgtggttacacttttgaaagctattttatttactttgtgtacagtgtgtttgcaggcataatttgctgagcacaagctaaaaggccatgtatgttaggcataaccacggacacttagagacagtcattgtttgttttagcacagagcctcctagcctgttgatttgtcttctattcatatgtgtgcatatgaatggttacagacaagtcagtttcactgtttgctctactttatatcctaattatattgtgtgctttcaaatatgttcattcatctaaggtcatctctttaagtattatgtaattaaatattcatagtactatattcaaaataatttttaaaaaaagagtttcctctcacttcatcacccttcaatggtaaccactgccctgggggaaagtttgagtagatctttatagacactttgtaaccaaggctgagtattcgttaagactcttctacaaaccattccctaacttcttttgaaaccttattcctatgtggagcactttgacatccctgggaattattctgtatcagttggataggttcaggaacttagaagacactgcagaagttcacataactgccaagtggctgatgggactgaaccccaccagagactgattcacaactgagcacttggtcttagcaggtagctgtgtgagttaactctctgcaaccctttcagtgctggacgagccagtctgcaattgctgagaccgcagcaaacctaaggcctgcctcctctgacactcctcgtcatcacgaccttctgttcagttttactggggtttgcagaaccttcaggggttaagtcaatacacacaacttcttcaaagagacagccatgaaccttcagaggttaagtcaatactcacaatttcttcaaagagacagccatgttgagcattccgcacataggcacacatttatactatcgtagtacttgattttctcaaaaagtattttgtattattattattatttattattattattgtgttgtgtgtgcgtgtgtgtagcagaatgtgggtatgcaggacacagcatacatctgaaggtcagaggacactttgtgtgttcagttctctcctcccctccctttcgtaaattctacggatcaaactcaagtcatctggcttgctgcgagatccatcacccactaaaccaactcaccagccctttgacttgatttttaatgttagccatataagcttttctgtcaaacttcaaacaagtaaatatacagtatgtaattatatacatgttcataggtaaggataagaattttttaatgttggggctggtgagatggctcaatgggtaagagcacctgactgctcttccgaaggtccggagttcaaatcccggcaaccacatggtggctcacaaccatccgagatctgattccctcttctggagtgtctgaagacagctacagtgtacttacatataataaataaataaattttttttaaaaaaagaattttttaatgtcactgagtcccagaagacaaacatattctacttcatttccataggcttatactacatgataaaatatgactctattcaccttgagtcattaagacaggcttaagttactgctgaatgatgttgctaaaaaaaactaataaaattttctatactgtattaacaatttagtttttgtgagaattttaaaaattctatttttaaattttttctattgtatttcttttttttcttttctttttgttttgtttgtttgtttgttttgttgttgttgtttgtttgttttttgagacagggtttctctgtgtagccctggctgtcctggaactcactttgtaaaccaggctggcctcaaactcagaaatcctcctgccactgcctcccgagtgctgggattaaaggtgtgcgccaccacgcccagctcctctattgcatttcttttgcaggtggtatgtgtgtgactgcttatgtgtaccaccacacatgcatgaaggtcagatgatgacatgcaggagctggctatctatttctgtcatgtgggtcccaggatcaaatccaggtcatcaggcttggccgcaagctcttcacctgctgcaccctctcgctggcccgaattcttaaaattcaaacaagaagaatacttgggacaattatcattttctgaaagaaaaaaaaaaggcctattaatgtaggcatgttgatagcaagctaaacttgtaaagaacatggttaaaaatcaagcatgcttgtagttgtcttttgggaatattagagtgtggaaggtggtgtttgtctgtatgggcaaacacacaagcacatacatagttgtacactgacaaatacagaaaaggcggtgcacggcctttactgatgatgtaatcatcattatggtgaaagttcagatcctaacctcttctgcaactttcccccatatttcaatactttcctgagcactgaattatgaaatactatcaatcccataatacttgacatttaaaatccatgaacggaactaaaattcatttctctttagccattaagatagggattgacaatcaaccaatcaaccaaaatgacacattctttatgtgctatgcagaaagacaccgtggtttatgcctttgtataccaaaaaagtacagcatttaaggagaatcgagatctggcctctcaccacaatccagcttgtacatttagaataaaataagtgggaataaaactcagagttctagataaggagaggcagagggaagagcacagctaggcacaggctggggtagactctaggcaccaccgtgcagtctgtggaaaactgcttgtgtctgagggaaactcctgcttgtgcttctgccaatgacaaaataagcatccagagagtgtaggagtttggtctaaaggccaaaggccaaaggactggactcttgtcatgctcagtctgtcctctggctacctgccctgctgtgaatagtcaggtttcagctgcgattttttgttttgttttgtcttgttttttttgtttttgggtgtctgtgtggattataactgtgaggcactgccctctcctgaaaggcagcaaggagctgggcacgcttcatccagctgcgctgggttcatgtgacctcagattgctggctcaccctgtagaggctatcccaaggctgctgctttttctcagtgctgactgcagtcagctgaatcaggtcccaaacggcaccacacagctggaagaagaatgctcagaggccgctccttgtcggtgacatcccttggtgggctccctgtgtgggaagctgaaagactccctgtggaagacttactgctttttgaagtttcttgggaggtgaccaacaaaggtttgtactacttgcaacactggccatggtgggccagagacataggggactccagtggtgatggggcagcattggctctgaaggtgtctgtaggtcataaaactctttccaacaggcaatgaaaacataaacttatatgtggggtgaagagggagagaatccaaaagggtagtgagtggctgaataggcttgttaatgttagaaatgtaaatgaatgtcatggccaagtaggaattttttaaaactttttctaattttgtattaggtattttcttcatttacatttcaaatgttatcccgaaagtcccctataccctccccccacnnnnnnnnnnnnnnnnnnnnnnnnnnnnnnnnnnnnnnnnnnnnnnnnnnnnnnnnnnnnnnnnnnnnnnnnnnnnncactcccacttcttggccctggtgttcccctatactggggcatataaagtttgcaagaccaaggggcaagttattgttttgtctgagcattttcccttataaataagaagcaaattaagaaattcttttcttagaggaaaagctatatgtggtcaggactaatcagaaatgttacctcttcatgctattagtgtttaatgcttctaagaattcaagataagattgaagttagagtttcatttaaattgtgttctactgagaaatattaaaatgaatctttctccaatgctatgcatatatagaaaatgtgcttttgaaaatgaaagatggatgaggcaacctaagtgatttttctaatagaggtatttataaggctatgtgaaaatcaactcttagagatttatcttccagttttaggatgttgacacatgaactcacagtttagttatggttggcctggaaaattacagattcaagtgctgggattaaaaagtgtgtgccattatgcttgttttaaaaatctcaagggaatattaacaggtgaatagatttcctgaattctgcaagatcatacaaagcctgtcagagagatgaggggagagggtaaatgatacaacctttacaaattgaagatgggagctgagaatgaatgaagattctatttcttccttgcacatgttgagggtcagcataatgtcagagttggaattataattgctgagtctgggaagataattctgtcagtaaaatgctcctctggcaggcataaggacccgagttccagccctgaaactcaagtgaagaacctgggtgtggctgcagatgcctgttgtcccagggctgtggaggtggaggcaggagggccccagaggctgactggccagccagcccagcaggatgggtaaactccaggcaagtgagagaccctgtctcacaaagcaaagtcaacaggactttggtgacctctggcctatatgtgtgtgtgcacatgctctcacacatgcacccacgggaacatgtacccacacgtgtgccacgtgcatcttgtgtacacacacatacgcaggattgtatttgcactctgtcctggcttccgccttattctgactgttcaaagttcccccagtacacatttaggaaatacgtaaaaggaaagtcagcagagggctcctctgtttagacgccctcagacgcagctcaaaggatgagcccttcatcctctgtactgatgagaggagcagagaggaccggaccttagcacagaggagggacgtgttgtgcacacagctctttcaaatgtccctttacactcaccaattctgtctctacggtttctgaataaggccagggttcttgcaaatagggctaccactactacacacgagtcccagagtctccctggagtgaaaggttttctctgcagagtacacaggaacccctggacagaggttttggaggggaaaggctgggggtggggttagcactgggaatcagtcctgaagacccgtgcacaagcccttgacaccggcatgacccttcttccttctctccattgaacaaacacaaatggggcatcagaaggtatcactcatggaaattggagtcttagggggaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatcagtctatctagatatcacatgcttcatgaataaagagaatacagtgtcctctgaccatcctatgatgatctgtggcaagcaaggaagtgtattcatgtccaagaaaacaaacaaatttaaaaaacaggtttcatttttattgtacatacataaactgtagatgtatgagtgcttgcctgcatgtacatcactgtaccatgtgcatgaagtgtgcatgcaggccagaagagggcatctgaacctctgtaaatggagtgacaggcagatgtgagcgtgtgagtgctgggggatgagtgtgagtcttctgcaagagcaaggagaggttttaacccctgagccatctctccggccccacaaaagacatctgagggaggcaaaacgattttccagtgtgagaattttgagtgaatgacagaaatatggcgaacacagcaaggaaaggaatagtggttattaaatattattctttttttaaatttaatgagagatgtcttttttattggatattttcttcatttacatttcaaatgtgtttccctttccaggtctcccctttggaagccctctatcccattctccctcccactacctctatgagggtgctcctccacccacccactcactcctgtcttcccgccctggcattcatctacactgaggcatcaagcaccctccgactcaagggcctcttctccctctgatgtccaaaaaggccatcctctgccacatatgtggccagagccatgggtccctccatgtgtactctttggttgggtggtccagtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgttgacactgttgctctctcccatggggctgcaaaccccctgagctcctctgacccttctccaactccttcatcagggaccccccacactcactccaatggttggttgtgagcatctgcctctgtagttgtcaggctctggcaaagccgctcagaagacagccatataagactttattcttaaaacaacctgtcctgcctatgcacaccaacctcaggtgcacaccagcctcaggtgcacaccagcctcaggtgcacaccagcctcaggtggttgctttctattcattcacccatttattattacaactctccagccattatttaataaagagcaccaagtgtttactaaaatgtcaggcactttgagggaagacagactggagagtagagaaatgacttgaacggtacagaattgatgccagttctctgaaatgcacagatgtgtgggaagataggtcactgccgtgcattttatcatgcagggtgatgaacataaaggcagaacaaggttgtagacttactgtgtgttgttggttagggcagaattcccagcccagtctggcgttaagggaaagctgtctagagcttgtgctgagacctctgggctgaatcgctgtgaggcaaagacagtgaaggaggcaaccaggcagagagagtggtgtgtgcgtgtaactgcacacccaagactcatggtgtgtaaaccacgatgcatagcgtcccccacttatagacctgagggagaaaacagaaatctgtgcagagatcagagaccagccaggaccagattgtgaaattcctgatgaattattacccctaaggagataaacctaatatccacaaataacagaaaacacagtgtttgccatgctgggtcctgtttgttttgcttatgataatttccagccgtatcaaatttcctgaaggttatgtcattttgtccttcacttctaatctgtgttttccattaattaaatttgttctctgatatttccatacatgtattttctgtttactcccccccaccacacacacacacacacactctctctttcatcttcctctcaccctatcatattaccccatccctcaggttcctttccagactccatgcctctttttgttttgtgaccactgatttttaaccaggactgcccatgggttggaatatcactggagactagtttttcggtacatagctggagtgagttgtttttggagacgggggctctttccagctacctaaggctagactaccagcccgtagagccccaggtgcctgcctgtctccaactttcctgtgatgggatcataagtctatgccaacattggagagcctcatgcttgctccacaaacactttatggctgtgccttctcctcagcctaaggtgagactgtttctgagaagagaacctggtatttttatcagatttccagacaacactggaattgatgtaggaataacggcacatttgagacacgtctatttaggtttgatgcttaccatatggtagtggtgatttactattaaactgggcttcttacatactcctgatattaactctttatgagactaataattggcaaatggtgtcttggaaaagcctctgcttactctgttgactgtttcttttggtgtgagttcagttgtttcctgtgctttgagggtctagtctgttctgctgctcgggcgactggcctctgcctgtccttcctgtgagctcatctctccagtgcaagcatggagttcatttgaactgagttttgggaagagtgctcagtctagttccattgctgtgcttccaattttccatccactttgcctcagaatcatgtctttccccattgtgtgtgctttatatctgccgcagaccctctgggcccctttgtctgtgtggtacgggtctctagtcatgggtgggcaaagcgtcagatggaatgacagacagatgcacacaggagaggttgtgtagaatctgaatgtaatttgtcaaatcgagcatcaaactttttatacagaagaaaataaggaagttgggtgacacattggcaaggtacaaatgaggttaccggatgcttaatgactcttacataaaacagaggaatgaaaacacaaagactggcaggaactgggcaataaaataactgagacaaagtcagctctatctaaggtcagctatagtcttagaagccaggtgtgaggtctttacactcctagggcaagggctttcacacccaagtcatggttctaactagggagttccgttctagctaaccatctcatgaataatgcaatattctaaaaccacagcccgatctacttcctaaaccattgtaaattcctgtatatgggagcaacttggcttttattctaagtgatagtgtaataccagaggcaattctgaatatcactgaataggtaacattcttactgaattccaagcccatggtcagctcaaggactttctaggacgttcgaacactggtgaaggcttagctatgtcagaattcaatcttaaaaggcacttataataagagagcacatggatccatacaccagactaatgtgggaatagaatatgagtatatgggttaaagagaacaccagactccaggagtgagtttccgtgaaactctctgtctcgtgagtggcttttaggcctctcggcctgtcaagctgactcaaccggagtgcgtagcatatatccttgtcagaagtcagctggctgcacacaggtggccgcatttctaggtttgctattctattccattcacatccctgtttttatatatacatcatgatggtttgactactacagtttttgccatatgttttagtgtggtgtaatgtggacaggagacagagcagatgaactatagctagctgtaggaagtagcgagagggcatactacaggaagccaccctgaagacagccaaaatgagtgttaatttgagacctatagtttaatacatatggatattctaatgcctatgggcaggatatggctgcaggggatggagaaatggccagagttaaaccatctattgttcttgcataggaccaaagtcctttcccagcacccaccaggccactcacactatctgtaactccaggaccagggtctctagtgcccccttctgacctctaaaggcattgcacacacatgatacacatgcaggaaagcaaaattctcctacaaatacaatacagataaataaaccttttttttttaagttatacatgcaaatgtgtgtggataaggaatttggggcttaataacatttccttctgaaggatgaagatagatgagggagctgggcctacagaagaggagaatcagtttgaaatccttatattcttttgggcagggatttctgttttgctttgtttgccaaaagatatatattatgttatattttgttaggatgtgacttttaaactgggtgtggaagtgtatgcctttaacattagcccttgggaggcagagacaagcatatgtctgtgagtttgaggccagtctagtctatatagtgaatcccaggacagccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggaaggaaggaaggaaggaaggaaggaaggaaggaaggaaggaaggaaggaaggaagggaaaagaaaaaaggagtctttccttaccgatgaggttcataagacggttatcttgtgaaaattgcttcaacagtctttatgttcaggagcctcaccagctcttctgtgtacagcaaggagtcttgttaacatcataggcgagcaccaggatttgtctcttggttttctcttactcaaaagacattttccaggctggagagatggctcagcagttaagagcactgactgctctttcagaggtcctgatttcaatttccagcaatcatatggtggctcacaaccatgtgtaatggcatccgatgccctcttctggtgtgtctgaagacagcaacaatgtattcatatacataaaataaataaatcttttttaaaaaggacattttctcctgaagtagagagttcacccagacctaaagaaaaattcacagataaagataaaaacagtttttaaaaactgtatctgagcaactgaaaaactcaagaaatggcagtgagaaacaaactttctcagtacagaagtgacaaggtagctctttccagtcgagggctggggacaggtctttctatcaaggacttcctgggttattctggtgcctacagaagcgcaaggacaaattactgaagaagctgtcctggctatttccatattctggaaacccattactgagggctggtgcaggaagtgtcctgcccagttccctggagaccttcttttgtcctccactgtccctcacatctgctgcccagtctcaaatcaattccatcaagtgactgctaccgtccccacctacactccgccgacacttcaggcctgctttaacctcagcactgtctgaatggttcggttcctctccaggatacccccttgcctctaattttacattgttttaatcaaccttttgcttgtttgtttgttttgttttgagagagggtttctctgtgtagtcctggctgtcctggaactcactctatagagtctggcctgaaattcaagagagctgcctccctctgcctcctgcgtgctgggattaaaggtgtatgctgccatacctggcttctagtcatccttttaagtgatattattcttattcaaatatcacctttccctttaagctgtgtgtgtgtgtgtgtgtgtgtgtgtgtgtgtgtgtgtatgtgttgctgcaaatcaaactcagggtcttgcatattccaggtaagctctgttccactgagcgaagccacctccccatactcattagccctaaccgtcaacacttcttttccactctgtcgttctgagacgaacagcattttattgtcatttagcaggttgacactgagccttagactcgttatgtgacttacttagttcagtctaagtggtttccaattttccagcattataagtgactctgtggctatcctcatatacccatctttttcctgcttcctcaaggacagctttctagagggtggcatgttagactcaagaatgtacattctctctagccttatgttttaatagtggtagcatcaatgtcagtgcgggggtgtggtgggggaataaacaataattctagggatccggtgggcagggagagccatcacatatacaccagacttggcatttacatctgtggcttgacgccagaattgggccaatcatcctccatcgagctctcccagctcattcccctggtcaaaggcaccttgtctatgctgtagaaatggactggctcctcagcacgaggaaactgcagagactgttacttggatcgactagagccccttagaggcccacggtagtagcagagcctgagctgtggatggcatcttaagatatacactacttccctccagtcctctctgaagagttcttggaatgcctgcttggctagcttgtcacttttacaggcaccgagtggctttagacaaggttcagattgcactcctcagagcacattagatcctacccttttaaaaatcgaagtaaagtgtcactttaagtagcagagtcatagacagggattcttctcttggattgccaactggaataagaacagaaagttttctccttcacagttgggggcatctgtactgtgatccagaccaaggccaaaacgacagccgatgagtggggagagaattacttcctgataggtccgtactttgagcataatatgaagactcaagtagaacaatgtgagcccaccaacgatgctgtcagaaaagctgtggatgcgatgaataaacatggctgccaggtaaaagattctgatgccctgttcctctctaactctaaacaaactgttaccagaaagcaccacacacacacacctcccaccaactcagaggagactatccacctagctaaggaagagatttacaaggaagacaatacttgttcttacacagagtgcagcagttgaggccccttgtgaaagctaagattctctaacaggacgaggagatggaagccccaggaagattcagggttgatggggtcttgaaaaagctgtacataaattgaggccaaagtcataagagtcgatgacattagtcaatagtggtttactaagagcacgctttcatccaaactatttatatgggcctggggatgtagttcaacagtagagtgcttggctagtgtgcatgaggccttggggtctaagttagatagagccttactcttgtacaaaataaaataatatattctgttgctacgataaaatgccctgaccaaatgggagttagtggagaaaagtttgtaatgccagtaccagtggttcaaacagccttcttttgctcccttgagaaccaggcagatatatagtatacannnnnnnnnnnnnnnnnnnncagatatatagtatacagacaaaaatgcaggcaaaacactcagacttgccatgtggtagcaaataggcagactggattacataacgagtgcttctcatgctacgaagttgaacccagtacagcacagaatcacaagaaggtaacaaggaacagaaaagcagaagtcacatgatccggacccctgcctttcaaataacctcacttaatgaagagcagactctggagacagcacccagatgggtgggcactcccttcggcttcaagtgcaaacatcagctgtcatcacagctgcgtgcagctcagttggtcaatcaaaggtggcctacccgagaggcaattcacaagaggaatttctctttggcttcatgggtttagtctgggcttagctatcatcattgctttaggggtgtggtaagatggaatatcatagtggtggaaatatggcttagaggttgctctgctcatagtagacacaagcaaagggcatccaggaggggctagggactgattaaatacccttcaaatgtcccccattctaatagcttttagttgtgaattcatgaatgaattaatcagctaagtctattgaacctttatggttcaaaagctaaatgctttctaagatctaaaacaaagaacttgtgaaaattttattttatgtagcctagctctaggaatcccagccagactaataagacaagagaaataaataaatggcattcaaattaaaatgaataaagccaaactgtcaccatttaagatggtctgatcttatatacagaaaactccagagataacaccaacttccaaaggcttttgacatttgagcatttgtcttcagggaaacacttcacattgacacagcgacacttggtctgctgttgatttttgtcttagtttctttcttggggttgtgataaaatattctgacaaaagtaagggagaaaggtcttgtttgacttgcaattatagagggatatgtttcatcagggcaggaaagatatggcagcaggcaggacaatcatggtggcaggagcaggaggctggctgatcacattgtatctgcatccaggaagcagaaagaaacaggaagtggagcctggctataaaaaaatcaaggccttcctacagtgaggctccaccttctaaaggtttcataaccttcccaaatagcaccatgagctggggccaagtgtgcaagaaaatacttttgtagaggacatttcacatgcaaatcataaccctcctcaaataatggctacacattctaagtccaaatatacgtcctttctcttatgttgtacttactacgacagcggctatgctttctttccatgtcaggtgcattttggaagatggctcatagaagggagtccctacgtggtgctctttgacatcagctcctcagcatggaacctggacagatggaagggtgacttctgggaagcttgtggcgttggcatccctcatcatgaccgagaagctaacgacatgctcatatttgggtctttaactgcctggttcttaaaggaggtacagtttgcagtacactgacagagcagaggggcagtctactgtgcctaggatccacagtgacccaagagtttggagataatgcttttattgattgtcataatgcatttaaaaagaatttcaaggaaatgtttaccactcctaaactatgtgccaaccttggcaacagagcaggaatacttattgctatttatcttgtgtattatttaaatagaatcatatatgtaaaacacccagttagggctgccttgtctggcatcagtgggaaagaaagcacctagcctacaggaacttgcagtgccaaggtgagggatagccagggggacttccacttgctcagaggagaaggggagaggagatgggggaaggattgtggaagggaaacagtgagtaggatgtaaagtgaataagaaaaaaaattaaattatattaaaaacaaagaaaactattcagatatattgcctgcttatgtagataaaatccaaaatatatgtataaaaagatatacatcatgaaaagtgcaaataaattctagacagcaggaaagacttggaacattgtgttttgtgtattatggacacaggtgcccttacagtgacttcttaacatttccattatacactaacagctgaattagcctcagtagctgctactcaggagtcctttgcaacagaatagcccagcagtgcacagagaaagagcactggaggccagtctgttaaatgagcccagcctctattctctcaaactcctcaaagcacagtagtaggttttgtctgcatgttctcatcacttctagatggcagcatctaggctggaagtcagatctgaaggaatgggaccccagtgaggagggcagctaaggacagagtaacatatctgtctgatgaagtcctatacaatccctaccaggggctggctggagaaggtggccatcagcttcttggtagtagtagaggggaaggtggtttgtactttgggaaaagcctgtgtgtggtaacagatatgcagtcttttggcaccagtgacaaggtggggtgtgtgtgtgtgtgtgtgtgatttggtatgagagcatatttgtgtgtgtgtgtgtgtgtgtgtgtgtgtgagagagagagagagagagagagagagagagagagagagagagagagagagagagagagagtttgaaagaaactcccttgggtagactcagtagattctcttgatttcttcaaaagcattgcttctgttattgagtcatttactcaatgaatattactatcaattgaacgtttatttaaattattaacagtataatggatattactcttcataatacttatatgtattctatggatacaaaaataaatatggcccattcctaaaagagaggattaagagataaatagatggacttgaccaacttgtcagtaaatcttactttctcttgctaagtttgcatgctccaagtgtatgcccttttaagagaggtaagaccgccacgtctcacatctgtcctgctgtgggcaatggtcaagatcaagcgtcaacaaaaacttttctaaagtgttttcttctgatgcaggtgacagaccacgcagacggtaaacacgtcattgcccaattccatgaatggcaggctgggactgggctgatcctttctcgtgccaggaaactcccccattgccacagtatttacaacccatgccacactgcttgggcgttatctctgtgcagcaaatattgacttctacaaccagcttgacaaggtaaaacacccaccagcccccctcagccccttcctttccgttcattgaagcccaaagatgaaagatattgatcgctacgtttgagctaacaaccacatggcagcgatgccctttcagctaatcaggattcacagagcagcgtcccctgggtgatggaggtggagggagcttaattttgctcagagtgcagtgaagtgtggaggttgagagacctgaattctgctccctctctggggagacagatccagacgggtgtaacagaacagggatgctgtgcatagccagacataggctcctgttccttccagaatttgaggtctgatgaaggcagttagattactggggtctgttagctttatctcctctatcctccatgtgagctatttattggtgagcactgtgggcgggtcagcttctttctgtatttctgcagtgcataggtgacatgcttccagggctgcaagagcagctggcactggaagtggaggtaagcatctgatgatgtagctgctcagtttatacattgttcatctctgtgacccccaatcattcagttttgaatctttcttcaattttccattagttaggttagcatcataagtttcttttatcttttaattttacttatgtgtctgtgtgggtatatttgacatgtgcgcaagtgctcttggaggccaaaggagggcatcaagtctggagctggaattacaagttgctgtgaactgttcgcatgtgtcctgagaattgaactcaggttctctgcaagggcagcaagtttatataaagcacacatttgactgccatacatttaaaaagataaatatttaatattcattttacttatcaagtcagtttagggcttaaaagtttggtttcattattaggacaatcaagaagctgaaaatgtgagtttttaaaaaatctttcccagcattcaaagttctgcgatcctatgaatcagaatgtgtgtgtcctcagatgcacattcatgaataataatcagtagcctgggaagtttatgttgctgtctcaaacacatttggaatgctagaggaagctcctgaaagcctctcactgtgcagacagcggagctaatgagagctgccctacaaaaaggtcagcccgtgctaagatctaggctttacataaagtcaacagggatttatttagaaaggcaggagactgagcagacctgcaaaccatgcatggtaacagccagctaatgagggcaaagcagctctctctgatgggcactgagcagtgcagcgtgtcctgcgaaggtcagacttggagcttagcccgacaacaggatccttcactctgcactgctgcgtggtcttatagacacgcagccaataaaaaaaaaccaaaaaactaataatgtgtaatgagtagttttatttagggacagacacattatagttacaacaaaccctttggttgaaggaaataactacatctgtatgcctctaatgatggttacatatctcaagtatattcagatatgtgatatgaaattcaagcccattattctcgtgaactgttcagccagccactgcgggtaacaagtagccaaaaatcaggttttgagttaaattcataagcattttttacagcaagggatcctgtgctcacaccagacatagatttaggcaatatttaaatatatcagattatgcacctcaaataagacatctagtgtaaatgtgacgttgggcaagtttcctgaggtctggaaggttctattaccccttctgtgaaatgagcgaatttcctgaggatgaaacacggggtgaacagcagcgctgaacactgctgaagacatcccgtggctctggatacacatgagtcttattttcccttagacactgccggtgtcaccggaagccttgtgagatgtgacactggttgagtaaagtttaaagaaggcttattgaggacttggtttctggggttttgtgtgttgtttgttagctaaaaatatctagagggcactatgaaatctcataaaaatatagtaaaagatgataccaagtcaagcagcggtggcacatgcttttaaacccagcagtagggaggcagaggtattcaattctctctgagttgggggccagcctggtctacgaagtgagttccaggacagcctacagtgctacagagaaaccctgctttgaaaaacagacaaacaagcaaaccaaagccaaaaccaacccaacccaaaaggacaggtgagcccaccatctgacatatttgctatttagcatgagcatacacttctttgaaattaacttagaaggagtatgtaaccaaggaaaaagaaatactcaactttttctctctcagaagattaagtaggataataaatttccaaactttcagggtcaagattattgtcagattcgttttatttttattaatgtttaatttaattttatgtatgtaggtgttttgcctgcatgtgtgtctgtgtaccacgtgtgtgcctggtggcttctgaggacattggtcttctggaaatggagttacagatggttgtgagctgccattgggtgctaggaatcaaacttgtgtgcaagaccagacagtgctcttaactacagtcattattcagccccacgtttgttttaataacctttttaaattttattttctgcttcactgtttatgggaaatgtagaaagaaatccttggaggttagaattatccctacacttatgaactgtggggtaagaaaacatgtaacaaatatcaaatttttataggtgatgaaatagccgtttctcagacttgaagtgaacagtgctgttaaaaataccaattttatactctagccagtggcttaatatccactagtcctttaatggggtctttacaacttcaatcagctctgaggaaaaccttggcatgtggagggggtcctgtaaggaacgtgtgtttgtcttcaacagttcgacattgacaaagaggccggggagaggcagatataccaccgctactgcatggagcgggcatccgtgcactgtgcgcacgtgttcaccacagtgtcagaaatcacagccatcgaggcagagcacatgctgaagaggaagcctggtaatgacagaggctgggtttgccaccctaacacatgcagcacccttgcttaattgctgtgctctcacctgcggtttcctagttgtcagagaccacttgggtgtctagaggtggggtcttcaagaaataaataagctttgtcgaataaagcaaatacaagtggaaaataagagcccaaggagagaacagtggcagcacaatgggccgggctgggttctttttctttcccagtttccccttggatttggagttgtctcggactgtctgctgtcatgaacaccagaaccgaagcaacttggagaggaaagggtttgtttcagctcacacatcctgatcactcacagcccatcactcagggaagtcagggcaggaactcaaagcaggaactgaagcagaggttatggagaaatgctgcttaccagccagttcctcctggttcacttagcctgctttcttataccaccctgaccgcccataggtggccacacccacaatgggctgggccttcccacagcaatcactgttcaaggaactgcacctcagagttgcctacagaccatcttacagagggatttttctcaactgtgattctctcttctcagatatgctagtaaactgacagaagccaaccaacgccgactcattctcacgctccctggctaccaatgacctcatttctctgttgatctctctgtccacagggcccctctttgagattgtgcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccagatgtagtgactccaaatggtttgaatgttaagaagttttctgcagtgcatgaatttcaaaatctccacgccatgtacaaggccaggatacaggatttcgttcgaggtcatttctatgggtatgttttcctttaatcagaaataaaagcaccacggctactgaggtggctcaggtgcgaggaacacacgctccccttgtgaggtcccaagcacccacatcaggtggctcacaaccacgtgtaagtctagcctggagagaggggtggttctgatgaactcttctgacctccaagggagtgtacacacaggcacacacacacacataaagagacacacacacagacatacacagacaaacacagacacacacatagacacacatacagagacacacacacaaacacacacacaaacacacacagacacacacacaaacacacacagacacacatacagagacacacacacagacacacacaaacacagacacatacagacacacatacagagacacacacatagacacacacacaaagagacacacacagacacacacacagacacagacacacatacacagacacacacagacacacatgcacacacatttttcaagatggtttcaagcattatcacagatgtctcttgctcctgcagattttgttgttgttgttgtgttttatcagaagtcactttgttttgtttcagtcatctggactttgatcttgagaagactttattcctcttcattgctgggagatatgaattctcaaacaaaggagcagacatcttcctggagtccttatccaggcttaatttcctcctgagggtaaggaagctctgagctgtggcacagggttctaggagaaggtctttctgctgtgaggcgtgaagaactggcttccagggcatttgattttgacatcaccttgggcaggtgaaatggatcagccagtaaaggtgtctgctacccagtctgatttccatggcaagaaccgacatcatggaagagaaagcagactcctagaagcagatatctgagctgtgctcagatgcgacaaaacatttaaaatgacaacatcgttctggaactgactctgccactcaagttacatattggagtcgtatgtcactcgcatgcatccttgtctatgctttaaaagtacttgtcctaacttcacactatgcatgttatatgtcaagaaagttattttaatagtcctttccctgatgggaatttgctgaaaggtaggtacagcaaagtccagcaaacggtgagccatgcatcacttattagaaaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggtgatggtacagtgtcctgttggccacccttgtgactgtccttcttcatgttaagcagccaagtgttttagcgagagtcttccatagaacatgacagagcttgcaagttccattcctccccactccccagctataccacttccccaaggtcacagatctctaactgttcatctctgatgtggcctaccacctggaaacaggaagaaggttttactagcacaccacttctgctccggaagctagccttaaaaagaggttcccattgaattcagcagggaaacacaggccaggagggactgctgtagaagatggcttcatgctgtagttatcatttaaagtgagtagtttatactccagtcctatcacatggaagtatagaacaaatgactcaagagtgtagcagttgagacacttcgagtcggggacatggctcagtggttgagtgcacgtgcacattcagagctgggttcctagctcccacgtggaggctcacagtctcctgtcactccagttccacggcatccaatgccctcttctgatctcctcaagttctgtgctcatgtgcacacacttaatttaaaacaaacaaacaaaacagataatgagaccatctaggctttcctgaattctgtattattgtatccctagtgcttttgatatatagatttttttcctcctttagcaagatgttataccaattatcctgaaagatttcctaaaactgcaaggtaagaaagtgattagtaataatctcatctgccaaaagagtaagtgaaaaggattatctttgtataatcttttctatatttcctggaatatatccataaagcatgctttataaataggttcataactgtatcaaacatgttccatgtttggggtcattattaataaatccattcatatagttattaaatgttcactttacttgtagatgaagtaaacaaaacccatttttattaagttagagagaaaagatgattataatactcagagaaattaaaatacccaatatatagtaatttctttgatggtgtgaaggctgccacctgcggtgaacctcacgtcttatagatttcctggatggactgtcaagtttcagaaggcagaggccacccagctgaaggaaagatgaccgaaactcaggacatcgtcttctcacttcagataataaggccatgcatatacacacagttttaactgagttagttgatgctttcactccaaagctgctttggtctatgttgttgccctgtgagaaatgctaggctctggcatctgaaggaaagaacaagaaagcagagatttcagatgtttaaaaatataccagtttaaatataatttttgttcctaacatgttatgggcactcagataaaatagcacacataccatcaataatagtaacatcaatagaatgagacaaaccacatctattgtgtacggtggttataaggactagggcaactgtgtatttaaagtgccccagcacagtatctgccacatctaaagcatgtgattgtcccttaacttaaagcctaaaacccaaaatgcatcacatggattatctagacatgtagcagaaacatgttttaaaaacgtttgtaccaaccgatatgagtaaattggaaagagttaggaaaagatgaataagaaatacattctcattaaattttgaatctgaacttttaaagaaggtattttaactttttaaaaatcaggttccatgtgtgttttgttttgtttatttaaccacaggaaaatacaatgatgtgagtagtcagtattgtctattttaaatggccaaggtgtggaaatattcactgctgagaaatccttactggaaatcagtttcaattatgactgaaaagtctagagaagacatgtgcactcattcagtggctcacgggccagtgcactctctctctcacgacacgtgacaacagttttccaggtttaagatccacgtgacggtgttttctgatctttggtaggtgacggtgctatgttttctcaccctcctcagatgcataagagtaacgtcaccgtggtagtgtttttcatcatgcctgccaagacaaacaatttcaacgtggaaaccctgaagggccaggcagtgcggaaacagctgtggtaatctcacatttgtcagcctcctcaggccacacgtgaagggagtttttgcctaagcgtgtgacctctgagctgtgtcctcaaactacatttctttcttgctgactatagcataaatatggtgttgttctcctggggctagctgctgtgttagagtgtgcaatgcctgtaatgtggtggaaaatcacattactaggaaaatgtcctaacgaacaaccacagactgagcaagtatctatatgtgggctttaaggatgggctgggtatatttcacagagaaaaactaaagagtctaccaaagcaaggagatgagtgcaatgactccctctacacgcagcccagatcacacagcaaacatgtcactagcttactctgtctattcactgacccttcccactctcaaccatccccggttacctcaagcaaaaaagaattccagctctctgggctgtcaagtgttttgtccaagccttggtcctggactttttccaagcaagctaaattggccagtagggaaatactaggagagactgtgttttaaaagacttgtaacttcaaggaatggtaatgagacaacagcacctttaccacagatgatgtcttaattacctttccgtgactgtgacaaaacaccatgaccaaggcaacttataaaggaaaagtttaaccaagcattcacagtagcagagggttggaatccatggacttcgctgtgggggagcatggcagcaggcaggcatggtgctgatagcttacatcttgacccacaagcatgaggcacagagaggttactaggaattgcatgggcattttgacacctcagagcccacccccagtgactcacctcctgtaataaggccacaccttctaatcctttccaaaaagttccatcaatgggggaccaagcattcaaaatatgagcctatgtgggtccttctcattcaaacacccacaaatgaatatgaaacgttatgattccatctgaaatctttctatgttaaacagggacactgtgcattgtttgaaggagaagtttgggaagaaactctatgacgggttattaaggtaagtgattaacagccattctaatcctggggggctcagaccttgtctaagttagggttttactgctgtgaacagatactatgaccaatgcaattgagattggcttacaagttcagaggttcagtccattatcaatgtaggagtatggcagcatccaggcaggcatggtgcaggtagagctgagagttctatatcttggtctaaaggctgctagtggaagactgacttccagacagctaaagtgagggtcttaaagcccacatccacagtgacacacctactctaacatggccacaccctctaatagtgccactccttggccatcacagaccctttgggagttgaatgaccctatcacaggggttgcatatcagctataatgaatatcagatatttacattatgattcataacagtaacaacattacagttatggaatagtgatgaaaataatttatggttgggggaaccacagcatgaggaactatattaaagcatgaggaaggctgagaaccactgtgtgtagaacaacgcacacatcaacatttagggcttcaccattcacaggccacagtttagacacttacacgcattttgttccaaacaccatggaatttgcagccttcaaagatgtcacgtcagatgaatactatcattgtctctttcatttgacagtatcaataaacagcttgtacctaggagaccatgagcgcacatgcacacagattcttattcaggggcaaactcattagtacatcagtttgaaactaatggagttttgaagttcaaatatatattggcctaacttgataaatgcatgaaaaatatttatatggcaaatctattttaacagcttagtaaataccactattacagtaaatgaactatttatgccggacaattagaaagcacttaactagttccagccatttttttatttttaatactgttttcatcacagaggagaaattcctgacatgaatagtattttggatcgagatgacttaacaattatgaaaagggccattttttcaactcaggtaagaaaaactttaagtgcccaccatctcccatgatcattcaaatcaacctaggcaatattgtcttcattcatgtaaaggaatgtgctaaattaggaatcttcaaatctgcgagttgaaaaagatactggcctttcattctgtttacatttgtggttatggaacagggcaggttggaaccagaggataatttgaaggacttacattctctctttcactgtgtgggtcctaaagatgggatttaaattatcaggttggcagcaagaacctttaaccactgaccatcattttacccatttagaaaaaaatctacttgaatgattttgtatgtgcttttatgagttgtttctaggggattcttttaaaaatctcataaaagtctgtttttgaacccacttacagaatttctttgaaccaatgtactcagttgaaaaactgtgtccattatagcagagaaccttgtgacaatctccaaaagtgcagaatcctccccacagctgagaaaacgcccgttcttctcagtggaatagaattgttattttaaagtgtaatgtagcatgttagacatgcatgggaacctctgttaatagtgtggtttgctagacaattccagtgaatctcgtccatcctgcgtgaagattccaacgtgccttcacgttctagataaatccagaagtaatcatgatgcccgagccttccttacagttgcttcgaggaagggacagctttttgttcatggtctgcgaagaaagttctggaactctttctcttcctctgaaacccacaaagcttactcatgttaaccagcctcatctcagaggatgagtacaggcagcgtgcgtgaaatatcgactgccttttgcagaaatgagtcacgcttactaatgcttttcaccacggatgcgtttcttccctctgttccctcagagacagtctttgcctcctgtgaccactcacaatatgatcgatgattccacggatcccatcctcagcaccattagacgaatcggacttttcaacaatcgtgcagacagagtcaaggtagaactaattggtttgctttgcactgcttccaagtcgtgcagaataggctcagttggttaagtgcttgctgtgcaagcgtgagaagtcgaggccaccttccagctctgtggtaaaagcctacccgggaggcatgcacttgtaatccagtgctcaggggaatccaggagatccccagagcctactagcaagccagcccaggttaactgataagctccgtgggaccctacctcaaaaagtaacgtgaagagctctttagaaacaacacccagggttgagctctgctctccacacatgtgtgcccacaaatgcagggacatcaatacagacaggcacctacaagaacacatagccccatgtccatgtacacacatccaaacaaaaaataacagcatgtacttgggagagagtttattacaagctcttcattgtcttaacatcttccagaaaaaaggataaagaattctaaagaataatgaattctgcttcttggtttaggtaattagaatactcttagatattgggtaactctgagttttaatcataacattcattttaattgcacaacgtcatcagtagacacaagaaaagttacctaatttttaatgattaaaataattattttattgattattattaattattttaatgattaaaataattctaaaactgatataagttaatgcttttttgttttcttttatgtattttatttttaaaattatatgtattcatttattctgtgtgtgaggtaggggatgaaatgtgctatgatgctcatgaaaaggtcagaggacaatttgtgggagccagttctctattgccacctttggattccagggatcaaactcacgctgtcaagcttagtgataatcacctgtacctgatgagccaccgtgctgaccctgtggtgtgtttattataacaattcatagtcacacggatgatgctttattattattttatgtgcatgggtgtttgcctgcacatatgtgtgtgcaccacatgtatgcctggtacccaaggaagccataggaaggcactagatatcctgaaactggaacttcagatggttgtgagctgccacgtgggtgctgggactcgaacccagttcctctggtagattaattagtgctcctgatgcacctctccatttgccctgcctggtttctacattggctctgcatgcttgtgcagccagcactttatgcatccctctgtcttccaagctgtgtgtccacttcagtaggctttaattccagagccactttttaatttccatctgctggctgtcccacccaggaaccacctcctttctgttacaccctcactgggttcagtccatttgctgcaactgatgagtctcagctggtacactgctatccctccagattaatcctttgtattaggatcatctgggcatcattctaagagtagacaactgaacaatggagtgttatgatcatttagagtcgctttcctaaacatgctttgtgttctacatattctccatttcagaataggtggtaactcctgataactctttcttttctagtctatcatatagccatgatactctacattataagtagatttttaggctttgacatactggttcatgaacagcagcagcacaccgctgcacacaggccttcatgcatgtgtgacatttttctttgagtcacatgtggctttttgagcagagtcatgaataccatctttacaggacactccagttgttgtgcagactagaaagccttgaggaatcaaagcaaagtgtggtaggcggcaactgcctctaggtgagaggggatggcaagtttaatctggatatgagtgttccaaaatcttcctcccctgagcctcgtttccctcagctaactcatgcatgggtcacgggtgacccatcctctctttcctgttcaagttgggagcaaactgacaaataatacagaggtcagcagatggagaaccaaatacaactttcattggggaataaggctggagaggggttggggtgtagtctaatgtgaaagcagaaaatgtatgtgttaactaaaacccctgtgatccaagatgtgagggtgagggcaatgttaagtgtgcagagtttgagctacagagtggagggacgaagaaagcagagcccacattctttacaatttatctttccctctatccctgaatgtacaacacaggactccgtatttctgagttaagcaaagcgtagacaggttttttttttgctttattttcttcatcagaactttcttttttaggtgattttacacccagaattcctgtcctccaccagccctctattgcccatggattatgaagagtttgtccgaggttgtcaccttggggtgtttccatcgtactatgaaccctggggttacacaccaggtgtgtgatatgtgtagaatgtgggcgaattctgatttggttgcatgctatttcaaacgtgtgtatgtgatgttaaaattgatcagaaactcctatggcggctttgttctcagtttgtttaaaaatgatttgggttggatccatttcattgggtcaattcaatgctttgcagattctaacctaagattagggtcaccaccctggtgagtcctgcacagggaggtttgcttccttctaagtggacatccagcctggtacctcactgtcctccaaagagaaacatagggttttatggggattgtacactcttcggttatctctccagatctcattaatgtgaagtaggaaccaaatatatagagctagtataaaaacaggaagtcttaccatatggttttctacaagctatttcagaagaacatattttaaacatttaaatcaattttgtaaaacaaaagtcagccatgaaaacccctctacgtctttgtctttcaaaagacagtattaagagagcgtgcgtctggtgttgagtaagacattgtagtcaatgccatcctacattcagaaactctgacatctctattttttttttccagatcaatagtcaattctcaaatctactctttgtcattttctcttctggtccttaagtggtgtggttactattagcaacaagagtgatggatttgcatttgtactaaagcatcttattaaaagagaagcatggcttagagtcacagctcagtggtagaacatgtactgatactatacaaggccctctctccaattcccagcaccacgaaatagacaataatttaaaaacatatacattttgcctgtcttccagaaggaaagaacaaggtaattagtttcttctgttgtattagtaatagcagacactcttcctgattaaggtacaattgcatttatttcaaaacaaaatgctaaaaaatattattaactacagctcaagggacagcagaggccaggtaaaggtaaattattattaagagaactttcacttcaaacattgtctctgtaactccatccatgggtattttgttccctattctaaggaggattgaagtatccacacgttggtcttccttcttcttgattttcttgtgttttgcaaattttatcttgggtattctaagtttctaagctaatatccacttatcagtgaatgcatatcaagtgacttcttctgtgattgggttacctcactcaggatgatatcctccagatacatccatttgcccaagagtttcataaattcattgttttaaatagctgagtagtactccattgtgtaaatgtaccacgttttctgtatccattcctctgttgagggacatctgggttctttccagcttctggctattataaataaggctgctatgaacatagtggagcatgtgtccttgttaccagttggaacatcttctgagtatatgcccaggagaggaattgctggatcctccggtagtactatgtccaattttctgaggaatcaccagactgatttccagagtggttgtacacgcttgcatcccaccagcaatggaggagtattcctctttctccacatcctcgccagcatctgctgtcacctgaatttttgatcttagctgtgttcttcttgtatcctcaacctctggcttctacagtctcttctctccccttttctttagggttccctgagctctgcctaatgtttgtctgtgggcctctgcatctgttccaatcagccattggaggaagtgtctctaatgacaattgggctaggcatcaattctatgagtatatcagaatatcatttggaattatttcattgagtgttattctattttacttatttattattggacagttgcgtttggcttttgcctaagtctctgagccaccagacccctgattctaaccatctaggcactgtcaagcatgggttccctttcatgaagaggacctgttactgaataatattctactatgtaaatatattacattttcttcatccattctttggttgagaagcatctaggttatttccaatttctgtctgttatgaacagggttcataaattcattgtttttaatagctgtgtagtactccattgtgtgaatgtaccacatcttctgtatccattcctctgttgagggacatctgggttctttccagcttctggctattataaataaggcaagtgtcctaatggtaggataaagcatcttttgggtatatgcctgagagtggtatctctgggtcttgaggtagatcgatatccaattttctgaggaacagccataataatgatctctatagtgcctgtgccaattttcactcctacctgagatggaggagtgttcttcttgctccacatccttgccagcagggctgtcagttgtgattttgaccttagctattctgacaggtgtaagatggaatctcaaagcaattttgattctcactttcctgatgactaaggacgttgaacacttctttaagtgtttctcaggcatttgagattcctctgttgagaattctctggttagatctgtaccctatttttgattggattatttagtttgctgatgtctactttcttgagttctttgtatattttggatactagccatctatcagatatggaaagctgaaaaatctttcccgattttgtcctattgacaatatcctttgccttatagaagacttttcagttttatgagttcccatttattaattgttgatgttagtgcctgtgctatcgatgttctgttcagaaagtcatctcgggtaagaatgtgtttgagactattcatactttcttttctatcaggttcagggtgtctggttttatgttgaagtctttgatccacctagaactgagttttatgcagagtgatctgtacgaatctgtttgcattcttctacatcctgatattcagtgagaccagaaccatttgttgaagatggtttttttcattgggtatttatgacttctttatcaaaattccagtgtccatagatgtgtggatttacatctgggacttcaattggattccactgatcaatgtgtttgtttttatgccaatattatgtggtttttattaatatggctctgtaggacagcttgaaatcaggaatggtaatacctctggaagttcttttattgttcaaggtttttttaaactatcatttattttttgttatttaaaatatttatttatttattttatgtatatgagtacactgtagctgtctttagacacatcagatcccattacagatggttgtgagccaccatgtggttgctgaaaattgaactttggacctctggaagagcagtcaatgctcttaactgctgagccaaccctctagcctttaggtatcctttgtttttgttgttgttgcttccatatgaattcaagtattgtccttcaaagctttgtattgaatgatgttggaattttgatggggattgtgttcagttggtagattgcttttggtagaatgggcatttttttctgttaatcataccaatccatgagcatgggaaatctttccatcttcagttatcttcttcaatttcttttttcaaagacttgaagtttttgtgatgcaagtcttccacttgcttggttagggtcaccctatgatattttatattatttgttgttgtttccctgacttttcccctcagtacatttttcacgtgtatatagaaggctactgattacttgagttagtcttttatctagccactttgctgaaggtgtttattggttgtagccattccctgataaaaatttttggtgttgcttatgtattctatcatatctgcaaattgtgatagtttcacttcttcctttccaatttacatccccttcatctccttcagttgtcttattgccctagtactatatcgaatagatatggagacagtggacagcctgtcttgttcctgattgctttgagtttccctgcgttaaatttgattgttggctacaggcttgctggaaattgcccttattatgtttagctgtgtccattgtatccataatctctccaagacttttatcataaaagtgtcaatggcttttatttaattttatttctggcttaatctaaggagataattatgtgatcctctttctttcagcttgtttatgtggtatattacattgacaagatttttgtatggtaaactatcactgcatctctagaatgaagcctacttgatcatggtgaatgctgtttttgacatcttcttgaatttggtttgcgaatattttattgaatttttttttgcatcaagtttcataagggaaattagtgtgaaattctatctttgttgagtctttgtgtggtttaggtatcagggtgactgtggcccaataacatgaatttggcaatattccttctgtttctattttgtggaataatctgagaagtgttggcattaactcttctttgaacagctagtagaggtcttcattaaactgcttttttttgcttgggagacttttcatgactgttgtattttcttgggggttatagagctttttaacttgtttctatgatcttgatttatctttggtaagtggtatctattgaaaaaattaataatttggcttagagttcctattttgtggagtatagttttttgaagtatgacctaaagagccttggtattccctgagcatctattgctatgccgctcccccttttcctctttggtttcgttaatttggatattttctttccatcttttagttagtttggatgaaggtttgtctatcctgttgattttctcaaagaaccaaccctttgtttaattaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgttatgtctcccttttcatttctgatttgttaattaggattttgtccctgtgccctctagtgagtctacctaagggtttatctatcttgttgattttctcaaagaaccaactcctcgtttggttaattctttgaataattcttcttgtttccacttggttgatttcacccctgagtttgataatttcctgccatctactcctcttgggtgaattttcttccttttttttctagagcttttagatgtgttgtcaagctgctagtgtttgctctctccagtttcttcttggaggcactcagagctatgagtttccctcttagaaatgctttcattgtgtcccataggtttgggtatgttgtggcttcattttcattaaactctaagaagtccttaatttctttctttattccatccttgaccaaggtatcattgagaagagtgttattctgtttccatgttaaagttggctttccaatatttatgttgtcattgaagatgagccttagtccatggtggtctgataggatgcatgggacaatttcaatatttttgtatctgttgagggctgttttatgaccaattatatggtcaattttggagaaggtcccgtgaggtgctgagaagaaggtatatccttttgttttaggataaaatgttctgtagatacccgttaagtccatttgtttcataacttctgttagtttcactgtgtccctgtttagtttctgtttccacgatctgtctattgatgaaagtggtgtgttgaattctccccactattattgtgtgaggtgcaatgtgtgctttgagctttactaaggtgtctttaatgaatgtggctgcccttgcatttggggcatagatattcagaattgagagttcctcttggaggattttacctttgatgagtatgaagtgtccctccttgtcttttttgataactttgggttggaagttgatttttttcaatatcagaatggctactccagcttgtttcttcagaccatttgcttggaaaattgttttccagcctttcactctgaggtagtgtctgtcttttcccctgagatgggtttcctgtaagcagcagaatgttgggtcttgtttgtgtagccattctgttagtctatgtctttttattggggaattgagtccattgatattaagagatattaaggaaaagtaattgttgcttccttttatttttgttgttatagttggcattcttttcttgtggcagtcttctttttggttcattgagggattactttcttgtttgttctagggcgtgatttccgtccttgtattgcttcttttctgttattatcctttgaagggctggattcttggaaagattatgtgtgaatttggttttgtcgtggaatactttgctttctccatctatgttaattgagagtttggctgggtatagtagcctgggctggcatttgtgatctcttagtgtctgtataacatctgttcaggctcttctggctttcatagtctctggtgaaaagtctagtgtaattctgataggcctgcctttatatgttacttgacctttctcccttactgcttttaatattctatcataatttaatgcatttgttgttctgattattatgtgtctggaggaatttcttttctggtccagtctatttggagttctgtaggcttcttgtatgatcatgggcatctctttctttatgtttgggaagttttcttctattattttgttgaagatatttgctggccctttaagttgaaaatcttcattctcatccactcctattatccgtaggtttggtcttctcattgtgtcctggatttcctggatgttttgagttaggatccttttgcattttgtattttctttgattgttgtgccgatgttctctatggaatcttctgcacctgagattctctcttccatttcttgtattgtgttgctgatgctcgaatctatggttccagatttctttcctacggtttctatctccagcgttgtctcgctttgggttttctttattgtgtctacttccctttttagttctagtatggttttgttcatttccatcacctgtttggatgtgttttcctgtttttctttaatgacttctaactgtttggttgtgttttcctgtttttctttaaggacctgtaactctttagcagtgctctcctgtatttctttaactgagttatgaaagtccttcttgatgtcctctaccatcatcatgagaaatgtttttaaatctgggtctatattttcggttgtgttgtggtgcccaggactaggtgcggtgggagtgctgcgttctgatgatggtgagtggtcttgatttctgttagtaggattcttacgtttgcctttcgccatctggtaatctatgaagctagctgttatagttgtctctggttagagcttgttcctcaggtgactctgttagcctctataagcagacctgggaggctagctctctccttagtttcagtggtcagagtattttctgcaggcaagctctcttcttgcagggaaggtgtccagatatctggtgttcaaacctgcctcctggcagaagttgtgttccactcacctgaggtcttaggatgccgtggagaatcctgtgtgggtcctttcgggtgtcgggagactccgctgacaaggcaccccggtgctcgagtggagcggaaggggcttgtgccccaggtcaggcctggatcgtctgcttccctagttaatgcagtctcaggttccgcgcgattggattggggcagatgctgtgttccactcaccagaggtcttagaatcccgtgggggatcctgtgtgggcccttgcgggtgtcgggagactctgctggcaaggcaccctggtgctcaagtggaccggaagggacttgtgcccgtcaggaaacttttagatgtaactttttttgactgatgtatctatttcttgtatcttcaacacctgagattccctcttctatctcttctattttgttggcaatacttgactttgcagttcctattcatgtccttagagttttcattttcagaattccctcagtttgtgttttctttattgcttttatttctattttcatgtcttaaactgttttattcatttacttcaactgtgttttttcttggctttctttaaggaagggatttactcattttctttaattttttatttgtctttcccttgatttctttaagggcttttttcctttctcctttaaggacctcctctgtcattttcataaagttggttttaagttttttttgtttttgtttttttttctcttgtgtttccttcgggttttctgaagtaatacagctgggctctgttggtaatgtagtataccggctgtttttgattatacacatctgaatttagggtgattatatgtctaggcatcaattttagggtttgtctttgttggaagagtattttttccctggtttctgtttcctctcttgtcttctggcctgtggggcctgtggttgatcagaggtctccaccctagttgggggctggatttctggtggctactgtgatctcttgtcaagccaggagtgtctgctccagttgaggactagagttgtggtgacctgcatggcctctgattcagtaggtaggcagtctctagttgaattggaatctgaagttgtcatggctggtgtcgcctctgctctagcaaggagtctctgttaaagttgggtcctggtctctggcattcatttaggtgggggtatctgctggaattgggggctgaggcatagcaatgattcggggtgggggagcattggttctgatagaagcaagaaagaaggttagataccttctgacaattctaacctgacacttgaagaaaaacaatctttcaggtggtataatttagccttctcatattccataatctctagtttattttaataataatattaaatagtgctgttctaattgtagaaagcattcattaatgccaactctgctagttgattttttaaaaattttttatttttatttttttgtcaacttgacacaagctagttatttggaaaaagggaacattgtttgagagaatacctctatcagattggactataagacaagtctgtaggaaattttcttgattaatgactcatatgggaggatccagcccagggtgggtggtgccagtcctgagcaggtaggcctgagctgtatatgaaagcagccatgggtagcaaaccagtaagcagtattcctctgtggactttgcttcagttcctgcattcaggtgcctgctgagtctttgccctgattcccttcaggatgcactgagatacaaggcaaaatataccctttcctctccaagttgcttatggtcatggtgtttagcacagcgatatatattatagcaagctaagacaccagcacggtgctttgagaaagcccaagaaaacactttattaaattcattcaaggggcattcttggttttctagattttacaacaaaatttattagtaaattatttaatgagaaaaaaatcatttttttaaaatctcatggcgttttaggcaaaggtgaatttatgagtgtatgaattattcccaggaggagtttcaaaattttcagtagatttcaaagaagctggtaatccttatgcacttcttctggctcttccctaaaggtaaaaaaaatgttgctgtgtagctaaagaactgatccaggaggaaagactcacagtcagagaagaaaaaactgtgatctaagctgcacaacacaatacacgacaggcacaacttttacacccatctcctctcaagaaccaaaactttccataatgaaagaaacatagattacttgtttaaaatgtagatgttgggcagggagacagctcctgagttagaaggtttgccatgcatgcctaaggaccatcattcagatccccagaacacaccaaatgcccaagagagtggcactaagcctgtaattctagcctctgagcaagtagacagggattccacagagcaagccggccagctatgcaagctggatcagcaagctctgggtttgatggagagaccttgcctaaatggatgaggttgaagaacacttgaggaaattttcttagtattaggtatgggcatcgacaggaatgtgcacacacaggttcacactcgtacgcacaaatggacaaagaaaacgtagctatctttgaaagaatgatatttttagagacagctgcgcagctattttgcaggagacaggtaagggaagacttggactatgaattccctacaccctcaagagagtagcaggttgtatgtggaggagattaaggtaacagagaacctgtctgtatccaaacacatactcatcctgataaagttgcaaagcagggtcacaagctcagaacagaacaaaatcaaaccagaaagtagccatctgggctcagacagcagagagcagcaggtcccagcagaagctcttggactggatgtctagcttcaaatcccagcttccctgtgcaatgtccccgattctgggagtggccaagttgcaaccactccccatgttttaatttcctcacgttgtcagagagggatgatgtcagacacacttcacagggtggttttgaatattatctatgccatgagtgtagatgaagccctactgccatgcctggcaaggagtaaagatggctccagccaggcagccaggatctttctcctccacatgcatgtgaggattgggagcaggtctgatgctcattctttgtccattctctggcagctgaatgcacagtgatgggcatccccagtgtgactacaaacctctccggttttgggtgtttcgtgcaggagcatgtggctgaccctactgcatacggtgagattttcctttccattgtgacctgagggtcttcacggggcataccgctaaagctgtcctgaaaagaaactaaagcttatatttcttgtttaattaaaaatagatttaagtagagatccatagaaaaaagtgttcctaatattgaatattctgcccccaagaagaagaattacacaagggcagatgttgagcaaactttacctttaacttattccttgatggtagtgatagggttttttaaattcctaggagcactaatacagtattggagtatgcatattgattcatctatagcaacagctctcaacctgtgcatccaagaaccttcacagaggttgaatatcagatatttatgttatgaatcataacagtagcaaaattgggctggagagatggctcagcggttaagagcactgactgctccaaacgtcctgagtttaaatcccagcaactacatggtggctcacaaccatccataatgagatctgatgccctcttctggagtgtctgaagacagcctgagtggagccataatgagcagggccagacagagagctggagagttggctcagcagttaagagcactgactgttcttctggaggacctgagttcaaatctcagcaaccacacggtggctcacaaccatctgtaatgagatctgatgccttcttctggtgtgtctgaaaatagctacagtgtacttataacaaataagtaaatcttttttaaaaagtagcaaaattatggttatgaggtagcaaaaaaaataattttatggttggagatccccacagcatgaggaactgtattaaagggtcacaacatgaggaaggttaagaaccactgcatacaaaacacttttattcttttaaagatccatgtattgaggtaggaaaaaaaatcacttatttaagattgtaggagaattcttgtttcattgtgtatctgttcatgttgcctagcaacaagaaatttaggccaggattagttctctgtctgtgccttggctgttgagtccacagggggcagctttctactaggtcagaggttgtaagtggaagcacagagttggggagaggggacctggtagtagattccatctggtgtttctggttaataacaattaatagagaattactgaccccagaggtcttgatatttttttaaaggtaagatctgctatgctggcagacatttgctggtgggttttaataattacatcatagaaaatggacaggagaaatggctcattggttaagagtactggctgctcttccagaggtcctgattttttcaatttccggcattcacacggcagctcactactgtctgtaactctagttccagggaatgcgacacctttatacagacataaaggcaggcaaagcaccaatgcacatgaaataaaaataaataatttaataaatagcatagaaaatatataacattagacaagaaaaagataaagtgaaggtctttgcagctgaggcaggagactgatggcaggctagtcacggcctttggcagaacctgaggtaataaagaagggaggagcaatgttccttagctccaggttggaagctgtgctttgatttgtgtgtgtgtgtccttcaggtatttacatcgtggacagacgcttccgctctccagacgattcttgcaaccagctgactcagttcctctacgggttttgtaaacagtcacgccggcaaaggatcattcagaggaaccgcacggagaggctctcagatctcctggactggagatacctgggcagagtaagcaagttcctcaggacgttggaggagcatgtcgagactatcctgcacgatgacaatcttgcctctggtcacaatatgtaaagtcaactcagtaccataagctggaatctcagggccatatccctgtactttttaaactgaatgtgacttctcaaaacttctgaagcccatgtcttcatgggtttagaaatgtgtgatatcaagtctatcaggatgtagcatgaacctggcctgtgcttagcttgatacataaccagtattcaaatatatggagttaaaaagaaaggtcaagagcaaataccttgcttatttttcccagataagacaagtgtattcttcaacaatgcccagtgggaaggacacggttggtgaatgcaagtataaacaatgtctctttacaccggtgaaatgggtgtgcaaacacccagatgtccacctatcttaaaactgagtgatttaatactaagcaaagtaccttagccttccgatggtatgcttgtcacatagtattgggttctcctagtcaagaaataggtgcagccaagtgctgagtatctacacccaataacactgctgtttgccatgagctaaggggttaacttcactagctcatttgatcagagaacaggagggccagggtctcaaatgttctgttctttacctaagtctgggcagagttagtgtccagtgtctagatatttaaaactgagggcaatattcagtcatgtttgtatttaatccggagctcagcttggccaacactgctgatctccctcaatgctttgcagtatttctgggcatgtatattgacaactaataaaattatagatggtcatttcttcatttattttccaagttaggacacgtagataccccaactcacatatacagatagctgttggtctatgcaatgtctgacagggtaaaatattagatgataacccacaacaagttttatatattagttaatattgagataggtatttcaggcttgggaacatagaaccttatatcataacttgattactgacatatctaattttgatgtgtaaactggctttctcttgacagtattaccagcatgccagacacctgacactgagcagggcttttccagacaaattccacctagagcccacatcaccaccaacggtaaatacttcctatgttgttgcctttttcaaaaatgacatttcctatttggcagttctatcaataagtttgaatctgagcatagcaaaatattccaatagaatgcctttttaagcattgagtcaaagcagagaatggaggcacaaatgtctagatggctaattcacaccatcagagaagtatctctttattaaaactctaccttgctgctcggaggctctgttactctcccattcgcctgagagttatcgacaacagagtgggttgatctaacaggaggcagctctctatctagggaagtgtttcaatttagaaacttgccacttggcaagagtaaaatagagaaaattcaagatcagaggaggaattggaccctgtcttagtcagggtatctattcctgcacaaacatcatgaccaagaagcaaattggggaggaaagggtttattcagcttacacttcccacattgctgttcatcaccaaaggaagtcaggactggaactcaagcaggtcaggaagcaggagctgatgcagaggccatggagggatgttccttactggcttgtttcccctgctcagcttgctttcttatagaacccaagattaccagcccagggatggcaccacccacaaggggtcctttcccacttgatcattaattgagaaaatgccttacagcttgatctcatggaggcatttcctcacctgaagctcctttctctgtgataactcgagcctgtttcaacttgacacacaaaaccagccagtatagaccctatgagtgtttatgttctgttcagcacagcccatagaggtcttcttctaacgtccaattagacatctctatcagtgaaactaccctagttcacacatgagctcttctaaagatagaagacaggacacgccctgaagagatgtttaggctttcctcttcagcgtgattagtcccatggagtctgcacactgatccaaggactacactctttaaccttgcatccaatgggggacagcctcagagtgagaagatgaggtattttaagtgtgcctaccctttggtattgcaatactgtgttgtcatttacacttgagaactgtgcaatcaagatgacatttaaaaaaaactcaaaaaggaagtcttacattaaagaaaaaatttacaattttgtattgagccacattcatagccacacttggcttcatgtagccataggtagaccatggatggcagattggacatttaagtcaacattatatataagatcgccttagggacatatacatatagtcccagttattcagaaagccaagtcatgaggattatttagattgtgagtttaagacaaacatgagcaacaaggaatgagtctgccttaaacaaacaagaatacatacaaacataccaagaaacaaacagaaaagacccactttgttcaggacctctgcgtcctgaaggagcctcttctgagcatatgtccacaaatgggcttttaataattttcacaacaaatatgctcagcgtcaagggtcatcagtttcatcaaccccaaaccatccatccacatcacaggctcacgaatacctcaagtccagctgtgctctgatcaggaatctcaagccaggcatcatttgtactaaaacaattttattggataacccaacacctaacccacctagcttcgatttctggaagatatagggaagggttcgtcccaggggaggcaaaaatgatcccctcccccctctgcacactccagcttctgcatttaccatgtgagcactgggaggtgtgggtgcctcatttatctaaagatacacttcacttgctgacgaggctacattcacccatttatattttattcaataatgagtatttagctcttactcctaagttcagttcagctctttaaaaaaattccttgataatttcacacatgaatacaatgtattagatcacacacacacacacacacacacacacaccaacttcatggcttcccttcttctttctctgttttccttttccttccttctcctccctctgacccattgagtccagttggtgccacatgagtgcagggaattaatttgtatgttaccatagaagaatgggagtcattcagtccacccctcgctgaggagactgtcacgagctgattcaggtcattgccgtggtgggttattcatgctctacttccttttctgctttcgggaaaagtaccaggaccttgaaatgactatgtgtgtgtgtgtgtgtgtgtgtgacttaataataacgcatatacatgactgagagagaagttgaagagggtcttccaagcacacacactctatgaggcagggacgctgtcgctatgtctttggtggtattgtgattcatgacacacatgttcagcacaggtttgtcaagtgagctttctctaggactctgagctagctgggcagtgtcactgaaaaccaggtggtgtcttctcatgaagtaaaagaatgtaattggtacaatctcagaaatcagtgaggacacccagccatccagattctctcgtggtggctgttggtggcctatgtccaggaactttcccaaaacatttgaaagatggcagagggatactagtgagatgaaagaaagaccctggggttgtcacagatcaggaactgagtttcatggtaccacatacatgctgtggcctctagcaagtcatttaccttttctgcctgtctgtctgtcatctatctgttttctgtctgtctctctttttctctctttctctcagaggagaagcagaaagaccaaatttatgagaatattgctaaaatattaaattatacagtttacaattatatacaattgtcatagacaattggtgcactttaggctcaatcaaagataactgcatgtttaatgaatcgatcttaatggtgataataccagcatcaatgttcatgagcatcggatgggttacaactgaattagcattagtactgtctgcatcgttgaaagccaagaagtcagagatggctcatcagttaagagtgcttgctgctctttcagaggacctgagttcagttgccagctctcctcaatgagtgattgcctgttacttcagccccgggcaatggtttctgtaatctcctgctctctctctctctctctctctctctctctctctctctctctctctctctctctgtctctctctctgtctctctctctgtctctctctgtctctgtctctgtctctctctcagtgtgtgtgtgtgtgtgtgttacacaatgtacttaaaaaattttaaagaccactacattaagaaagatacaacctagccgggcgtggtggcacacacctttaatcccagcactcgggaggcagagtccaggtggatctctgagttcgaggccagcctggtctacaaagtgagttccaggacagccagggctatacagagaaaccctgtctcggaaaaccaaaaaaaaaaaaaaaaaaaaaaaaaaaaaaaaaaaaaagaaaaagaaaaagaaaaagaaagatacaaccagccaggggtgtaggcaaaggcatgtggagttctgtgagtattgtgaattccaggacagtcagggctatagagagagaccatgatacaacaacagcagcagcagcagcaacagcaacaacaacacaaacaaaaaagagaaaaccaagaagtctttttttaacatttgtgcctcatttgtctctggcagacggatggctttaagtatcccaggccctcctcagtaccaccttctccgtcaggatcccaggcctccagtcctcagtgcagtgatgcggaagacgaagaagatgaggatgagaggtatgatgaggaagaggaggctgagagggatcggctaaatatcaagtcaccgttttctctgaaccactttccaaaggggaagaaaaagcttcatggagaatataagaactgactgagctcaaacgaagtaagatgttcctctgtgtgtgaagttcctctaagaatcacagtggaatctgctctctgcccataaagaatggaggggatttagtgaatgacagttttgtaatttggaataaaaactgacatttttatctttgggtcttttgtccccaaattttgtaaaaatttagaaacgagggggattttttaaacgggcagtgctggaggcattttaaagatggttaatttagctggagatggtaactcacacttgtaaccctagcactcagaagcctggggcaggaggattgccataattggaataccagactggtctataaagtagggccctacattaaaaaatcatggctaatgtaaaagatcagaaaagtgtagctactgctgtttacagcattctcattttaatcctttgattaatatttatgaagcttttctacgccaaacaaatctcttccagcagagatagaatcatgactatgatgatatgactcacgtgttttagataattgagactttattatgcttttttgtgcattaaagccatgaattctcattttgctctgcagatgattcagaatccacaagaaaatgagctgccccaagtccacaccctgatgcagaccaacagatatttacatcctgacatctgaaatctagaatttgtatccagatcattgataggaacttgtagccaccaatgtgagtcaccttactgtaacggtacttttgttgtctaattggaaatttcaatctgttagagataataaattgccaaattcaaatgagtcaatgtgtcactgtttgtagatcttattttctttgataatatccggcttaaaatgtttcagaaatcacaataccacatgaggaggggcacttgttgtgaataccacctagcatcattgaaactgatcttaaaaaaaaaagtggaaaatgaagaaattctctgagatgtaggaacaatttctctaccatgtcctgtggtatatttaaggtgatagtttaatgattgcacataagcagatgtgtgtcaaatctaataaaatctaaattgacacaatgctaacaacagagcccagattcacccatttctttttcttgtaactgaccagccaatcgctgtgtcccacctactgcacactgatcactttgattgccatatcaattaacctagctctgaaaatgttctgtaaagagtcgaccttcctagagctgagttgttgaaggtaacagtggaagaggcacaatgtcacatggttgcaggctgccatccaacacctgtttcctcatagagaaagtggaaacatggacacaagcaatcaatcaaaccaccagaggaagggacatgagttatgtaaagctcagtcctgctaaaaagaaattccccagtatggtaacattggaagcctgacccttgtaaggtgtttaggtcatgagggcatagtctttaggaatgatgttagtgaccttagaaaagtggcttccctgctggagttgtagctcagagatagactgcttgttcagttgcatgggactctaggttcagtacccagtgccaaaataagaaaggacaaagaagagagaaagaaagaaagaaagaaagaaagaaagaaagaaagaaagaaagaaagaaagaaagaaagaaagaaaggaaggaaggaaggaaggaaggaaggaaggaaggaaggaaggaaggaaggaaggagagagcaagggagggcgagagaaagaggaaggaacgaagggagaagggagaggagaaggaaaaagatgagggggcataaattgaaagaggaggcagagaaagaggaagaggagaaggaagaggagggggaagaggaggaggagaggaagtttccttacttttctatcacttagaagtgtagcaagcaacggcaaagagccacctatggggaagtagtccacagcagacatccattctgtcaccatgctaaccttacacttccagaatggtaagaggcaagtttgttttaaactgccagttcagggtggtttgttttagcagtccgagctatctgaacccaccactctccttctacagccaagtcatggtgaacagagcaggcttaacctatgcagctatgaattctaggtcttacaaatgtcacgctgatggcttctcaaggcatcaggactttactcaaggaaatcctaagagtcctcattggaggggctcaagtttctatgaggtaacatgatgactgggctgcacctccacacaatggtttttaagaattaaataaagtgagaattgagctcttcctagaagaattggccactggaaagactaaactgaaaggagttgtcacatcaccaactgctctttcacttgaggccaggataaaacaaccagactcaaggctgctggtatacattcatgcttttaacccagtagagaagaggtgtggactggaggctggtctgaacaaggcagagcccctttgccctcatgtctcctctttcaggatcacaatggtgttggggtttggagagacatcgatcagaaacacagagagacagacaatcaagaatcaaggctaagataaggggtaaagcaatgagagggaaggcaccctgaatcctgctgagagtggttggatatcctgcagagatgggacagtccatgtgtatgcgtcaatgtcagcggttttccaactgaaaatacaagtcttaaacagaagcaattttcgacccacgatgttattcatttcattttgtacaaaggtagaaacaaagagaattgggagcccatgctcttctggctagaaagtagtctttccatctgttcgtgttggaatttgcttactatcgttagagtgtggggcttctaagatgctattagaaggcctgggtgtgaaacccagtaacatatagtgagcatgcacaaagcttggattaaattcctactataaacaaaaatttaagaagttactaggtcattagaagtgattaacgcaatactttgagagcttggggactgggccattacaccagaatgtgttcttacgaaatgtttgctctcctcctgtcctgactcttttcaatggattctcttatcatctacttttctctcaggttgtgagcagcattaggttcttcaaaacactagaaagatgccagaaacatgttcttggatctcacagccttccaaaccccgaatcaaaatagacctatttttttcatgataaattcccaagtctcgggtaacttgctatagcaaggaaaacctaacaaaggcacatcctaggagggttgagaagttttatcaaactggagagagggagccatctaattaaccagcacgcctgtactgcagagcatttaagggaggtgatgaagaggagggtgttacttgaacagctactcttatttagatagattttaagaagctacattacagcatgaaacactggagactatgtggggcagctatgagaaaaactactttgtgagctaggtgttaaaaacagccttggaataaaggacttttaaaatgagcaatatatgccagtgtgtccccatcagttactccatacactggatatgggattctcttgtaagtccacgtcaatgtcaagtcttgacaagtgacaagcatctatttagagtttgaatatttttgatggaagccaatggtacattaactagaatatagttttattgtttatttatgaactgagaagcaggcaaaacatatacactaggttttgatttaacacagttgagttaaaatatcagattacagcggtatttacataaagatactgtatagttcaaggtaataactgtaagctggggacaataagtatcgctactttgtcacttgagcacttatggttaatgactctgaattgaatatttttttaaacacacacacacacacacacacatacacacacacacacacacggtgatcaagatgtaattccaaataagttagtctccttggtatagggatttcactcccaaattccttcactgtgtgcgtgtgcatgtgcctgtgcatgtgtgtgcatgggaaagggtaaatcatgcatgtggcactcacttgtgtcatgggaataccttaatgcaaagtcacagaagatggactacctctgaacctgaacaactggtttgtacctttgtgtgccgtgtgctccagcaaactctgacatcaccatctgtttgtgtgtcagtaaccttaaggtctaagcttctatgtggagttcagttaggtcctaggagcacaaagaggctcccggtcctcagttttcacagaccttccagcagtttcagcatcatggatggtgccctgtttcagcagcgacagagatgtgttttcatgggagctttatcaggcatcttctccttgcctccctccttatttgacctcgcagacgagttcctatctaggagatcctatccattcccttcccggtgcaccctctctctcactggggctgggacgatgagggacagcgatatttgcttctgagtggcaccaaaggcaagggaattatgggataagaaaacaaacggccaaaatcaaagcagggcctgactgcagggagaagaaagaacatttctgagttctcagccttgacacgtgaaaggccctgaataatccaagcctacgtaagacatgggtgatgttccagccaatggtgatgttccagccagtggtaatgttccagccaggatttccatgggactaaacctagaggtgcaggtttctcgggtggaaggaagggtgcacgggcccctcgtgtggttctggtttccatcacaacgaggactacacttgaaggtgtcctggtgtgttttcaccagttgaagagtctgtcttccaagagttcgcttttatcaaaattccctccttcatctgtaagaaaaaaagaaaacaccttttcttgtgaacacacagtcatggctttagagggggaaacagaacctcaggaaatagacattttagttctcaatcatggccaatgctaccaacaactaactcaatcatggctggcaattcacattttttttttaaatccagaatgtatgtagctgtgaccttgaacttctgatcttcctgcctccacttcccagctcccgggatcacaggcattcactaccatgcttctttacatagtactaggggttgagccccaaggccttgtgcttgctgggcaaacactctaccaactgagctacattctagctcccaacatccaaatctctacaataaattaagtgtgatgtggcaagtttggcagaagtatatagagactgtcttgctctgattaacatgcctctagtctaagcacctgacattataaccattcatttgcatcaaaatgatgtggcccgtgattcctgatgatatagctccctcatgggaaagatgacacagggacacacttgaagatattccttcatcgggtgatttcttctgggtaaccactgagaccaaaggcaaacacacttgttagctgggtgcaaatacaaaaatgttaggcctggtgcatctcataaagattacatagtaacaagatcacaggaccctaaatataaaggtacaagagatgaaacctgagtggggtagagaacagtggctgacacagcatacatgccctagattttaattttccaacgactgccttctagataaagcaacgttctctcagctactcacaatataatttgaatcctgacctatcccaattgctcacatcttttgaaaaatagtaattagaaaacgtgcttctctctagagggaaagaaaatgtgggcacacggacggaaacacagacacatacacgcctaaggggtagaggtgggacagaaaaacatcccagtacaaactccattggaatttaagttcatgatgtaagagacatccatatgaaacctagagattctgcaatgaaaatattagagaaaatgattgacatatgatatgggaacccacaactcctcccttcatttaggataataaaacatataataagataataataataaattatataatatataaataaataaaataaagataataataataaaaagaagcaatttctttggcgcatctccagagacaagctacccagaacatgccaaccattagagccagtgagaaggcacagcagggatgggcccctgctctcaagtctaacaacccaacttcagttcctggaaccatcatggtggaaggagaaaacagactcaaaatttatcccctgacagcctcactcagtgtggcatggatttatactgaggtctatgaagttccaaagacccagctgatccattgccaagatgccttaattgtcttggtacttctaaatctcagggatagaatggctgtttgaagattacatccactcctggcttagaagctgggcagaaaggtgaaaaaaaccaggcctgtagtcaaggctgctcctgtctgttagggggaaccacatctactgctgtgtgggaaagggaaaaaggattggcaataagaactttcatttggtttagttttgaatggtgagcaattggattttgattatttcgtatttttggctttgctgtttttagttataaaacaatgaagccaattggagctttaaaagttttaaaagtcctatttggtggaggcagggcaataagatgttcaaggccagcctttgctacataaggaatttgaagccagcttggaatacataggcattatattcaaaacaaacaaacaaacaaacatcactaacaataggctacggttctttccccactctcatcaaggtagtgctttagtattcttgggactcattttactgggaagtaactggcctttattgaataagtgtttctgtgggtttggggagggagcagtcaggacacaaaggttctcagcccagaatacagagaagccaccacacctgcacctttttgtgatttttccaaggaagccagaaacagggctgcagcctctgggagagtcagcagttcaagatctgggtttcgtctttctggagaaacagaaatgagctcagccttgatattcatataaagaaagaagcattcacacattcctgcccattaacatcgtaaacagatcagcattcagatatttgtgtcaactaaacacccatgtacatgaatcttactctgccatacaagactagaaaaaactctgtatactatgtgctgattttttttaaaaaaaagtttattaaacatttatattgcattttatttagtgcattcgtgtgtgtgtgtgtgtgtgtgtgcatgtgtgtgactctcctttcatatgtgggtcctatggattgaacttagggagtcaggtttggtggccggtgcctttgcctgatgatcaatcttgctgccaccacagtgaccttccatttgtttatacctgaggatgaatgctagggagtatggagtatgtagcaaaaggaagatgagtaggaggccacacagctttctctcgccagggtttagaagggggtgcattttccttctcacagcttaaagaaggttgttttggccaaaatatctcattggagccggatctccctgctttcccccttccaagtcaatttgagataaccgattacaatcgtggtcacataggaggtaattagctatttgaatgaagagaccctggctaaatagtcagagttatttcacttttattgaattatatgtttactgggtcacagggatatgccgctgcagtctatttcatacttaagttgacagatgacatggtcctgatctaggacaggctgggagttttaatcggaagtagcaggaagagaagaaacatattctaccctaaaaaacaagaccagtcacactgcaaactcaggaactgaaacaaaagctgaaagcatctgctatcggcatgctaagcagtgctgaatatctctccaagtaagtatagcttttattcttggtacttctatacaaaattttaccaagattattttttcttctgtttaaactgcaatgtcattaagttcatcaaggaaaaaaaatgttcctgaacctatttcttaattaatttgttttttggagaatttcatacatgatgagtactgtttgcatagtttccaccctctctctgtcccccaactcgtcttatgcatcctctgtaatttatgattcccccccccccccgcgtttcctacaactatttagggctgaggacttgagattggatagcttatctagagtttgtcccggaagaaaactgatcctcctctcagtcattcatacctggctcaatcattcgttcatagcttttaacttaattgcgtttggttaaaaacctttggcggctgtttctaatcatttaggagaaagatatacttgaaatgtctaagtgattatttagtagcaattgctatttaggaagagaaagatcaaggctctttccagaaatacccggagagggggcttctctctgccctgtgtctgtgctacagaccctgccagtttggggacccgggctcactagccgcctgctaggggacagggcaggtggaaccccgccataggcgcagcgctcgctcacctggaggcggccggtctgcaagctccttcctacggctctggtcggagaggaagcggcggccctctgcggggggtgggaaggggggaggggtgggacacgaggaggactgaggcagacagctagaccccaggatcagggagatcgcgggttcccgccagggatgcgacctcgattcggagagcagccccagtgggattcgcgcgtgcctctctctttccttccaccccttcccttcctctctcccttcctaacttcttttgccattctatgctcctctaccaggcaccttctttgttcaatcattagttctctaaattcaatcagccagctttccttcattccctccccttctccctcctctccttccttcttatcccccacttttccctcccccctttcctttatttcgcctttcttgaacccttctccagctctttcttatttcctccctcctcctttttccttttttccctgacaggatcttagtttgacctggagcccactaggtagcccaagctagcatttctcctgcctcagcttcgagagtgccaggtcacagtagtgaccccaaacacctctttgggggagggtttctggccatcagagtatttttgtcccacctgcccactcctatggtttctggattgtctgaaatcctaattatttactggagccggctgtgaccctgtctcttaggagtccccggatgtctcccatcaccctccgtgaggagaataaggagtatggaactcacgtgcacccttcagatagagcatagcttggggagtccagttcctcttctcagagagtcgctgcagtgcagggaggagagaagaatcgttattacaatgcagcgggtggaaaaagcaaaaacagaggctgcctagtccgaacccggggtttgtgttctctgcattacctgtggagcaccgctggagttttccagcgcagacagcaccaggagaaggaccacggctgtcactgccaggacgctgggcccctacaagacacatcgaccaaacacagcctcatcggacggagtgtggctgcatttgtttttttgtttgttttttgtttgtttgttttcgttttgcttcctcttcagagaggacagtaggccccttacttcactcagtatatgatcccaccttctagttaatccataaagagtaactttaaaaattagaaagatatgattttcataacttcacccaaataaagaattggtggataagttctattcagcaaaatcaggttgcactatttaaaggcactattcttcaaatgtccagtcactacaatgctcagtacatataacctagatagaaaggtagacagtttatagaacagctggaaagatatcgggtgcacacatctgctgcttaccttcatgttccgaccctgtccagagccccacaatctctcgccctaccttcc

SEQ ID NO: 1766 - DNA, 2092 bp, Mus musculus
tgctcagtctgtcctctggctacctgccctgctgtgaatagtcaggtttcagctgcgattttttgttttgttttgtcttgttttttttgtttttgggtgtctgtgtggattataactgtgaggcactgccctctcctgaaaggcagcaaggagctgggcacgcttcatccagctgcgctgggttcatgtgacctcagattgctggctcaccctgtagaggctatcccaaggctgctgctttttctcagtgctgactgcagtcagctgaatcaggtcccaaacggcaccacacagctggaagaagaatgctcagaggccgctccttgtcggtgacatcccttggtgggctccctgtgtgggaagctgaaagactccctgtggaagacttactgctttttgaagtttcttgggaggtgaccaacaaagttgggggcatctgtactgtgatccagaccaaggccaaaacgacagccgatgagtggggagagaattacttcctgataggtccgtactttgagcataatatgaagactcaagtagaacaatgtgagcccaccaacgatgctgtcagaaaagctgtggatgcgatgaataaacatggctgccaggtgcattttggaagatggctcatagaagggagtccctacgtggtgctctttgacatcagctcctcagcatggaacctggacagatggaagggtgacttctgggaagcttgtggcgttggcatccctcatcatgaccgagaagctaacgacatgctcatatttgggtctttaactgcctggttcttaaaggagttcgacattgacaaagaggccggggagaggcagatataccaccgctactgcatggagcgggcatccgtgcactgtgcgcacgtgttcaccacagtgtcagaaatcacagccatcgaggcagagcacatgctgaagaggaagcctgaagtcactttgttttgtttcagtcatctggactttgatcttgagaagactttattcctcttcattgctgggagatatgaattctcaaacaaaggagcagacatcttcctggagtccttatccaggcttaatttcctcctgaggatgcataagagtaacgtcaccgtggtagtgtttttcatcatgcctgccaagacaaacaatttcaacgtggaaaccctgaagggccaggcagtgcggaaacagctgtgggacactgtgcattgtttgaaggagaagtttgggaagaaactctatgacgggttattaagaggagaaattcctgacatgaatagtattttggatcgagatgacttaacaattatgaaaagggccattttttcaactcagagacagtctttgcctcctgtgaccactcacaatatgatcgatgattccacggatcccatcctcagcaccattagacgaatcggacttttcaacaatcgtgcagacagagtcaaggtgattttacacccagaattcctgtcctccaccagccctctattgcccatggattatgaagagtttgtccgaggttgtcaccttggggtgtttccatcgtactatgaaccctggggttacacaccagctgaatgcacagtgatgggcatccccagtgtgactacaaacctctccggttttgggtgtttcgtgcaggagcatgtggctgaccctactgcatacggtatttacatcgtggacagacgcttccgctctccagacgattcttgcaaccagctgactcagttcctctacgggttttgtaaacagtcacgccggcaaaggatcattcagaggaaccgcacggagaggctctcagatctcctggactggagatacctgggcagagtaagcaagttcctcaggacgttggaggagcatgtcgagactatcctgcacgatgacaatcttgcctctggatcccaggcctccagtcctcagtgcagtgatgcggaagacgaagaagatgaggatgagaggtatgatgaggaagaggaggctgagagggatcggctaaatatcaagtcaccgttttctctgaaccactttccaaaggggaagaaaaagcttcatggagaatataagaactgactgagctcaaacga

SEQ ID NO: 1767 - protein, 607 aa, Mus musculus
LQSAESGPKRHHTAGRRMLRGRSLSVTSLGGLPVWEAERLPVEDLLLFEVSWEVTNKVGGICTVIQTKAKTTADEWGENYFLIGPYFEHNMKTQVEQCEPTNDAVRKAVDAMNKHGCQVHFGRWLIEGSPYVVLFDISSSAWNLDRWKGDFWEACGVGIPHHDREANDMLIFGSLTAWFLKEFDIDKEAGERQIYHRYCMERASVHCAHVFTTVSEITAIEAEHMLKRKPEVTLFCFSHLDFDLEKTLFLFIAGRYEFSNKGADIFLESLSRLNFLLRMHKSNVTVVVFFIMPAKTNNFNVETLKGQAVRKQLWDTVHCLKEKFGKKLYDGLLRGEIPDMNSILDRDDLTIMKRAIFSTQRQSLPPVTTHNMIDDSTDPILSTIRRIGLFNNRADRVKVILHPEFLSSTSPLLPMDYEEFVRGCHLGVFPSYYEPWGYTPAECTVMGIPSVTTNLSGFGCFVQEHVADPTAYGIYIVDRRFRSPDDSCNQLTQFLYGFCKQSRRQRIIQRNRTERLSDLLDWRYLGRVSKFLRTLEEHVETILHDDNLASGSQASSPQCSDAEDEEDEDERYDEEEEAERDRLNIKSPFSLNHFPKGKKKLHGEYKN

SEQ ID NO: 1768 - DNA, 87749 bp, Homo sapiens
  misc_feature (1)...(87749): n = A,T,C or G
tctaatattttacacaatcaatataaaattcctaatttcatatgtatgttctagcacctccccaaagcacctgtggcgtaatgaactgtggcaggtattgaactagtaattcgtaaaaacttaaaaagccattcttcatcatttgtagaattcacccagtttcaaatgtgtagacttttttctcttatagaagtatttggcttttttaaaactcataattaagatttatatggttgaagacaaaataaaccttaaagactactttcgaagtcttttcctatttttccacaagtaatattgtgaaaactatatgtcctatttctcaacaatgcctaattttaaccagtagcaaagttgatgcaataaatgctttcagaacaaacagtatttttgacttcaatccagaagttaatttgtcctagggcttaaagactcataaaatcagtttttaatgacatagctactgtctacatgtatttgccaatctttcccctgaagatgagaactgctaggctaattgccaaatagataacactaatatattgctcgtacttttaactcttccatggttgttttggaagagattgcatgctttacatctggagtgttgattacccaagcggtatctgcttgtattgcagctcaatcatttttgactgggtcaagcctcaggaataaccttccctttcttatcaattactttttagctaattaggatgttataaaatatattttcaggaagaaatctttttttataaatcatgaggttttgggggaaagcaatgtaaggtcatgaatcaattcaccaattgctttggtgaaaattagttgcatgcctatacctgatctccagaaatctgtggtatttttgttctccagccaggtgaccatgtttccaggatgaatgggaaaccagcttagttcataatccaaaaagtaagcattcttaaggtttaccttcattcatagaatacatttgagtttattagcaaaaccaaaggttctaaatattatgtcttaaaaaataaataaaacctttttttgccataaaaatgttaatatgccttgtgggtaggataaatagcggcattactttcatctctaattcattaattcatcattgatttattaattcaattgtggttttaactaggcagctatgcatacatttagcgaaaagctgatttcatttaaagaaacttgctggagatcacacatctaaaaacaggcaactccccaaattaaaccaatgctcttatttcttaagatatcctatgttgaagcatgtatttacacccccacctgttttcctcatactgtgttagaaagacttcttaaaacaaatagaacatatttggcatctgtgggctagcatataaacttagaaaaaaaatctcttgacagtttctaatatccctctactttttatcaactttccaccctaaatcaacatcaaagggttttattatctcttatcaggaaagtgattccacaatattccttggaaactatttaagtgttacaggaaccatttgttttctagtcaaagtgcatatggaacagccaatcacataaagtatagtgactgagaacccagtactgatcttgtggaagatataatcttataaaaacattaaatgtgagtataacttagcattaaatcttaatatctaattttccctcaaaatcgtgataataatagggctgggtaatgttatgactgttaggacttctcctcttggtctgacactaccacatccagaatttgcgtttagtgagaatgtgcttttatgccttctccatatgcaaatagagattaggttgacagaaacagctaaatttaaaaaaaaatgtgttctcaaggagatatttgacttgttttgatggtaaaggagttacttgggatctcatgtgttgtgggtttcatcaaggtggggtaggactgattctcaggtttgcctaactacattgagcattaacacagaaggtaaaaaaggtaactaccaaaaggcattccacctgacagaaactaatttagtgccacacctgtactaacattcgaattttcctctttatattaaaaaaaattttcatcgactctttctttctctttctttctttctttctctttttctttctttctttctctctctttctttctctctctctctctctttcttttttgagacagggtttcactcttgttgcccaggctagagtgcaatggcgtgatcttggctcactgcaacctccgcctcctgagttcaagccattctcccgcctcagcctctcgagtagctgggattacaggcatgcaccaccatacttggctaattttgtatttttagtagagatggggtttctccattttggtcagggtggtctcgaactcctggcctcaagtggtccacctgccttggcctcccaaagtgttgggattacaagcgtgagccactgcgcccggctttgtcaactattttcatgacaccattttggaaaaaaaagtttaacattgccacttatattacttgacttgtttatctttgtaatacttggcatttactcatatgtatataccactgtatattttataagcctctgcatagcatatatgcttctgcttcatacaaaatcaccatgtaaataatatttgacaatatttcatatcttaaatttggtggagaatgtcagaaaagtaagcctgttgttcagtattcctagccttcatatcagcatctctcacctgagcagagcgtggagaaaagagagcctagatggcagccaactgatggtctcctgcaggaggcagatgagcagcttgagctggctggccatcaggttgactccatgcatctggcttggaatccctgatctctgagccgatgcaggctttggcagacactgtgcaaagagcattcatacatgctcatttaatccccacaacaacctcgtgaagtgaatatcatcacccccatttcacagtctactaagtagtccacttctaaatgagactggcttgactccaaagccctagttttttttttttttttttttgagacggagtctcgctctgtcgcccaggccggactgcggactgcagtggcgcaatctcggctcactgcaagctccgcttcccgggttcacgccattctcctgcctcagcctcccgagtagctgagactacaggcgcccgccaccgcgcccggctaatttttttgtatttttagtagagacggggtttcaccttcttagccaggatggtctcgatctcctgacctcatgatccacccgcctcggcctcccaaagtgctgggattacaggcgtgagccaccgcgcccggcccaaagccctagtttttaacaattttactctgctccctctttcctggtaaactcaaagtgtcatcgagccttggcttccactcttggcacgtaagctcttatcattgcacattttctctccaggctctgtttttgtaaacttttatttaaaaatatttcttatattgattttattaaaaattccttgggagaatagaggaccgtacatggatgtcacagaacgagataaggacgaaagcaacacatttgattaaacgtcactggatgacttgatctcttcccagagagatattatccctctgctttctctcttacccaaaatcttatttgtttacttctttatccataggggctatagctacctttcctacatttgattttagccaaaaggccgagaagcgatagctacctttcctaatcccttcatcttgtgtagcaaaagagtttaaaataaaattagagaagagggatcacaaaccaaaagctctattccaaaaacaagttctgagtatacgggtaaaattcagtctatactaaggtaatctcaacagtcaaggtcaaaaatctctctcacgatcttcagtgtgatggatgggcattgtcagcttagattgtaagtttaatttaaggataatttcttgctttgcctttggctgcttcctgatcagcaactccaaatgcacgtggaaaaaaaaattaactcaggagcttaagtgtttctagaaacctgacagttaatgtaggcccatggagactgagatgactgtgatgatttcaggagagatttacccagctccagctgattatttcatgaagccatgcaaatagaatccagagtggccagatctgatttttgaagagaaatccaaaggtttatgtgaaatctcttttgaaagatgtttgactcttttgtggcaacactgcatgtaccaatctaaactcatcgcaccatattgcggcctctgccttaaaagttgacccttctggagctctgcttcatgtagtttaccctatccaccctgcacctcctcttcctcagaacctaccactcccatggcttcagttaccaactgtgccccagatctctcatctcaggttcttagtaggcataatatttaacttcttactgagcatctggctggtgtctcaaactcaccacatcggaaagagaagtcattctctaatgtctcaagcaaatctatttccctcccacactcaatatttcttattgtggtacactgcatgaccatccacttggttgtccaaactagaaacctaggcattgacccttccccacaaccaatcaactccacaaactgttacctcaaacatacctcactactcacttctctaatctcactgccatcactctagtgcaaccagccaccttctctagtctagacacactggagtcattttaactgatgctgggttctaaagccagcatataaggtagggattctggtcaaaatgtgtgtgccaacccttcaccacattcagccagtgagacactcagattctgaaaagactgactgtaaaaaacacagtctcccagcggctcctcagtctgggtcatcctgtctcttcactgagtaaattattccaggctatgtaaagtgttatttcttgtttttttctatcttctgtttgtctagctgatataattaaatattcaggagttaaatgttcacataatacatctccataatgctacaaacacatcaccttaagtttcatccctcctttaactcattctcagttatgcagtgagaatgatctttggaaaatgcaaatctgtagaatgatccactatttgaaatatgtcataccatggaatcagttctctgaaaaaaattcactctggtattgtttgttccaattttttattgaatagttacacaaaagtgtttgcttcgtattaactcactgggctataatttctacactatgctatttatgtgttccacttccatttaaaagttaaaactataaagaaataaaataatgcaaatcctatcatgcttttccttattattaagataaattcaaaattcttagccccttcccacttctccaggttcattcctatatcactttctacctcaagtttgctgaatctaaatatattgatctttcagttttttgaatttaccacattctttatttctattggtctttgcatgcactagctcgtctgctagaaacacctcttccttagcttttcccattttcgatctcaatttaaatattattttctcagggacatcattcttagtactccatatcgagttaattctattgttacatgctctcacagattctgtattccattcaccaccctcaaagtcctttagttacttgtttaatacatactttctgtgctagagtgtaaacttcatgagagcaagaatcatgatcatagtacctgacatatggcttttaattctccagtttctgtagtaacaacatcactacacacataataaagtacatacaagcaatgtacagataacaacataaaattatatagagacactatgtgggaaaacaaaggtactctctctaaccttaaaaggcaaagactaaatgctaaataactaactttcatttctgcttttatgacattcagaagaacgcagggattatctaccaaatgaataaagttttacattctagaatatacgagtgatatgcaggcttcataacctcagtctccaagcctcctgccttatacttctcaacattccattttttgtagcaaaaagttccctgcttaaaacctcccaatgacttcctactacaaccaaaataaaatccaagctcttgaccagcttctctatgatccatttcctactttcctctgacctcatcccctccaggcttcccctcattcattatgcttttggcttcagccacattggtcttctttctgtttctgtaagagttaaaggctttgcaatcacttctctcagatcttcaaatgtggccactttctcatcatttatatcctaattcaaatatcacttcctcacaagggtctttcttgacctccccacctaaagcactcatttctatccaatagcactcactattgtttgcagtttttcttctccagaaatttagcagaacctgaaataacataatttgtttacaagattaatgtctatgtgtccacatggaggcaaagacttatctaccgtttatcgaaaatattctcagtgatgagaatagtagcacatagtaggtgatccataaatatgttaactaagttattctggatatgcagctgcaggcaagtcaagccttggaagtctaaaggctttttggaagacttctaagaagattccaaaaagtcaaagcaaatgtgtggttttctaaatgtatttagtgacctctgctggaatacttaccaagggaaccaaatacaagtcttcatttgttcctacttgccctctcacttcttttcattgggtgataaaatgttagcataagtataaaatttggtatcagggacttttgtgagtgcttctcccaacttggagaaaacccatctccctttctgtctggatgactgttctctttctgctctcatctcatcaatttgtgcttttagcacaaacattataggagaatgttcagggatatgggaggaagagaaatttccctgattcctcttcaaatctttttgcacaaatgactgcctttctctgcacaaatacctgaacaaagggaattcatccagatactatggatagatgaagatatatccatctcatggatatacttcatatggttccatttattttacctctcttaacccaatgaacaactttgaaaatgatatttaccataaacaagcaaagcattggcaaaggatgttctcatgttgagaataacaggatcaagagaataagtctactatgagggatcattaggagatgacgtgtggctgagagtgctggtacttgacacaaaaacgccaaatgggaactaaagactagaaatttcgaaaaatcagaataatgagtgtgagtgtgtgaaacaatcatgtgtatttaattcatttatatgattaaacttttgaaaactgtgttactcatcctatatacggtatatatatatatatatatatatatatatatatatatgtatacgtttattgcagaaaatgtgtagaacacaaataaaaataccacacaaatatcaatcataattacaaccagtttaagacaactattgtaagagtttttacatgtagcctcccgtcttttgtttatgtctattccagccttctattacatatacttcatgaacagaggtatagagtacattttcacaaaattaaatcaatcatactacttattttattttacatcctacttattttcatttaggatgttataaaatatactcattgatcttaaggtcatttttctgaaaaaaatgttttctctaggcatttgatcaggtaatatatacaggtggtacaacttcaaaaaaatgaaagaaaagtaaagccttctttttacccctttccttttcaatggtaacctctgccattagggaaagcttttactaaaccatcatatgtgttataaaaaaggctaagattactaaagtggttggcatagtaccaggcacaatgttaagtgacttatatagattatctcatccccattttatcaagaaaacaaaaacttaggtaagaaattggctcaagtttacacagcagataagtgatgccacaagtgcctaactcacaactaagcagttgatacctggaacagattgcaaataaataattcagccttatcatgtaagctggagaatatggatcattgtgctcctgtagcctgtgtgacactggatgaaccaatctcaaggctcctggaacagaaaactgcaaacgtgaaactctatcactgtcatcccattctcactcctgtcaacatgtccttagatttggttttactggaatgtgcacttgcaggactctcagaggttatgtgaacataagcaaaccattttataaaggagacaatcattttgatcatttgggatcatatgttttctattttagtacttgattttttttattagccatataatctttttctcacaacgcaaacaaatggataacaaactatgtacttaaatgtacttttctggacaaagataagaatcaactgtgtcacaaaatcatagatgacatttatttatttttgttttaattaattttttattttattttattttttaagagagtggttgttcaggttggccttaaactcctgggctcaagtgattcatccccctcagcctcctgagtagctggaacaacaggtgtgtactaccacatcaagctgacatatttaatctatttggcttacatagatttattaatgtaatataatgaaatgtggttctgcccatcttgagtcattaaaataagtgtaagtctataagaccaagtatatagaaaataatttaaaacctaataaaaggtgctaaaatagtattatcaagtaacaaattacaattctgattgtaattctaacttaaaggatattttgtatgagcttcagttctgctgctttagagaataataatgtaaaaatattgattttagctacatctgtaaagatggctcaaaattaagcttgcttgtgaatgcaccaactctctgtaggtacaatataggatatatgtgtatgggtgtgtaaataaattggaacatatatatttacaaacatagaaacacaagggaaaagcaaacatatgccatttatctgcagtctgatcctgatgatttttcttcccatgtttgaacatttacattgactgaattattctttatcaatttgataatatttgaaggaaatgtacaaacatgacaaagatttatttttactacctcattaaaattattgactgatgattattgaccagtcaaaattatgttttttttcatgttacacccaaagacatactcaaatttatgcttttttatagggaaagttttaagaaaagtaattgagaaaagggggctcaagatctctggctatcaccaaaattcaatttgtaagtgtagaataaaataactaggaatattttttaaaagctctagaaataggaatcaaaagaaagaagaatatttaggaaatccaaagggatttaaagcataaaaatatgtcccaatcagtctacatgtaatctaaggaggcctgcaaacttaatgaggggagttgccaatattgtatcactttggaaatgatgaaataagcattggtaactgtatgaatctaggagtctggtcaaaaggacaagggctaaaaggctgaacttgggtcatgccctgcctatcccaggaagtgcttacctatgtcctgaatcagaggatttttctgttgacagctctggattgtttgggtagatactgacagggcagataccgtcctcacaatacctgcccagaaagacgagaaagaggaggaagaattcctccttccaccaggaattctgtgggaagcacataagatttcatgctactagtttattcccaagagaagctaccaaagcctggtaactctaccaactctaacttttgtgcctgtaagttctcttctcctgggattacaactaattgaaacaggaattcaaaggagtctcggaggactgtaagaagaatgcttcgaggccgatccctctctgtaacatccctgggtgggcttccccagtgggaagtcgaagaacttcctgtggaggagttactgctctttgaagttgcttgggaagtgaccaataaaggtttgtactgctcctgaaggtggatcagtacaccttcactaggtgactgaggaatgtagagtaagatttcacagataactctctagtgataaccaattgctagtgagtgaggaaagcatttaaacggaatatacatttaggctacatttaaccttgtctattacaacaggctatgaatacagacttgtgtatgtgttgaagagggagaaagttgaaaatattagccattgccatggaatgtgcatttaaattaaaatttaaaatccatattatgacaacatagaaataaaaagttaatatttacattttttgttttaaaatttttctcagcaaaatagtataattaaacattttattttaggaagatgtatatgtgattagaaccagttggaaacctcaactctacattctgttagtaattatatgaaatgcttaagaatgtttcatattcacaattagcttggaattaatgttttaattcaggagcttctcaaaaggcaaaatactgtgctcctttcagaatgaaagtaatttttttcttcaatgctatgcttatgtaggaattataaaataaagaaaatcaaattgataaaacaatttgcgagtgaggtataacctcatttgtgctgggtaagagaaggcaaggtagagaaccacaatgtaaatgattttgaaaataaagacatctgtaaaattataaaacaattccttgtgggtttatactctctagtttaaaagtgtcaagactattgaaggaacattagcaaagaaaaagtcatggttttgaaggctgagttcctcaagatcttgaagaatcaagccaactgattgctgggtaaatggcagtgatgacttgtgtgatttaaacgatctgaaattatgtcatgtgttgtgatatataacacatttatttttcattttgtgtttactatttcatgtctattacagtaatctaaaggatctgaaataataaccagaatgtgatatattacttccttcttttggctaatcagagccagcataatctcaaaattaaatgcattatatatggcatgcattctgaaaaatcagaattcaccttatactaactgttcaaagttctcgtgtgtatgcattcataaaatcaaaattaaaagtcaattttgcctatgtagaagtggacagaatgcatataagagaacaaagcacggtcttattctctgtagtttagtgagaaagaatctaggaggacagaaaccttattacagagaagtgaagtattttatgtgtacctgtttctgttgtttctttttaaattattttgtattcttttcctcagagatctttatcctgaaatgagcatgtgtttttaatgtcctttttctagtcacaaatttttccagtccagtttttaaatatgcccaaagttcctgggaacagaaccatctctatcacatgtgaatcccggagtatgccttgaaataaaagttttctctagagagtgggcaggagctcaaggacatagcttattggtggataaaactggaagggacttgttagcactgggaatcagtccagaagatctctgcacaagttcctgcacctgagcagagccccttctgctttcctcttttctcatcatttaacaaacattaatggagcactgttacctgggcactgggaacacgccagtgaaactaagttattttatggatcttataatcagtagcatgtgtgttgatctcagggtctagaacagtgcctggtacatagaaaatgctcaatggatttttttttgaaaaaatttgtttttcaacccctaagctgcctttaatacttattttctatcatttccctttcaaggggaagggaagtgtttttgtggagaggtccccacaatgtgatttacacaagttgatatcatcttcaatgtatctttattttaatattatcatagcctggtatggtttgagattttcatatagatggataattattgtgtttattcctaataatacattgccactatagtttctttaaatttaatgatttgaatttttacttccctgcatttcatagtagtgatatgaggtatcttagagatcatgaatcccactcctccagttcatagagcaaattgattcgtagaggtatttaatgatcaagcaaatggcagagttaggaccaggatttaggtcttttccaaggccaattcacttttttactattatgtaagaattaaatattaaaacctcagttttcaaaggaaatgtcctatagatgaaagaacacagtacttgcagtcaaaggtcttggatttctgaaactttctgaaaaagaaccccttaaactgaataacagtttcttcatgaataaaatgaatgttatactctccagttatcttaccatgttttctggcaaacaaggaaatgtattcacatccaagaaaacaaaaggtttcttaggagaagaatcccttgctgccagaattttgcccatgaacaatggaaacgtgaaaaacataacagatgagagagtcacagttagttttgggtactaattctcagacttcaaaataacctttttaatttattaatattaaccttgaaatttattgcttttattcattaatccattttattattcagtaaggattcatcaagtgtctattaggtatcaggcactgagaggcgagggagatagagttaagaatacagaactgattcttaatcttcaagaattgacaaatttgtagaaggtagacattgaacatacaatacagtcaaatgtgatgagtgtgagactaagggaaccaggtgtcctaagactatacagtgtaccgtggaatggggagtggtttctaacctagttacctagaggtttgggaaaaacctctctaatgatgagatgtttgagctgacacttgaaggataaatagctaaaggggagaaagcgttctatgtgagagaactatatatgccaagatgcagaagtgttctctgttcgaagatctgagcggggctcagagagggaaaaggagaggagtatgagagaagatgggagagacctgcagggactagattgtgaagctcagggggagttaatagccttaaggagttttgtctccagggtatgaacaatgaatgaggagtcactgaaattctatccacagtagtgggaagtactaagtagtcagatatgttttggaagaagcactgttaccagttgagggagaggggaggagggaaattagactgtggtgtgacccaggatggaaagttttgcccaaatgtgggggaaaaatgtttactctctcctttgcccaggtcttactacaatcatttcttctgcacacacttgctcagaacattacaaactctggagaaattaacatgttaaggatatttaggatcattaaaaaagtttaataaatgttgtcacacataatgaaagttaatttaagaattgtaaagacttgagcgatgtagtccctaaataaatgcttccctcttaaaatggactagaaacaatttgtttttgcctaagccaacgtattgctggacataatttacctgcttcctcctcagtcttgacactacacctctgaattacatggtacaagtggcacagggaagaattcagaaaactagagtcaaagtggttatggaagaaattataataatgagtccactcttctaggacaggagttctaaaggtgaggactttgatataagtgaactcaaggagtttctaaaccttcagaaattatatctaaaaattaggtgcacgtatatagaagtacttttctctgagaagaggacttcacacttccatcagcttcctgaaggcccctgtaattgccgtaaagaacaactgctctaaagtttaatactaggctactcggctgttttttgttaacacagaagttttccaaatggcttttctctagagcaaaatgaaaaggatcccatccttcccgagacctaacgatgtttatctttcgtgatactgtttttgttcttcctctttttctcctaccccccaccacttttaaagatccatcaaggcccagcatggtgattcacacctgtaatctcaacacttttcaaggctgaggtgggagaattgtttgagaccaagagttggataccagcctggggaacatagggagaccctgtttctacagaaatttaaaaaatttctctagctggccatggaggctcacacctgtagtcctagctacctgagaggctaaagcaggaggatcacttgaatccaggcgttctagtgaggcttcagtgagcaagattgcaccattgcactccagccggggtgacagagtgagaccctgtttcaaacaaacaagcaaaagcaaaaagatccatcaatttgttgctccattcctttacttactatcttgctgtctacagctaaagtcagactgcatgatttggaattccaactccaccatcacctgggtaatgttgagatttattacatagcatctctgtgcctcagtttctccatatataaaatctacctgtaataatgttgtgaaaattaaaagaaataccagttgtaaatcactcagaactgtgcctagcatttaataaacactctgtaggtattagcttatttctttataaaatttattcataaaatgaggaagttagctcatgtattgtcataccagctttcactttgaatgagtccataattgcatttttaaacacaaaaagagaaataataggaaaaaatatgtatacatcaatgttacttcaatcacgggatgcatagtaattaggatttctttgccctaattactgatgtggataagccggtgggccatgtcaatggcatctcaagctgttatcacaccatgtgaaacacacgatctatgtaaaaactatgcttggttgcacagcttcaaggaaagcactagtctactcacttccttttcattcagcatgctatgtctaggcccctttcatataaaatatttggagctgccattgtaggtagtgcaggtggtcttgttcaaagtgtgagtatcacctcccactgccaagactgcagctgctttgattttaactgaggatctagaaaagtgctgggaacacaaatatttgctgacctttgtcacaagtagcacctaatctccttcctaccagacctgctgccttataaaatgatgttctaagtgtataatgacttcctctgcttctgcaactgtgttttggaacaggagggtgagattagtagccacacacactgaaatagtcatatgacttccaaagtctgtaatttttaagcatatacaaaatagtgaaatttctccatatgtgtataatatgtatatatgtgtgtatacatatatatagagagagagacagagagagatgggggagagagagagagagagagcgagagagaggcagagaaagagatccttattttggctgatatctattctatacttctttgaaatagtgatttttagtaaattggcagtgttgccagatgacgacttagagttttaaccacctcattgttatatgtaccatggtagctcatcttttctttcaggtgaaagttgtgatactttgtcctcacgctaaacatagcccccatgttgttccaggaaaatagagatcaataaaatacaaagtacttgtttgaaagtgaaggttaagttcaaattcaatgacctacgctgtggtaaaacgatcattcattaatgatattaagtattttcttttttaatgtcagaataaaaccatttatttgcagatttaaaaatatatatgtgtatgtaaatctccttggtttatacctcaaatatgaaaataggaatgaccctgtctctatgctcttgcattcacttatattctagcttgttaagagagaagtttggggcaaaatgtgctttataaatagtaaaaactgaggtaaactatagcacaaagtgtgctatataaacagtaaaaaccgaggtaaaaatatggggaggacaaaaaagggctaaaatggtgttggaatataagaaatagcagtaaaagaagctcctcacagcaagacagtacagggaaatgtctggagggacaaagatttacttacaatcaggcctcaaccaatatgagatcgactttcttttattgatatatgacgtgtttatatgtatcaggtacatgtgacattttgttacatgcatataatgtataatgatcaagtcaggtatttggggtattcatcacctcaagtatttatcgtttctatgtgttaggaacatttcaagacctttcttctactattttgaaatatacaatatattgtttttaactataatcaccctactttgctattgaacatcagaacatattccttctatctaactgcctgtttccattaaccaacttctcttcgtctcccttcctcccataacgtacacacccttctctacctctggtttctgtcattctactctctacctacatgatattaacttttttagctcccacatatcagtgagaacatgcaaaatttgtctttctatgcctggcttatttcgtttaacataatgacttccagtttcatccatgttgctgcaaatgaaatgattttatatttatatggttgaataatattcaattgtgtgtatacaccacattttcttcattcatccattgatggacacttaggttgattccatatctttgctaatgtgaatcatgctgcaataaacagtgtggtaccagtatctgtttattattctgaattcttttcctttggataaatacccagtaataagattgctggatcttatgatagttcaatttttagctttttggtaaatctacatattgttttccatagtggctatactaatttgcatgcttaccaatagtgcctacgagtgccttttccttcacatccttgccagcatgtgttatttatttattaatttatttaaatcatgatgattctaactggcataagatgatatctcattgtggttttgatttgcatttctctgatgattagtaatgttgagcaatttccccatacccattgtgcatttgtatgtcttcttttgaaaaatatcctttgccaattttttaatgagattatttgtttttccactgttgagttgtttgagtttcttatatattctggagattaattccttgtcaaatgtatgcaaatattttctcgcattcaacagcttgtctcttcactgtgttgattgtttcctttactgtgcagatgtattttagcttaatatagtcccatttgtctatttttgcttttgttgcctgtgcttttgaggtcttggccataaaatctttgcccaaagccatgtcttgaagtgtctcccttatgttttcttttagtagttttatagttttaagttttatatttaagtctttaatccatcttgagagtacgttttatatggcaataaataggggttgtattaggccatttttgcatctattgtacaaggggttgagttcttgatttgattctccatttggttgctgttggtgtatagaagagttactgatttgtgtgcattcatcttgtatctggaaactttgctgaattattttatcagttctaggagctttctggaggagtctttagggttttaaaggtaaatgatcatatcatcagcaaacagtgacagtttgacttcctctttactgatttgaatgccctttatttctttgttttgtctgattgccctggctaggacttccagtactatgttgaagaggagtggtgagagtgggcatccttgtcttgttccagttctcagagggaatgctttcaacttttccccattcaatattatgttggctgtgggtttgtcatagatggcttttattacactgaggtatgtctcttgtatgctgattttgctgagcattttaatcataaatgtatgctggattttgttgaatgctttttctgcatctattgagatgatcatgtaatttttgtttttaaatctgtttatgtggtgtatcacacttattgacttgcagatgtcaaaccaaccctgcatccctggcatggaacctgcttgatcatggtggattatctttttgttatgttgttgaatttggttatctagtattttgttaaggattttagcatctatgttcatcaaggctatcagtctgtagttttcttttttggttatgtccttccctggttttggtgtgatgctggcttcatagaatgaattagggcaggttccttctttatctgtcttgtagaatagtgtcaaaaagatggggaccaattcctctttgaatgtctagtagaattctgttgtgaatccatctggtcctgaacttttttttggttggtaattttttaattaccaattaaatctcactgcttgttattggtctgttagtaaatttattgaggctcatttcatggcctatcatatggtctaccttggagaaatttccacgcgctgttgaatagaatgtgtgttctgtggttattggatgaaatgttctgtatataactgttaagtccatttgttctaaggtataatttaaatccattatttttttgttgactttctgtcttgatgaactgtctagtgctgtcaatgaagtattgaagtcccccactattattgtgttgctgtctatctcatttcttaggtctattagtaattgttctataaatttgggagctccagtgttaggtgcatatatgtttaagattgtgatattttcctgttggacaaggccttttaccattatataatgtccctctttgtctcttttaactgctgttgctttaaagtttgttttgcctactcactttggtggccatttgcatgaaatacctttttcacccttttaagtggagcatttaggccatttacattcaatgttagtaatgtaaatgcctggctatgccaggcaggaatggcctgctcagggacccagtgagctcccagggcctttctcactgcttcctctacacctgtattttgctcagctctctaagttaactcaactccaggtaaggtcagaaacttctcccacaaacagaccttcagtttctccagtgggagtgtgtgtttaggagaggaggatctccctttcccacttccgcagttggggcactcacagtatttggggtgtctcctgggtcctgcaggagcaatctacttccttcagagggtctgtgggtcctctcaggattgctggtttgttcttgcagtctatctgcagctaaaattcacaatgcgagcctccacatgctgctctgtccatctgagttggagctgcaatctaggcctacctcccatccgccaagatcctgagaagttggggattatatttcaacatgagatttggagggaacaaacatccaaaccatatcagcagtccagttttattcttttgcacatggatatccaatggatatccaattttttcagcaccatttcttgaacactgtgtcctttcctcaatgtatattcttgtcacctttgttgaaaatctgttggctataaatatgtggatgcatttctaggttctctattctcttccattggtctaagtgtctgttctaatgtcagtatcatgctgtttaggttcctatacttttgtaatatactttgaaatcaggtagtatgatacctctagcattgttcttttttcacaggatgactttggctactggagctattttttaatttcatacaaattttagattggtttttccatttctgtgaaaaatgacattgctattttgatagcggtcatatagaatctgtagattgctttgggtagtatggccattttaacaatattaatttttctgatccatgaacataggatatctctccatttgtttctgtccttttcaattcttttatcagtgttttgtagttttccgaatagaggtttttcggttccttggttaaatttatccctaaatattttattttttagctattgtaaatgggattgccttcttaatttccttctcagctagtttattattggtgtgtagaaacattgcttgtttcatatgctgattttgtctcctgtaactttactgaatttatttttcagcgctaagagtgctttggtggagtcttggtttttctaggtataaaatcatgtcatctggaaagatggacagtttgacttcatcttttcctatttgcatgccttttctttctttctttctctgacctgaaagctgtggctaggacttccagtattatattgaataggagtgatggaagtgggcatccttattttgtttcagttcttagaggaaaggcttccagcttttcccaattcagtatgatgttagctgtgggtttgtcatatatgacttttattatattgagatatgttccttctatgattggctgcagatagtttttatcatgaaggaatgttaaattttatcaaatactttttctgtatctattgagatgatcatatggtttttgttctttttgttgatgtgatgtatcacatttattgatttgaactgttcttgcaaccctagtataaatcccacttgatcatggtgtattatcttttggatgtactgttggattcagtttgctagtattttgttgaggattttcacacctatgttccatcagggatattgacctgcagttttatttttacttgcatccttgtctggttatggaatcaggataatactggcctcagagaatgagttagggagaattccttcctgtttaatttttaaaagaatttaaggagacttgttagttttctttgaaagtttggtaaaatttgacagtaaagccatctggtcttgaaattttcttttttgggagactttttactactgattcaatttcattattcattactggtctgttcaggttttctattctttcttaattcaatcttggtaggtggtatgtgtccagaaatttattaatttcctctagatttttcagttttttagtgtatggttgttcataatagtctctgataatcttttctatttctgtggtatcggttgtaatatattttcttttttatttctgattttctttatttcagtctcttctctttttcttggttagtctagctagagctatatccattttatcttttttaaataacaacttttcattttgctaatcccttgttgttgtttttctctatttcattaagttcttctgttcttcattttttctttccttctgctagttttgggttttgttcttgcttttctagcttgttgaggtacatgattagattatatatttgaaatctttctatgtttttaatttaagtgtttattgataagcttctctcttagcactgcttttgctgtatcccatggcttttcctatgttgtatttcaattttcatttgtttcaaaaaatttttgatttccttcttaattttcttcttgacataacgttcattcaggagcatgttgtttaatttccatgtatttgtataggttttaaagtttttcttgttattgatttctagttttattccattgtggtctgagaagatgcttaatatgatttcaaatatttcaaattagttgagacttcttttgtgttctaacatatggtgtatcctggggaatgcgtcatgtgctgatgagataaatatattctgtagctgttggatgaaatattgtgtaaatgttagatccatttggtctaaagtcaagtttaaatccaatgtttctttgttaattttctgtctagatgatctatctgatgctgagattagaatgttgaaatccccaactattattgtattggattctatttcaccctttatatctaataacatttgctttacatatctggatgctctggtgttgagtgtgaatgtttagaattgttatatactcttgctgaattgttccttttatcattatgtaatgacttttgtctcttagtgttttttatttaaagtcaattttatctgttataggtataactacttttgctcatttttggtttctctttgtatggaagatctttcatctttttactttcagtctatatttatctttacaagtgagataagtttcttataggcagcttacaactgggtcatatttttgttttaaatctatttagccagtctatatctttcaagtaacaatttaatccatttacatgcaaggctattattgacatgtgagagcttattcctgccattttgttaattgattcctggttgttttgttttttttttagtttgtttgttttgtgtttttttcttccttccttccttttctttctttcattctctctctctctctctttctttctttctttctttcttattatttatgattgtggtttggtgattttctgtagtggtaacgtttgagttctttctcttctttatttgtgttttgctctaccagttagttgtatacctttgtgtgtcttcataatggcagtgtcctgtcactttcatgtgtaggactcccttaaatatttcttgtaaagccagtctagtgatagtgaattccttcaaatttttcttgcccagaaaagattttatttatccttcatttttgaagaacaatgttgctgggtataacatccttggtgtcatttttttctttcactattttgaatatatcatcccatcttctcctggcctgtgaggtttctgctgagaaatctgctgttaatctgttaatcttgtggaagttcccttataagtgactagacattttgcttgctgttttagagttcttactctttggcttttgacagtttgactataatgtgctgtggagaagagctttttgcattatattatttgggaatttctgattttcatttgtctggatgtctacatttcttgctagacttgacaagttttcagctattgtgttgttacgtaggtttcctacacctttcatgttctctttaccttctgggaaactgcaaatttgaatatttgttcactttatagtgcctcatatgtcacatacactttgttcattctttttttttcctttctatcatttgaccagctaattttaaaagacctgtcttcaagttctgaaatttttcttctgcttgatctgatctattgttgaagtttttgaatgtattttgtatttctttcaataaactcttcagttacagaatttctgtttggttcattcttgtcgtatctatctcttgggtaaatttctcattcatatcctgaattgtttttctgatttctttttattgtttatctgagttctcttgtgtctcactgagcttccttaatatcaacattttggattcttttttccagaattttataaatgtcttttttttccactggcttatgttgctgaagaattattaaattcctttggaagtgtcatatttcttcacctttttatgtttattttgttcttgcattgatatctctgcatctggtgtaatgattgctgcttccagttttgtaaatttgtttttgtaggggaagacttttttctgaagatgtatcttggtgttgattgagtagggcactttgattttgatttctaggtgcatacagcagcatagtcttcatattattttttttcagctgccaacagtatcatcagtgtctgtgattttttcagtggcttagggtgcatttgttagtgaaggtggtgatgaggttgtgctggagacaagaatatcaagtgggccagtccttggccccagtggtggtggtgggcctagcattcctgtccttgggccccatggctgtgtacattggcactgatggtaatgagtctagttgggttgattctttggccttcaggcagtttgcttgggtgtcagtagtggccatagtagactgggctggtgtgtgggtcctcaggcttctgggcagtgggtgtggtgtgggtgatggctgtagcaactgcaggacaaccctctggctcccaagcagtctgcactggtgttggtggtggctgcaagggctgaatgagccagtcttcagacccacaggtggcacatgcaggaggtgccagttgtgatggcagtggcagattgggtaggcccatcatcaggcttctgggagggttgcttaggtaccagtcatggtggatggcacaaggctgtctctgggttcccagacaacttgcttaggcattgaggaaggcaaagccaggctgggtgttcctgacctcaggccactcagtggtgtgtgtggacaccggctatcataggctggagtggagtgatcctcaggcccccagcagaatgcctgagtgaattagcagctactgcattgttgccctgctcttgaaggggtgcggggtgtgttgctttcagtggcagcagctataaatgggttgctggtgggcatgtgtttcagccccagatggtggctgcaagtggggtagcattttcttagggagcttataaatgtgtagcagccctgctactgggggtgggggagtccacttctaatgacacactttatccctggtgacagcagccagcagtagcactcagctgtgggtgggggatgtcagcagagcttcagggatgtagagatgcagatgatgttggggtctgaggaacgatgtcatctggtgggtgttgggctctcaaaatggcaccttgctgctcagtaatggggatggcaggggtgggacccagtgagagctccttctctggagcaatgcctttgtgcgattgctgggcagttccttatgatagtctcaaggcctgcatggtcaagggactctcctgtggctaggattcctggagtccataatgcagatgtggaccactgggagtcagtcacttaactttcgatgcactggggagcctctctggcctcacagaggatccctactgggtaggcttccttgcttccctccccttcattgccttagatgcttcctgtcacttctctgttgaattccagaattctctcttatgtgggattttctacttactattttggttctttgtggaggaggtgagtgtcagctgcccttagtcagtaatcttcaagccccttcccttgaaattttttaagctttatgtttttatttctaatagactgaaagagcataatcatattttaaacactctaaggctatatgggggactatctgaaggcctcagatgagtaaaagaagtagcgaattagttaactatgtttttcttttcatttcatttcccaaatcaaatcatttgtttcttcaaataaagaatctctatttcccccttatgttcttcagcaaataaaaatgtttgcatctaccaaagtgtatatgaatttgaaatacgtaatctaacaaacaaggatgttttaagatctctgagtaagatgcatagttgcaaataaaaggagttttcaaggataaaaaatgtaaataaaacatctaataaatgtgtaccatcagaaacttatggtatattctcctggaaaagatgaagatgaagaaaataagtctacagaagaggagaaattctttggaaattttgcatttttgtggatagtggttttgaagaaagcttagatatatttaaatatgttgctaagatgtgactcccacactttaaagaaaagttcttcattttagttgcccttgcaaattggctaagtttatttttcctcaacaaataattttgatggtttctaaaattgtccagaatttgaggaaatacttagatgtagtagatgacatcaatttatgttaacttagatttattgttggatggttaagttaatcatgtctgttcttgtccagtctagaagtttctgcttcctcctcatgtgttctattctgtcctcatcacataacatctgaactgtgatttgacagtgtccttattatcagactctgctcaatgacagtttaaacttctttttgatacagtaaaaaacttttccttaaagatgaaattcttaaggacaattagcttgtgtagactcatatgaaaattgcttgcattttggagttacattagctcttctcctttataaattaatgaatcctattggtaccatataatagcatcaacatttgccttttgtgtctcgcctttcaaagggcaattttccaaaaagtatattttgcatggctcaggctaaaagtaatgtctccagatgaagttctactttgtgaccattgattgtgactattgataagatttactatgtaaagtataagttactggaataatacatttaagaaatatagtagctattaaaacctgtagtctgatgaaatggaatatgttttgaaagacagcagtgaaaaatgagaagtaatatataagtaataaaattgctttttgcaattgagttgaagattgatgccaggatcttattacctccaggatttcacaaaggatttcttgagtcatccccttgctctagctcatgaacaaagtattgctcaagtaatcgacagattatttgtgtattctcacatgtgattattatttagtgctgtcacgggaaatatcctgcctaagtttactggaggtcttcctccccttacccctccctatgtcctcctacctggttatccttttcaatcctattactctttccttgcacactctactccagcttagggcctgggctctgaccattacctctgcctaaaaattcctcctcatgacatccatttgcccaatttcttcacccttttaattaccccattaagtgatattttgcttgctcaatttttgccttttcaatcagatctaatttattttatatttttaaactttatttatatatatttagaaggtatgtactagttcgttatcatgctgcttataaagacatacctgagactgggtaatttataaggaaaaaacgtttaattgtctcacagttccacagggctggggaggcctcgggaaacttacaatcatggcagaagaagaaacaaacatgtccttcttcacatggcagcagcaagtagaagtgccaagcaaaagggggaaaagccgcttataaaaccatcagatcttgtaagaactcactatcacgagaagagcatgagagtaacctcctctatgattcaattacctccctccaaatccctcccacaacacgtgaggattatgggaactacaattcaagatgagatttgggtggggacacagtcaagctgtatcagggtacaagctcgggtttcttacatatgtatgttgcatagtggtgaagtctgagcttttagtggaccatcacctgaaaagtgaatgttgtatccaatccgtagtttttcagtcctcaccatactcctatcctcccacctttctctagtctcaagtgtctattatttcattctatatgtctatgcttactcatcgtttagctcccacttggctctcactaaatgagaacatactgtgtttgactttctgtttctgagttatttcactgaggataatgtcctccagttctaaccatgtttctagagaagacatgatttcattcttttttatggctgagtaatatatatgtatataaatatatatacaccacattttctttatccaatcgtccattggtagacatttaggttgattccatatctttgctattgggaacagtgctactttgaacatactaatgcagatatcttttttaatatgatctctttcactttgggtccatacccagtagtgggattgcaggattgaatggtagttctgtttctagttctttaagaaatcttcatgctgtcttccataaagtttgtactaatttacattcttaccaacagtgtataagcattttcttgtctccacatcctcaccaacatctgctgtttttgaactttataatgatagccattctgactggcataaggaggtatcatatggtggttttaatttgcattctctgattattagtgatgttgaacttttttttgacgtttattggccacttgtatgtcttcttttggaaaatgtctgctcaggacctgagctcactgtatttgtcagggttccctagagagacagaactaataggagatagatagatagatagatagatagatagatagatagatagatagatatagatttagatataaaagggagtttattaagtagtgttaacttacacaatcacaaggtcccacaataggccatctgcaagcagaggagcaaggaagccagtccaagtcccaaagctgaaggacttggagtccaatgtttgagggcaggaagcatccagcatgggagaaagatgtaggcttggaggctaagccagtccaggattttcacatgttttttttctgcctgctttatatcctggccacactggcaactgattagatggtgcccacccagattaagggtgggtctgcctttcccagcccactgactaaaatgttaatctcctttggcaataccctcacagacacactcaggatcaatactttgcacacttcaatccaatcaagttgacactcagtattaaccatcacaagtccatcgcttgtcaacttgagcctatacacatcccctgaggtcatacattatcttcaaataaagacaacaataagtcataattatgcctaacatactaaaactatccttcgtgcaattgaaaatgcaccaatccccattgcaaatgctattacataaacttaacaatacttaaatgctgatatgaagtcaataaatcttatgtcacatgataaaggaaaaaggaagtaaaatgtatatattttcttagtacaagtgtatacagacacgaaggtgtttttaacaaaagaaggaggaaatactcatgacaattacagtccttgtatctgcaattggtcacgtgatcgtagctggtattgatgactaccttcttctgctacatattctgtattccctttgccctcagcaagcacctcagcaggtcttgtcttttttttttttttttttcctggtggagtgacccaaacctttatttgtagtcctgcctggaatggcctgtagtagtttcccactgaccttaattccaggacatggtaaaactaagagacaccctaatggatctcctatattccatgcatacgcttccttacctccattgtggagttgtagactgatttcatcttgatagtctgggttaatcaccccagccaacactgtaactctcttcttagcctgttgacttaaaggtgggaggagcccaaagtgtccaggtggcaatcttaatttgcagtttaatggaatcattattgtgtcacctggcggcagtgttcctccctctggaactaagacctctaagccagcagaacataatgccatgggaacaggaagcaaaaattttgctagtggaacactaggggtgatggtgagtggtgccacttccacttccacttccaccctttgattcctggacccgtgaatcctgtctatgggagaaacagtaccatatattggacactgattcagagcatacacagccttctggagaactttgccccaggcctgcaaagtattgtcacctagttggcattgtaatcgtgacttcaaaaggccattcaaaagctgcttcaggatgatagggatcatggtaagaccagtaaattccatgagcatgagcccactgtcacacttctttagccataaagtgagtggcttggtcagaagcaatgctgtgtggaataccatgacagtggatacggcattctgtgattccatggatggtagtcttggcataagcattgagttcaggattgggaaacccatatccagagtaagtgtctattccagtgaggacaagcctctgccctttccatgatggaagaggtccaatataatcaacctgccaccaggtagctggctgatcaccccgaggaatggtgccatatcaagggcttagtgttggtctctgatgctggcaagcagtggctgtggccaggtcagctttggtgagtggaagtccatgttgctgagcccaagcataacttccatccctgcaactgtggccactttgttcatgggtccattggacgatgacatgagtggcctgggaaaaggctgagtggtgtccacagaattgatcatcctatccacttgattattaaaatcctcttctgctgaggtcacccattggtgagcactcacatgggatgaaaatatctttgtagtttttgactaatcatagaggtccatccacatacctcttccccaaatttctttgtcatcaattttccagtcatgctttttccaagtccctgaccatctagccaaacctttggctacagcccatgaataagtatataatcgcaaatctggccatttctccttctgtgcaaagtgcacaaccaggcacactgctcaaagttctgccaactaggaagatttcccttcaccgttgtccttcagggatgtcctagaaaggggctgtagtgctgcggctgtccacttttgggtggtgcctgcatatcgtgcagaactatctgtgaaccaggacctagtcttctcttcctctgtcagctgatcatagggaactccccatgagaccatcggtgcagtctcagggagagaaagcagtgtgtcaggagtggagaccatgggcatttgagcccctttctcatgtaacttactagtgccttcaggatctgctcaagcccaatcgcatatataccacttccatttgctgatgcaatgctgctgtgcacagcccactttatggctagatggatcagaaagcacccagttcatgataggcagttcaggtcacatggtgacttgatgactcatagtcaaatatttcgtttccaccaaagcccagtaacaggccaagagctttctccctaaaagagagtagttatctgcagaagatggcagggccttgctccaaaatcctagaggcctccgctgtgattcagcctgccaaatgctccaaacagcatccctatctggcactgacacctcaagcatcattggatctgctaggtcatatggcccaagtggcatagcagcttgcacagcagcctggacctgtggcagagccttctgttctggactccactcaaaactggcagccttttggatcactcgataaatgggccagagtaacacacccaaatcaggaatatgttgcctccaaaatccaaataggcccactaggcgttgtgcctatttcttggttgtaagagtggccaaatgcagcaaattatccttcactttagaaggaatatctcaaagagccccaaaccattggacccctataaattttactgaggtagaaggtccctgaatttaatcagatttatttcccatcctctgtcccacaaatgtctcatcaataaatccagtgtgtttgctacttcttgctcactagttccagtcagcatgtcatcaatgtaatggaccactgtgatatcttgtggaagtgaaaggtgagcaagttctctccaaataagattatggcacaaagctggagagttgatatactcctgagttcatcattttctttcatcactttgtccagcgaacttacaagcaaccaaccaacttcactatgttccttgattctccacatatagtcaaaagtattatgtatacagtagctaaattccttgcctctcacaagcgttgaatcaagagtgtcaaatgcatttattttgcataactctctaaacaattgatgccaaggattatcagtgttctccataccattagaagaagagtccttagcatatttgggtctaatcatattaagcagccaactccagaaaccccaaaaccaatgaaagaactccatccttaatattctgttcctctagaaccactcctggtaccaaaatctgtattagggttctacagagaaacagaattaataggagatatatatctatatctatatctatatctatatctatctctatatctatctctatatctatatctatatgagagtttattatgtagtattgactcacatgttcacaaggtcccaaaactggccatctgccagctgaggaacaaggaagctaatcggagtcccaaagctgaagaacctggagttcgatgttccagggcaggaagaatccagcatgggagaaaaatgtaggctgggatgccaagccaatctagccttttcacatttttctgcctgctttatatcctggctgtgctggcaactgattagatggtgcccacccagattaagggtgggtctgccttccccagcccactgactgaaatattaatctcctttggtaacaccctcacagacacacccaagatcattactttgcatccttcagtccaatcaagttgacactcagtattaaccatcacagtcactttctaatgaggttggtttttttgttgttgagttccttgtagattctgtatattagccttttgttgcattcatagtttgcaatttttttttctcattctgtaggttatccgtttactctgttgattcggtcttttgcggtgcagaagcattttagtttaattaagtcccatttgtctgtttttgtttttgttgtgtttagttttgaggacttggtcataaattctttgcctaggccacatctaatttttaatcctcttttagagcctgtctttccctccaaactaaatattattttacccccatttgacacatgagctaattgagccttctgtctgttaagtaagttgactagttcagtgtaagttgtttctaattttttgccatcataatgctttagtaaacatccttttcatactctccttaattttcccccaggatggttttctagatgtggacttgctggatccaaagtgtgcatattttccaaatgtatccatatattgtggctttgtgttttaatagaggtagcagcaatattagaggagagaattaaggaacgattctagtgtagcaggacaagctgcatacaaaacccctcagacaccgagttaaagaaggaagggctttattcggctgggagcttgggcaagactcacatctccaacaaccaagctctcagagtgagcaattcctgtcccttttaagggcttacaactctaagggggtacatgactgggggctgcatgcactggtcatcagaatggaacagaacaggacagggattttcacactgcttttccatacagtgtctggaatctatagataacataactggccaggtcaggggtttatctttaaccaggcccaggatgtggtctcaggctgtttgcctgtggatttcatttctgccttttagtttttacttcttctttctttggaggcagaaattgggcataaaacaatatgaagggtggtctcctcccttactaggaagagagaaataccatgtgagaatgaaatacgtatttgtgttattggatttgacatcggggttggaccaagcatcttctatgaacatctataagcacgttctccttatcaaaaggtactttgcttggtgctttaaaagataaatgactatgtagcttaggagatttcttcataattgaaaaccacagcagctgttatttgaacatacctgagccccttctggaccactgtaggagaaggaggaagagaggtgaaagtgatttctgctgctgagggcatgtatgatgacaatgggtatttgtcctaactttgacactacaaagtgactggagctttaggcaagtagttactccaattgtcttttcagactctttctttttgaggtatttgacctctttgcggcatcagcctgctgctatttcacatgcacctagaagggactttaaaacatgcacagaattgaacaaagcagtaaccattcgttggtgtcccttaacaatatgtcaaatactattatttttgaaaggtaaataaatccttgggcttagtggatcctaaatgctaatttaaaaatctgaactcatttccatcccttattactttaaacaaattgctaacctgaatgataatagaaacttttttccttttaacagttggaggcatctatactgtgattcagacaaaggccaaaacaacagcagatgaatggggagagaactattttctgataggtccatattttgagcataatatgaagactcaggtggaacagtgtgaacctgtaaatgatgctgtcagaagagcagtggacgcaatgaataagcatggctgccaggtaaaggaactgacacttcacttggcaattctcagtaaacttatgggaaaaaagactgtaactaacatgaactcacaagagaagaccattcacttacttaaggaaaactttcaggtttgtgagaaagatgatgaacttgcttttaaatggattgcatttgagacaccttgtgaaaaccgaggaggaaggataattggtttggagttcagcagaagatacagagtaaacatgtttttgaggaagtcatttgtacataaactgaagtcatgagtgttgttaaaaattattcagtggaaatgtttagacttggagtaaaggttttcaaccaaaccttgtggaatgtcagcatgttagggcatctacattaaaagaagctagagattgcaaatgtagaagcaaagctaatgatgtacaaccaaggatgttcaagtcttaatcctcagaagctgtgaatatgctaccttttatagcaaatggaatatggcagatgtgattaagttaaagattttgagaaggggagataatcctgagttatctaggtgggtcctcctaagagggaggccatagaattagaatcaggcaggagatgtgccaatgaaagcagaggttgaagggagctactttgcagatggaggaagaggccacaaggaatataggtggcctatagaagtaagaaaaagcggccaggcatggtggctcatgcctataatcccagcactttgggaggccaagatggatggatcacctgaggtcagaagttcaagaccagcctggtcaacgtggtgaaacccctgtctctactagatatacaaaaattagccaggtgtggttttgcaggcaggcacctgtagtcccagctactcaggaggctgaggcaggagaatcacttgaacccaggaggcagaggttgcaatgagctgagatcgtgccattgctcgcctgcttgggcaacaagagtgaaacttcatctcaaaaaaaaaaaaaaaaaaaagaagaagtaagaaaataaattcttccctggaaactacacatggaatgtggctctgtcaacacactgattttagtctattttggactactgacttcaatatctgtaagataataaatttgttttaagccactaggcttttggtaatttgttacagctccaacaggaatcgtgatgtcaagtcaagggaggagagaattttaagtatgaagaagggattaagtcagcaaaggactgatccagggtctgttgggtttggtaatatttgggccattggtaacatggataagtacagtttcagaggagaaaggaaggttaaatctcatttcagtgggttaaggaataaatacgtggtaagaaaaaagacacagaagttgtgattatgagatttttctatgaatataaaatataataatgtagttgcagaatgacatggttttgagaattggtgtgttattaaatatgggtaagacctgagcatgtttatttgcaaaaaggaaatacctagcagacagggaaaagctaaaagctcagaataaatggaggattgaagagaataaagtcgctgagaatggggaaggggacaagatccaaagcaatactgaaagaatcatttttcgcttgtctcactcaaaaaaggaaaaaaggataaatgcaaatactagatacaagttaatgaagaattcaggacaatcttacccaatgtttttgatgatctcactgaagcaggtattaaaggtcattttatgacaattaaaaggcaagtgtagaaactagggaagttcaagaaagaagttctgaaaaagtgttcaaggaatttttggacatgtttgagatgtagtcatgactttatagtggcacaaatacacacggctgtgactttgtccaggagcagtctgcagtctgagtgatggtgcaggaagttgaatagatgaagatccagtgttgtttaatttgaccattcatgcaatgggtcaaggtggcccaagaattgaaggtaattgtaaaagtgattgaattaatagtttaattcatgggccattgcattggaatagatagaaaaggaaggaattaaataaggaatagacaggaaagaaagtaagcaaagccagaaagaagatgataatgtaggacaaaatggagggttataggaactggaggtcttaaaggggagaaagaaagaatatatacactggcagaaacacagtgacagaaatggaagtacaagagttgtaactgggtaacagaatgccgaagtggaatattttagagaagaaatcatttgggatttgacaaggaaagaatgcagtcatgatcctgagtagctgaaatcaggtggacatgaaagtcttttaagtccataaggtcaagtaaccatgaggttaagtgtgcaggataaaaaatctggactttgaagttgcttaggataaggtcaaaaagtaaccttatctttgctgagcaaggaaaggtaatatttttggatagcaaacatttcaaaggtgttttatatgtaaataaagaataaggctttaaaagcttcagtagaattttaaaaatcagtaactttccttcctactcatcccaggaatatagtttctgggggtgaaaaaatgcaaagtcttcacttgagatgctgtgtgggtagtggtgtctaggaggtgcatgcaaggtttaaagagtggaatgcataatttacaagggaaattgagatcccaaagagtaccggaaaacatttcttagtgaaggcagcatagagaatgttagaaatgtgatagaacaatgcctattgtactatcaggatgcaaataaatgaaatgttagaaagggcttgcatttgaagttctggtgaaggaagagttagatgagaaacacaatggaactgactggtctcaagacttcatggctttctagtgtagggatattttcatgttgcagccaagaactgactggaggtcaatgccaattggcttacattctctatttgtgtaataggttcagctcttctttatgatcttagcttatgtatcatgtggcacatattaggcagtcagtaaatattatatagtaatattacatgttattcacagtgtataaatacatgaagcaatgaatttcccaaggagaaaaactattgaaaagtggtttggggctcaggaaaatttcatcttaaaaggaaacagtggcatgataaacactaaattataatggaaacaactgaaacataatgagggtctttcaaggttgaccaaggaacagatgggtgagaagcatccccacacatgcctgggtcccctggtaggaaatgatcaaattgggctttgaagtcctgcaaaattcagccataggtggagtcataagtgtcaatatgtaagcaatattaatatattttattttctagagaagcctggatccacattgagaaagactcgtagcctctgctgagttccagaaagggtttgaagtggtttatgaggttgtatatcatgtaaaaggagaataaacataaaaagaaaattaagacaaaagaacaagtaaattactatagaaatatggagacaaaaaaggaagttaaaacttggatatgcaagtgatgatatacatacaactggaaaaaaatgagagagctaattcattaaaacttgcagaagataaaacatttaggaatcaacgtcaatttgaagaatgtaatagaattatactttgagttactagattaaagagataatgtatctagggcaatgtgtttagttaaacctctggcagcaaccatactgggaaacattttgcatcacttcttttgataggaatagtaagataaatcatacatattggactacagaaatagctttttcttctagcaggaaatattgttagtcctgttccataaaagaaaataagcgacactggagccattatatccaactacccaggttttcagagatacaaagcatttcatggctctgtcataaaagcagacactataatattaatcactgtgagttcatggtcacaagagagtaactagagacagatgaacagagattacatgatttagatacattgtttttaaatttaatgaagagcaagaatttggaggttctagatgaatggatttatgcccattccagcttgaggctcaaacagcagaggctatatgttatcaatattcttttctaagtagcttgtttaatttgctattgagtactacataaagtttatatcctcagagtgcaaatacattgtcctgtcttgcatgacttaatatcactacatggctgtgttctttatatgacaggtgcattttggaagatggctgatagaaggaagtccttatgtggtactttttgacataggctattcagcttggaatctggacaggtggaagggtgacctctgggaagcatgcagtgtcggcattccttatcatgaccgagaagccaatgatatgctgatatttggatctttaactgcctggttcttaaaagaggtatggtttattatatagtgatacaacggaggagcagcacaactgctttcagtgcccaagaatgatcccatgatctttaaatgaggcagattttgagatgatgccattatggcttgtcctaatacaattgaaagaaatctgaggaaatgttgagcattctgcaaattaaatggaatagcgtaataatgatacttattactatttacctcatgtcaaatttaaatggcatgatgtgtatcaaacacccaattatattgccccatatatagatgatacttaatatatatatataagaaaaacatgaagtatagaatcttaagagtagcaaatagcttaataagctatttgtttaataagctttccaggtgatcctgatgtacactacatgtgataaccactgttttaagtttactctccaaatttcccaattctctgctcagccttcttcaatgacagtgttttgctattgtctctattaaggaaatgaactctcattgtggagtcagtgtgaatgttaatattttgtaagggcaaacaaaataagttgtctctttgtaaggcaaagatacggatgcccacctgatttggaactagaccctggggtggaattagaccccgatcttcagtgtgttacaaagctgctatttgattctaggcatgttttttattagcctctttctctctaattccatattcttaataatatatcagttaaattttgttggcttcaagaaaaagaaaacccaaataagataaatttaaaacatggaatcatttattatttattataaaatgatgtaacggcattttatctttgtttctcaaaatcaaatatgcaaatatatacatgaaaatcattgtatgcttttagagttttcaagtcattgaaaatccaagtaattatctattagaaaaaaatgatattgtaaaagtcactttttcttcatatgcatttttttttcattatgattgttaaatagttttaggcaacatttgcttctccataattgggccactacaaatatacaaggcattttcaagtctcttcctggccatttctttagtaaatatcaaaatatatactataaataaacacaagtctagtcaattaaaaaaaatttaagtagttttttaaaaataagcttataagtaagtggtcccaattgattcagctgttcagtgatatctttaagaatttatttattcttaaataaatattttttgagtgcctactttgcatttattccatttatttattaatattcattacctgttattaatattagtatttattcttctgtggatataaaaaatctgctccatcactgaaagggaggattaagacctaaaaatatatggggttaatgaacatgccactgaatcctgtattatccttgctaaatattcatgctttatgtttcgactcctttaagttgcaaaataatttatagacaccataactccacttatgatgtggaccatgatcacaatcaagcttcatcaacaacttttctgaatgctttttttttcctaatgtaggtgacagatcatgcagatggtaaatatgtcgttgcccaattccatgaatggcaggctggaattggactgatcctttctcgagccaggaaacttcctattgccacaatatttacaacccacgctacactacttgggaggtatctctgtgcagcaaatattgatttctacaaccatcttgataaggtaaatattccttcctccctccctcttactcacccttctttcagattgctgaagctgaaagataagtattgatctgtacatttcatctgccaaccagatggcagaaatgcccttttagctaatcaatattcatgacaaagcttcccttgggttgaaagacagctcatatagttcaactttgttcagagtacactagagtatagaggtgagaggcctgatttctgtcccactttggaacaatagttccagagggatatggtaggagtaaagacatggtgtaggtgcaaggttgggcccttgttctagcctaaggctatggaagcgctgtgaacaccctggatccacatgcagctctgagtggcaggtagataattgagatttgagacatacaaacttgcactatgagacttacttcctctatttcttctatcctccaagtaaacaattgattaaaagccacattataggttgataggttcagttttccctgtaactttgcaatgcacagggggcatttttgtgggatcaagtaaaacagaagttattgcaaacagggatatgggtccttggtgaacaagaagttatttttgctcatcttagcaggttacctgagtctatgacctgccaaagtcattcagttttgatttatttcttctatttttcatgtcaatttagattaatgaaagtatatattttatatcatcatgttaataatattaacaaaatgtttgagtagtataaattcagaggttttgcagatttggtgtctatattaacaatcaaatctatttagtactctagggttcagttttgctatcaggaaaattaggaagttagaaagttgatttttaaaaatttcccagcttaaagagttctaggattctataaaatagaatgtgtatgtgtgtgtaatacacaaataatactcaaataatgccactgaaaagttatactactgtctcaaagacacttagagcgcaagaacgttctttctgaaaaactttaacatctgtaaagcaatgagtggtcctgatgagcccttccctataaaaaggtcagcctaatttaaaggtcaaactagaaacacaagctgtacatttaaaataaaatcaccaaggaattcagaaagcctggggatctgggaggttcttagcggtatatagtaatggtggactaataagggcaaaccagtgatctgtgataagctggtaagctcaacaaccatgcttcctggagaggagtgcactttgacttcagtgaaggagaaaatattagagtggcagattgaatatttcacttcagaattcttgaatcttgtatagtaataattaattttaaaagctactaataatatacataggatatttttctttggttttaaggaagaaatgcattatagtatatagttatatattacaattttacccttttgatgaaagggcagtatttttcatactgtctttagatataatcacacatctctctagtttaaagcccttcactggttgagatacttaagtttagtcagatccctgcccatctttctagtaaaatgttctatctagcaaaatgactagtagacaacaagcagtcaagaactagcttttgggttaaattcatagtcattttacacagcagaagcccccatgctcacactaaatttagaatttgggtgacacataagaataccaaattatatacatgaaaggtttttaaaatttcagtataaggaagaagtcatagtttaatctttgatgcaggaaccaggatcagcttcagtaaattctgactcagacaaatgaaaatagggcaaatatgagaacaagaataagataattaaacttttgtaaaatcagaaagattagaacgattttactcaaattactgctaactgaaaacaatttttgttagtagccaattacaaaaactctaacgctggtttaagtttttagtaaaattcattatttaaaataagattttaaccattttcagccagcgtatgaaatttctgagaatatgtctccaaattcattttttaaagtccaatcattgatcaattatcctctcgactctaatgactacataataaattcttttttttcctctaaagcctttagttttcttgttttgccccccgccccaccccccctcccattttatgttgtttgtttgtttttgtttttgacacggagtcttgctctgtcgccaggctagagtgccgtagcgtgatctcggctcactgcaacctccacctcccgggttcaagcgattcccctgcctcagcctcctgagtaggtgggactacaggcacgcacaaccacagccagctaattttttgtatttttagtagagacgagttttcaccatattggccaggatcgcctcgatctcctgagctcgtcatccgcccgcctcagcctcccaaagtgctgggattacaggcgtgagccaccactcccggccttttttttcttaattgtagcagaatttcctagatggaaatctgaggacagtgccgtttgggattggaaaatggggaaggaagccatggacaattatttggtggatttaaactctttcttctgatcaagctttgagctagtcaacttcaattacagggttatccacatgtgtcactggactgtgttttattgattaatatgtactttacccattttttgtttttctatacacattatccagaattcaataaaaaactatgagatatattaaaatgcaagaaagtaaaaacccattgtcagaaagaccaggtccagatatgtcctgtgttggaattattgtacagagattttaagatataatcataaatatgtggaagaatggacaacatgtgtaaacggataaggtttctgtaaagccacaggagtggccacgcgtactacagacctaaaagataagtgtgccccatgggaggagggaaaggcagaagcatgcacacccacccgacttccccaaggcctctcacggggtctccaggctcttgctatcctgcctctgtatttgtgcatactcagcctgctcatttagaaaatctatcttcccatctctaaatgtccaaatgttaaatgctgtcttatctgtgacatgtgattctctacaacaataataataattaataataacaatggctaaatttattgagcactttccatataccaggcacttttctaaacatttgacatttgttgtctcatttgaaattcacaaaatactcaatgggatagaaaacattctttacttctttccagagttatttttcttaaacactggctctgtctttaccacacctctaaataaacactttcagagtggcttttcttgtttacaggacaaaggcaaaattcctaggctcatcttcagggatttcagtgatctggccctattgtatctgaccagcctctgtctcttacattctacatccagtgctacagtcacatcagatgtcctgctattttctgcacatgccatagcattttctatacttgttctttagggcagctagcatttcagctaaaaataactttcccagaattaaactttcatatcctggtccaaatgccattttattcatccaaccaatttggagatagaaagatgaataagtcttcgtctttgcacttgaaagtcttacatttgtagagttgatactgactacgcttactgcgtagtatgagataattttgcctaccttcagccagagtgaatcagtgctgctttgatcctataacttattcagacacatactcatttcatttctacctgtttttaatccattttccattaatttataagtttcttaaagttaatagatacacataaattgctcaaaaaagttgattaaatgagagatttggtttcattaattaggctggccacatagagcttttaagaaaacttctgctgatccaagcatgtcatatacaacctgattcaaacattttcagagagatgattccaaatattacagtcatgaaagaatgctctaggagttttcttgttctaatcatgagattcctctaatgggtctctttttagtatttttctctatatgatgccataattattgggactaacttcttgatagagttgaagtctcaatgatataaaaacagatgaatacaagactgtattcattaatcagtcaggctgattaaggatcaaattagggttctaccaagattcttaatagcaatgtgaccttcgacaagtttcttgacctctaaaaggttcaatttccttctccataaaatgaaggcaaaatatgtgtctcagtagtttataagaattaaatatgttattgtgcgtagtggagtgcctgacactagtgctgaagagctactaaaaatcttcactatgaaaagcaccctacttacataatgtcagaaactttacatattctttttgtcttagacactgctagtttcatatggagctgcgtgagacactacattcagtaactaagtgaaatggcaaaagcccacactgttgccagttatttaagtgattgttgggaatttgactttttttaagttaaactacccagaagcatagataattgcataatctagcacaatatctaactagactaactatacactctttgcaattataaaggggaagttctataaccaaggaaaagcgtttgtctttctctttttcaggttccctttcagtgaattaagcattataataattattcttattttcgatgtcaactttaatgtcaactttgtttcattgtttatgggaaaatatataaaagactttggagaaaggcattagctcagtattccaagatgtagaataagtaaaagtgtaattaaaatgtcaaaaattcaagaattctatgtgattacagtaaggtagaaacatcatttacttagggagttaaactgcagtttagagggagaaatggagtaaacaatgtcttttaaagtgtaattccttatgtatattgtagtaatgggtttaattcaagtttttattacttttttgtggtcataaatttttacacagccttgaggtaagccacttggtgaaatgtgtgattttgtttagcttgtgtagaagggccattgttagcaaatgtgtgttttatttttgtttctaacagtttaacattgacaaagaggctggggaaaggcagatttaccaccggtactgcatggagcgagcttccgttcattgcgctcacgtgttcaccacggtttctgaaataacagcaatagaagctgaacatatgctgaagagaaagcctggtaattattatccctggatcacctatctttcagttccgaatgatgttacactatgaggattttgttttccatcgtgaagtagtagtttgaggaaaaattgcattcagttaccacgcagctctttttatgtattttaattctcaatttcagtaggtttgcagggaaaccaactcaaagctatatctggaacatggctaagtgttcaatctgtgcttgttgaataaatgagctatgcttgaaataaccttggtatgacctgggttgtcataatgagtcggtatgtgtaaggaagttcggttgactcttgtcttttgagaaaatgaaagccaagaaaacagaaatttgtgtgagactatcccagtcctacatcttgtaatattgcctcattggtgctgtgttggtagaaacgttttatattacctatccccagattccttggaaatttttccaggaactatctacagacccaaccagagcttgcaatgtgaagaactcatgctcataagacatggccctgtcacccggccacggctgattggcccaaaggaagacatctgacataagctgggccaatcagaatgctcccattcaaacgagtctctcaatgcactgtcatacaatgaaacactaccaataactcaaagctattggtagtgttcatttttctactttgttgcactggatgcaaagaagattaaactacactgaattgttataagaagcaaaaacagactgagagagagaactagaggctctccacagtgatttcgacccctttttcttttttttttttgagatggagtcttgctccattgcccaggctggagtgcagtggcgtgatctcagctcactgcagcttctgcctcccgggttcaagcaattctctgcctcagcctctcgagtagctgggattacaggcacctgccaccacgcccagctaatttttgtatttttagtagagacggggtttcactatcttggccaggctggtcttgaactcctgacctcgtgatccacccgccttggcctcccaaagtgctgggattacatgtgtgagctaccgcggccagccagttttgaccacttttaaaaatcattcctaaggctcagctaaatatttgccatgagacactccggcatcctattaataaattccttgttattatacttaagccagcattagtaggtttatattacttgcaacgaaatcatcctaattaatatatcctccttgcttaatttctgtggtcttgtctctagttgtccttctttcagatagcagaatgtgtagaagaggtatttcaaggtgctaggttaaaaaaaaaaaaaaaaacaagatagaacaagaacccaactaatttgaatagtggcagcattaagaacctatagtagccttttttctttccaaggattctcttgaattcgcttggattcttactctcattcttcttttgggagtttattccatcaatatgctcatttctctcttggatcttcctttttcctgtctacagttatctttctctgagctcacaaaaatactttctttgtttttgcctattctaaaatgaaaatttctcttgaggtttctaccctgccaaatatcataccatctcctcctttctcctgctgccaaatatcttataagagtaaaccataattgctaggttcacttactcattagcccctgggactctggcttccgacctccaactctggcctaaaattgtgtttccaaaaatcatcgaattcagggtcatctaatgttttttatttttctttatattctctagcatttaaaggcggtgaacatctgtttccattatttttcatgacactgcacattctactttctttccagtataatcttttctggtgcctctaatcatttttctactttcttttacttttcaaagtggacattctccaagattctattctaggtcctgctttctctatatactattttcttaaatttttgttttcttaagaatatagctacagagtagtggtcaaagcatgagctttttgccaaactgcctgtattcagtaccaaaaatgattttatgttgagtatacgttactagctgtgtgacattataaaagttacttaagctctctgtgtcttatctgcataatgtggataatcctttctcttatctagaatcattgcaatgattcaaacgttaacatatggaaaaaactcagctcagtgcctggtacattgtaaagatttagaaaatatcgattattattttgtgtggatcactgtctagattttccccaagttctcatctattactgagtgcccacaagctagctttctctggaagttctaccagaaaccataaacactgcaatctgggcttcttcagacttgcagtagaatcatgtggtggctctgatggaaattgtgaaatctctgaacattttgtggctcaagaaggtcaatggacttttagtagatcattaaacatataaaccttcccaagagcattctgaaaaaaaaaaaaagatcacatagtgtaactatgactttgtattccttgatttttcttgaagtcttccccgattaaaagtttaactacagccattacttttaacgctgagggtgcaactacagagcaagaggaaaattggctgggtgaaaaacatgcatgggaccagatatttttcaaaatgtcactatataataataattggcaaaagcttatatttattactatatcattatgcttttgccataaatttgactcaaaatagtttaagatgttgaaaaggtgatattttcttaaaaatattggagagaaggcagtatgataaatttaccaattacagatacaaaactgaatacaacatatgccttaaatatcttatgttgctttaaaaaaatttgtcattttccctttaatatagtcattaatagtgttgcagttattgattttggagcccatgctaataccttactatgaactctagctaataccatcctttagtcaacgtttttcttttgtgttggcgttgttaacatcagaaaggtgggtaacattgtcttctacttgggaacaatagcaagaaattagtgaccaatgttgcttccagggaaaggaaaaaattatggaacggaagtgaaaaggagatttttcaaggtcaatattttgattttttaaaaatttaaatgatatgagcatataacttatatacactaatttattatgtaataatacatgtatttatataaactaattaaattaaattaatcaaattaatttaactaatttaacatcatttcctggttattttactacattttactatgatcttaggttatttgtatatagtagtgcagtaataccattatatgttactgcgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttacaccttggcgaaaggcaaacactaaaattatctctctctctctctctttttctctctttttcctggagtactctttgttaaattttaccagcatatgactgcacataggcctgtgcatgtgagattattctgttataaatatggatattagaagacctcactggcctaacactttaggctaatgaacagacaatttcaggacacagatcttttttttataattgtttgtgaaacaatttggaaaactgctgaggattacaatccataataagctggtatccacatacattcttgccttctatagcttttgtatggtacagttgtatgacaccactgcatcaaaagggtggaaactcctgagccaggctgctttggttctaaatccagcctctgttactttgtgcttacttgacattgggcaaatgacttaatattctgcaggccagtttcgttatttgtaaaatggggacagtgaaaacaatttacctcatagggatttttaaaaattattatatatcaaatataatagggcctggcacaaagtgagccctacataattgctgtagaaagataaatacattttaagatgtaattgtcatactgtacgaatcacattatatagttcatttaggaattattcacatgaaagctttcactggaaaccttggctacttaaaattgattctactgtggccatgtatgtaaaagagtgtaacaaaggtcagattacttaataaaaactcataaaaatcagtaagtttttattttccacaaaaaatgaccaaaaagcctggattgattttgtggaaccatgtcaagaaaatagccagttaactgtaaaagattctttttttttttcttttgagatggagtctcactctgtcacccaggctgaagtgcagtggcgtgatttcagctcactgcaacctccacctcctgggttgaagcaattctcctggctcagcctccccagtagctgggactacaggcgcacaccaccatgcctgactaatttttgtatttttagtagagatggggtttcaccatgttggccaggctggaaaagattcttaaaattacaaaaatcttcatagccctatgccacatttttttttaacatagcttcttttttcttgtttttgctttatgctgctaaatctgataacccatgtattcaactcagtaggtagtttccgtcatatgctcggagtggtccctctctttcttgtcacagaccaatgttttgaaaaccaagaatgtcttcctgcctgagcaacaaaatctcctgggaagaatgaatcagttgtgttagaaataagagatggaaataagaatagaaattagaagtaagaggtttccttttccaattttccaaatgcacaaaaggtgtcccatacacttgtggaaaacaagatggcaggaggtagtttagtgcagggttaaggaaacagtatgtggggtcagactgcatggattctgcttcgacttaccagctgtgtgttcttggacggcgtctttaaacaactctgtgcctgagtttccacctctgaaaatgcagataagagcactcactcccttggtttgttgaagagattgagttacactctaagcctttagagcaacacctggtacacattaaataatcaataaatgagtactataataaccattattattgttattgattaacttgtttcattgtaccagtgcttcattgttattttggtcaggcatttctgatttcctatttcaatcagtagaccaaatttgttgcgaatttttatgaattttttatgaactggaagttttataaattttaaattttatggtagtcagaaagtagaatgtcaataaacatctaactttatagttttaaagatacttttttctacaatggtaccctctttgaaaagagaattttcataataattttgttttgcctttctagatgtagttactccaaacggcttgaatgttaagaaattttcagcagtgcatgagtttcaaaatctacatgccatgtacaaggccagaatccaagattttgttcgaggtcatttctatgggtatgattttctttattaaaaagaaaaagaagtatcagatatgagtgatctttggtagagagaaaacagaattgtaataataaatgtttatctttcccagccccctttgtacattaacagaattcatgtgtacattttgttactgttgctgtatttcatttgaaactgtttggttttgttttgttttagtcatctcgactttgatcttgaaaagactttgttccttttcattgctgggaggtatgagttttcaaacaaaggagctgacatcttcctagaatccttatccaggctaaatttcctgctgagggtaagaaagctctaggacatggtataacactcttgtagggagaactttcttctgtgggaagtgaagaattttttggcttcttaaatagttttcaagagaataaacgataatcgtattctaaaaatggcttcagcctttcaatttacatattggagttaccacactgttgacttgtgtgtttgtctataatgtcatcttttttttttttttttttggagaatcttaagcttatcccattatatgtctcattaagcttatccccttctatgttttaataagtcattataacatccctttcccctcacatgagtttgtaatcaattgaaaagtaaatatagagaaatccagtaaatgcagagcaaaatatcaattttcagaaaatcagtgaagactataatggaagatgtggcttatgcacatgacaatacgcatcctaatactgaaccttgttatgactcttagccatttaatcataggaagctctgaccatcactctcctctcccgactgaagcaggccttcagagtagcacgtgccacatagctggcagccaaacccgacagcatgaactctctatagaacagggcagacacatacacactcggttcactcacctccccagccacaccacctccctgcgactaagagtcttaaactcttgaactagtggatgtcacaccacatgaaagcatgaaggaggaaaaagaaggttcttactcccaaccatgtgaaatcattttttttactcaggaaggtgggatacaaagtgggttctcaactaaccgagcaatacaatatgcataaataaaagcaactataaaaaaagataccatgtcatagctattgatggcagctattggtttatattccaatcccatcacataaaaatgtagaataagtaataggaaaatattcacaggagaagagtgtagaatttcactcttaatgagataatgagaaaatctaaactttcctgagttctgtactaccctccagttaaatttttatttcttggacataaattttttgctttagagcagacattatgccaaatatgctaaaaaaatttactaaagccacgttaataagcaagcgattcattaataaaatccaactatgcaaaacagaactgaagactaaaaagattattcttaaataaccttacttaatatttcctagtatatattcattcaacaagctttataatggactcacaactatatcacatatacaatctttagggacattattaataaatgcatttatatagttattaaatattcactttatttatagatatgaagaaaagactgattactattatactagacataaaagataactgcaatacttggagaagttaaaagaaggaattctctttccacatagtacatttattttttgatagcaccttggctgttcctagggtgagtttcctattgtatgccttcagtagctttccctaataaaatgtcaggccctagagggccgaggctgcatactagacggtaaagtgccccacactctggagctagtcagtcatttccagaacacataaaccttcatagaggttcatgattttaagtgagtttatgctttcattcttacagcttcttaacaagtcatttccttttgagagatgctaagccagcagtttaaatgtcagctttggcactaacctgttataggactcagagaaaatatttaacctctcattcctttcttttgacattaataaaatgaggagagaaatgcctattgtacatgattattagtagtatatttaaagcacccagcacagtgtctgctatcccaaaagtgctcgtcatgtgcttgtttctttgctttagggctaaaaaccaaaatacaacatcatgagaatcaagacatttagcggaaaagtaaaaataatctatctgtcatcaatcaacatgaataagcaaaaaaattgaaatattattttagcttttaccaaagcttaaatcttcattaaacttccaatctgaaattttaaagaactaattttggtcttttaatattagctctcattcatgctatttttttaaccacagaaaagcacagtgtcatcaatagcaattgttatctattctagatggtcaaaggcacgaaaatattttgtttgaattttcaaattgttaactgacaaatactgattgaaagtcaatttgttcattggcaagtacagactgaaaatttaaaatttattttgattttaattaaaatttctgaaaaagtctcaggaaggtgaatataatctctctgtgaaacataaataactataccttttatctactgatattttaaaactctacttttcaatgtttaagttccatctatcatactttttaaaaatctttgatagttgactctgtgttttctaattcctcatcagatgcataaaagtgacatcacagtggtggtgtttttcattatgcctgccaagacaaataatttcaacgtggaaaccctgaaaggacaagcagtgcgaaaacagctgtggtaatctcacaacctgtgaatgttctctagcaataaatgtgaaaagatttcttttaagtgaatgacatctcatgtatcgccttgaactttgttttttccttaagattattacagacaaataatacttgactctcttttcatcgtgctactattttaggttatcgtaatgtttataacattataggtgttatacaaattttggaatgagctaccattgaaggaacaaggccctgtagaaatctttaaagatgagtcaaacatttttaaactttctattgtgaaattctaagaacatgtcaagtaaaaagcttagtaatatgactccctgtatactcatagttcagattcaacaatgatcaacgaattcccgtcttgttacacctatacctccatctactccccctctctgctctctatcctgttgcaatcatcatgaagcaaaaaaattttaagctctttgtgctggccatggtgttctgttgcctcagctctggagatgtcaacttaagctgaattggcaagtagtaaaataatagaagagactataaaaaagatacctgtaatttcaaagaatgtcaacaaaaacaatagcattatcgtgacaaataaagattaaacattgtcatactgtttaaatgataaatctttctgtttcaaacagggatgttgcacattctgtgaaggaaaagtttggaaaaaaactctatgatgcattattaaggtaggtgcttaaaatgctttctacttcaatcacttaaggcttcactattcaaatttaacaatttagacatcataacttattaattttgttccaaatatcaaggaattaataacctttgaaaatgtgttatgtcatgtgaacagtattttacccttcatttgacaaaacttgtaaatagctgtacaaataagaatacatttatatgcaggcaagttctaattcaatgatgaactcattaagggttgatatgtcaatctgaagctgagagagacttcatgagattttaattcaaaatatatattgacaatgtgtattaaatatgtacttaaatattaagtctatgtgaacacatttacttaatagaataatcaacattatttattaaaatacatgaaatatataatatataatctgatgcttaggaatcactgaattagtgccagctgtttttatttttgttattaacattttttccctgcagaggagaaattcctgacctgaacgatattttagatcgagatgatctaacaattatgaaaagagccatcttttcaactcaggtaataaggaaaaaagcacccactatgtcccatagttattaaattctatctaatcagtattttaatttattggaatgtgctaatttggaacattttcagacctgaggctagaaaagacattcttacatagtcacttaaatgattactttggacattttttcattagtggttttaagagctcctttaaaacatctcatgaaacttgtccttccacttgcttacaaaattatttttgaattaatatattcaatataaaaattatgtatagtttagtaactacaaaaaagtcctaaatacttccaaaacatagaatttgagtcacattagagaaaagaatatttcttagtcgagtggaattattacaaaggagataaaacaaatgtgtcaggcttgcatcagaatgcttgttataatagggaagaatcagatactggaggacagccttgctaaaagaaatcagtaaagttcatcttaagtcaagacttcaggacacctttatattccaaataagtcccggaagcaatcaagaagtccaggtctctcatatagtagctgcaggcggaaaacaaaagcttcatgtattcatagcatgcaaaggagattcttcaacccatatcttcctttgacacacacacaagacttagtcatcatcattagtgccatctcaaaagactgaaggtgtgaaggttggatgaaatgtcaatgacctattgttgaaattagtcacccttattaattctttccgcaattgatatttccttccctctcatacttcagcgacagtcattgcccccagtgaccacgcacaacatgattgatgactccaccgaccccatcctcagcaccattagacggattggacttttcaacaaccgcacagatagagtcaaggtagaacaaattgttcatgtggcgaactttaaacttacttaaaatatattttctgagaatttattagctttccttagttgtttttacatctacaagaaatattttaagtattttaaaggaaaattggttcagtttcttgtcttggataactaaagtataatgaatattttggtataattcttgaaaattgaagcatattcatcgctttgagctataattctagcatttatttccactgtacaatactgctaataagcataaggaaattacttacttttttgtttcttttttttctttttttgagatggagtcttgctctgtcgcccaggctggagtgcagtggcgctatctcggctcactgcaagctccgcctcccgggttcacgccattctcctgcctcagcctcccgagtagctgggactacaggcgcccgcaaccatgcccggctaattttttgtatttttagtagagacggggtttcaccatgtaagccaggatggtctcgatctcctgacctcgtgatccacccgcctcggcctcccaaagtgctgggattacaggcgtgagccaccgcgcccggccagaaattacttactttttaatgataccaattattctaagaattatttgaatgaaagaatcgttgatattaacatggatagtgtttgtttctttctaataaagttcaacttaaggggataatatgaggaacttccagtttcagagaatgtggctgataatgtttttataaaattttctatagagcaattcattcttttgacttgagtttccacaatgactaggcacaatgttacttgctgagggcatttatatgaataagagctggtttcttccactgtggaccttaaactatatgatgtttactgagggcctgctgtattccaggcatggttttggatattgaggcaaagatgaacatgcaaacagataattgcttacctctactaagctccatccactaatgttcaagatcaaatagccacaatgaatcttttcaaatgaacccattttcacttctttctttcatttttagcagatgacctaattgataattaaataaattatgaactccttcagtgtcccccccatgctggccccaaatgtagattttgacctatccttacattttttccttcaggttcttacaactattctaagatttcaatccccacattcttaggaaacttgccttatcttttttccttctgttgtattgtacatttcattcttatcactagcttcttctcttgctatctataaatattccttaaatttctccatgttaaaaaaatcaaacaaataaatttggccttcaccctctttccctttgatgtttttacaaaaccatgggagagacggttgcatgtagaaaaggtcatccttagtgactgatggatactgggagtaagaaagagggaaaattcaagaataatagcctcttggctttagtatttaaccaatgcttcctaaaaatcaaaacaagtctttcgcacaaactggtttgaggatcatgtcatgaactgagttcggtttctgattaattgagtttgagttacatgtgagatatagaacttgagatgtttaatgggcactgagaaaacataggcctggagcttatgagggcaaccttgaaggagagacattggtgcatgggcagcagtggacatcaatgaatgatgaccctgacacactcaaaaccaggttgagggctgggtgcggtgcttcacacctataattccagccctttgggaggttgcggtaggtggatcgcttgaggccaggagttcaagaccagcctgggcaacatggtgaaaccctgtctctacaaaaaatacaaagaaattagccaggtgtggtggtacacgcctgtagtaccagctactagggaggcataagtgggaggattgcttgggccctggaggtagaggctgcgattgtgccactgccctccagcatgggtgacagagtgagactccgcctcacaaaaaacacaaaaacaaaaattaaaaagactaggttgaatgagtagagaaaaatgtcaatccaaggaaacttcaagatttaagagaaaattagaggaagaaaagtcagggaaagaaagagcagaaaataaaaagaaaaatatttcagaaattgaggtaggagaaactttcttaattgtaggaagacctcatgatacagcattaagtaacacaagcagtttataaaatgttccatgctgtggaacatttatatcaaacatatccacatgcacatagatggccctaggccatagaattgttactgagatgccatgtttttgatctgggtccccttgctggtggggcagaaagccagttactgagaaaatgagtattgccagggaagaaggctttttcgggtgctgcagcctaggagaatgagagatcagcctcatactcatctccccatctgactaaaattgggggatttatataaacagggaaggaatgtaaaacaggaattaggaaaggataaagaagcaatcatgaggaatgaggggtctggcatctcattgtctggatgtgatgatctggtgagcttcagtcccttacctgaagatcagtttcctaagggaggaactcagatgagacaaatgtaaatttcaagttttaagatcagaagtgtcaatttctatgtttatttaaaaaccagtaagtattatttctataggactatggggcccctttcattataagtggtttttattttttcatttgtgtttctgtatttctgaaatatctacacctagcacacctcctataataagtgagctacatccctgggaatgcaggaatgtatccatcaaagtgaaaataatactaagggacagaaataatttctaagagatagaaaaatctatcccttagattttttagtattattatatccacagagacttatacttcattgcagagtatgtcagtactaactaggcctcattctcatatagtttaacctaagctggtctttctgtctctgtctcctggaaaggaaatagtagaggcagggaaagtttatttccctgtagacttctgtttttctcagaacattttgtgtcacacttttatctaaatctataggtctttttctgaggatctgtctgctgcctggcacatgttacgtacaatacatgcagacagaagggagggatgagggaaagtgggaaaaggagggatgggtcatgcagctggcaatagttcatgcttcccttggccttgggaagactgaggctggaaggttcattgaaattggacgctctaaatgaagaatgccttgctgatccgtgttttaaaagtgttttgcatcagtgaaacaattttccaggaatggaaaagtaccttatttcctaaacatacgtaacacttacatacctctgtgtccttcctgatgttatcatctcttctgaaatactcttatctgttattctaacaattcttctgggttccaacctaaaagtcgttatttccttgcacctttccctaacacacattcctctactccagacaggaacggttgtttccttatctgtattctcgagacactttatatctgctataattataggagtgattacaataaattgtgtttttaaaaatgttatgtgtccatttttctagaataactcagttatttgaggcagcaatcattctcatatgtattgtctctgtttaggttctctgagaagcagacaccaaggtgagattagatatgcgaaggactaattagagaaagccctgtgaaggatgaaggggtcgaaagcaagtacaggcagggagatgcaggtcatgcaggtcaatatacccatgaggagagagcaggaaggaaggatgatgtaggaagaaccacagactgcagcccagatttaaaaatgcctcagtctgtccttcctccctccctccctccttccctgcctctctccttcccttcctcacttccttccttccttgctcacttccttccttcctcacttccttttttccttcaccccctccttccttccttcttccttccttcctcgcttccttccttccttccattcttctttccttcctagaaaggaaagtcaatgtatttaataaaaaaacaagaattaataaaaattggctaatatacaaaaaatatacacacagcagcagcacttgtgcctcacacaggggaaaagcagtggtcgaagaccactcaacatggcttttcagttaatggaagagaaaaaggaatacatacatatacatgtacacagacaaataggaaaaatagttttcgatagtgtaatctacagctaacacaaattcagaactattttacagtgcttcatttcttaatacaaaagaagcctattttatgtgtgtgtgtgtgtgtgttatatgtgtgtataaattggtttactgttaacttattttaaatatattagtgttaatgttactacataccactttttcctgtattcagcaacctttccattctgttttacctttatatgtacctcccacttaccagaatagtttcagattggcagacagataggtgtctgattctatgagcaattgaatatggattcctattaatagggatagggattccccaaacaaaaattgcccattaaaggcacctgttgggcagaaatgacttcacactggtaccagtttctgccagtcctgtaagttaggagcagctgctgcaatagatccagagggaaggcaattggtgctgtcagtcaagattcctggggctaagatctctagaagtaaagctgagctatatttccagggttggcagatctataaagaaggcagcagactaagtccatgaagactgtatttaaatccctgacacttatcaattttgtaaattcacttaatctctctgcacttcagtcttctcatctgtgaatggtcataaaataaccccacactcatagaactgtaaggattaaattagacataggccaagcgcagtggctcctgtctgtaatcccagttactcagaagactgaggcggggggatcacttgaggccaggagtttgaggatgcaatgacctatgaatgtgccactgcactctagcctgagcgacagagtgggaccccatctcaaaaagaattcataaataggtgctgcatttaacagcttggcacatagtaaatacataataagtattagcttcttttagttcttagcccagaatctgacacatgattggaactcattatttttaggagagatgtgaatagggtttggtgagaggtgaagaaagcggatttatcttctcctgcaggatttggtaagacgttttataaaagagatgacgtgttagctagatcttgattaatgatctggaatttgtcatgcaaataacaggaaaggggactcaccaggcagagaaaaaaagtagaggagaaggcacagagatatcaaagcacatgactttcatagggtgagtggagatgaaagtttgtctcataatttatgtctacacagttaaaatgaatattttgagatgctcatttattatcataaggcagccacagacacacacacaaaataaatgtacagcaccttcctgacatttgctacatactcaaagcactgagagaaactcccatcaatgcagaattaggtattatattttattaacaattcttcaaaaatttggcaataacttaggcctgtgctgatttaagtgcctatttaatcacctgcttaaagaactgtgtagaatggttctaaactctcagagtgcattgataagtttttgatatgaatgtcatatttgattcagcaaacattgcagatcattttgaatttgaatttatttatcattttgccttagctacgtagtgtggtgaggaaagcccaggctgaagatttcatgtctcagctctgggctgccacggtgtaaaaataaactaacttcctgagaccttacttctgtcctggaataaataaagagtcagacaagcctttgtctctgtttcttgttttgtttttcctactgatctaggtagggtctgctgtgagccaggagctttcctgggcgctttttgtacaggatctcatttaatcctctttataaccttcagctgacctctaatatcccttcctcatccctgggcttctgcaattggctggtttagagccagagcagctgttttcttattttagttatgctgtcattctgtttggctgggagcaaaacaaatgaaccatggtgttttcatgttccaaaatgggctttggagagggcaacttttcctaagcttggaaacgctaaagtagacacaatgcttttcaaatccccctttcttgttctttgccaagagagtacaacgggttgccagtttgatgattgcccagatacagtatctgtgtcttttgtctttttttgtagtgagctactttgcacataataggaactcaaatcatgttctatgaatgaaaatattgtattcacttttactttgccattttttaatttctgtgattgaattcttaagtactggggtttgcatatcattttattcttaagtttaacttatctcttacttatggatctgctgagatataattaatgtttgtaatgtccttgaggatccaaggggtaaatctctccaataaaacaaagacttcagactttttttttttactttaatccttggcatatgataagattataaagtgataaaatcaatttaaaattgataattcaacagccctctttatgtcttatcttctttaccaattgcacaaggtcactaagattaaatgaggtaatatgtatatttatagtatataaaatgttatacaatataatgataattgttacatacccaagttagggtttttcttcaaagtaatctcttctgaagaatgcatacttattatttcgtgaataaacatgaaaagtgtctattctcactcataggtgggaattgaacaatgagatcatatggacacaggaaggggaacatcacactctggggactgttgtgggggtggggggaggggggagggatagcattgggagatatacctaatgctagataacgagttagtgggtgcagcacaccagcatggcacatgtatacgtatgtaactaacctgcacaatgtgcacatgtaccctaaaacttaaagtataataaaaaaaaaatttttaaaaaaagaaaagtgtagagtgcttgtgtaaaaatagtttgtcttctttctctctctctctgtttttgaaatggagtctcgctctgtcgcccaggctggagtgcagtggcacgatctccgttcactgcaacctctgcctcccaggttcaaggcgattctcctgctccaacctcctgagtagctgggactacaggtgcatgccaccacacccagctgatttttgtatttttagtggagatggggtttcatcatgttggccaggctggtcttgaactcctgacctcaggtgatctacctgcctcagcctcccaaagtgctgggattacagcagtgagccacggcacccggcctgtctcctttttctttgtctttccttttccttccagaacaattcagttctaaagccatttggtgggcaacataaggtaggtatctgcactagaacagggagggtgctgtggaagtccagagaaaggcatcagagtccaagcagtttgagaaatgtctacacaaagaggagcagcctaaagcagtgtcagagccagaatggagagaggagggcatccgtgcatgtgagggagtgtatggagaaagattagttacacagaagaagattgacccaatatgtagcaaattaaaggtagcaaaaaccaggggtgtgtgtgtgtgtgtgtgtgtgtgtgtgttctttctgtctactcagagcacttgggggaagtaataggccaatgacaatgagcacacctagtagccacgtcttgattgctaaatgccatttgctactaaagggaaccagggctgcctttagaattggctgattttagaactgtgacaggtaaagtacaagttgagcctggaacttcttgtgtcaaaaatcaaagaaatgctcaaggaacaatgaagttttgttaaatatatacagaaacaaacttgaaggagctcccactggccaaatcatggacaatttgagtgtcaaaataaataaagatagtaaggaattaggatgcattgaatgacataaggaatcagaagtccaatacaaatattaattaaaagtttaattaggaatgagagatttacacagcttccaaataactgcctcaatacttgttaataacaaagagtaaaaagaataactttatagtggagaagccaaaaagtcttggccttaatcaagagatcaaaataaacatcatcattaatgaaaaaaatagaaaacctttaccacctgattaaaatgcaatgaaaagaacacagcaccacttctgtgatatatctgccaaagatgtgtgaactaaatctaattatgaagaagcgtaagacaaacccgcattgagggacatacatcaaaataaatatagtcttcaaaaataccaaagtcagaaaagccaaaaaagcccatgaactcttccaaattgaaggactctaaagcgatgtgacaactaaatgtaatatgtaattctgaactggatcctttggtttaaaaatcactatttgaatcatcagaaacacttaaatggggtttaagaattatacggtagtgatgcatcaatgttaatttcctgacttttatgtttgtgtaagattatgtaagaatgctcttgtttgtgtatttcccacagtacagtttatgaatggttctgaaaatatatgaattctcttcatattgtacttggaactttctgtaaatgtgggattcccagtacttttatatcagatgtcacttattttcaataaccccttaggtatgggtgaggctgagagataatctaataatagctcagtgataactgtagtaagtgggagaaataggataattcattcacagagttagcaagttaaatagctattctagtcacaactttccaattatagccatgctcttgtcattagtaatattttgtgccactcacattgtaatggctacaggtacaacacattttaaggctaaacctgaactattaatatttttccattactttcttgagtccagaaatcaatacacagtaaatcaagccatgatttgtagtatatgcctattttcattctatgaaaactctcactgccaccaaggccattgtcaagctaccaatgcgatgtcactgaattaagagaaaatagtaggaaatagaaggagaaaatagcatgttgggcaaaatacgtgccccccaccaaaaaaaagcgctgggaaaaatagcacattgtgcaaattaattgactatatagaattgacaatatggagtactgtatatatacatttttaatagactttatttttagaacagttttaggttcacagcaaaattgaacagaaagtacagaatatcgatgctcttgtttctgcgtttccagtgtgggcccagaactggctcatacaagtgcacaagagccagtagttaaatgttcagaagctttgtgaaccagttttaaatacagctattgctaaaattaaattatataaattttaaaataagtcaactatattaaatgaaaggtagttctcaaaattcatcacatcctaattatttacttcatattactatgacctatgcagttgagactctatgtctgtcagatcttcgtggtgcaaatgctttataatgatgtgctactgctttccctgtctctgaattcggcaacatcatattggtagcttaaaaatggccttggtggtagtgggagtatttatagaatgaaaataggcaaacactacgaatcatggcttcatttactgcgtattgatttctggatctgtaacctgtacattgtgagtggcaaaaaaaaaattttctccatgttcaaaaactaatatctgacccagcaaagaagtcacttgcattactgatgaactcatgaagttccaacaaatgtctctgttatttccgctccttctactcattaacaaaggaaatcaaccaacatttatgtcagagctatattcagccatcaattgaaaccataaattggttatgaatacaaaattttggaaaaataaaaatagcaaattgtgagaattaattgactatatagaattcacaataaggagtattgtatatatccacttttaatagagtttgctttttagaacagttttaggttcacagaaaaattgaacagaaagtacagtgtccatttgctctctggcccttcccatgcatagactcccccattatcagcatcccccaaagtggtatatttgttccagtagatgaacctacattggcacataattaccacccaagatccatagtttacattaggattcactcttggtgttatacattctatgggttttgacaaatgtattcatcatcatagtatgatacagaatagtttcactgccctaaaaattgtctatactctgcccactcatccctccctcacccctgacgcctggaaaccacagatcttttcactggttccatagtttaactttttcaagattgtcacacagttgaaatcatacatcatgtagtattttcagatgagcttctttcacttagtagtatgcatttatgtttcctctatttattttcatggcttgatagctcatttctttttagcactaaataatattccattgtctggatgtaccacaatttatgtattcattcacctactgaaggacatctgtgttgcttccaagttttggcaattaggaataaagttgttataaacatctacatgttataacatcttttgtcatttggtaactgtatatacatcatttatctcattaaaaattacaacaaatttaagtattaatatatatttatacttcagtgtctcagttcttaaatatttaccagcataccactgcttagaagccatggtaaacactttggcttttactctgagtaaaatgggaagccactgaacaactttgagcaagggaatgactgacatttttaaaggatcaatctagttgtgttgaatagagaccccagtgggacagaaagaagcaggcaagtatgttaggaggtgatggtctctagctgagagaggagggaggtttgcacgaagtcctctagcatgatttaatctagatggcattcctagaacatcttccctgtcccttagttccatttcagttgaataactcatgcttaaggcatgtaagagtggtctgttacacagccccctcttccctgctcaagttgggaacaaatagataaaaagacaagagcaattagataaccaaatataaggtttattgcatgtcaaagctggactggaggatatagtttagtgtgagagcaaaaatgagcactctaactccttatccttcaacctaagccttggaacctgagggaaagttaaatatgcagcatagacacttctacagaatggagagaggagaacaaaccaccacggcttttttctttttcttttgtcttatctctttttttctttctgaatctagaacataaggattctatagtagagtactgaaataaccaaattgtaggagatttttcactttacttgctcctttttctttttttttaaattagaattttccttttttaggtgattttgcacccagagtttctatcctccaccagtcccttactacccatggactatgaagagtttgttagaggttgtcatcttggagtatttccatcatactatgaaccctggggttatactccaggtatgtgtcatgtatagagtgtggaatgttttgaattttgttagtatattattttatgtgcatatatataatattcaaagttgatattaaatttctaataagatttcaattcttcagttttaaaaaattttggttggatttatcacagggattaatttatggtttgtagataattacttaagaataaggatgaagattatataagtataccacggtttgggcatattttaggaggtatgtgaggtattgcctcattgaattccaaagaaaaaggaatgtgatataaaggttgtatcttatttagctatctctatctgccccatttattagtgtgaaggagaaattgactgtaagtaggattaatataataaataatagtctagcaatgttgttctttaaaaattattttagaataattctttttaaaatttaatgaacatatttaatatgtaatgggtaacacagtcatatggttagggaaataaatataaaaaggtgtacagtgaaaagtcttcttcacattcttgtgcctcaaaataaaaggtactaagagagattagcaattcagtggtattgtcaacaatgacatcattccattcagaaactcctccttcttcaccctcctttgttattttattttattttattttttaacagatggtagtttctcaggtttactatgtatttttcttttctggaccgaactggcatggttgccattagcatcaagagcgaccaatttgtacttgtactgaaatgtctaattaaaagggaaacaaatactttaaatacatgccaatgcaaagaatacaacaataacttttccatctcttattaataatcagatatttttctgcccaatgtaaataaagtttcacttgtgattttattattatttctttgagacggagtctcactctgtcacccaggctggagtgcagtggcatgatcttggctcactgcaaccttcgcctcctgggttcaagagattctcgtgcctcagcctctcgagtagctgggattacaggcacacaccaccacgcctggctaatttttgtgtttttagtagagacaggtttcatcatgttggccaggctggtctcaaactgttggcctcaactgatccacctgccttggctccccaaagtggtgggattatagacgtgagccatcacacccggcctcttcacttgtgacttttaaaaagttcagaaaacatttttatttataattgagatagtaaatgttgccttttgtatctcaatgttatcattgatataaagctcaagtaaggagcagcagaggccaaggtgagagggaataataggctgaattatgaagaggaagaattttttctattatttgcatctttatcctagaattaaaatacagaatttaaaagtctacaaaaataggatcctgtattatttacagcaggaacaacatgagggctgggcatgtttggtcataaggtcctattctattgttctagcttcaccaagcataatttgccagcagctataaaaactttaaaatttcttggggaaaatagacaaaggattgtcttgaaacatgacataggaaatatttgtatctaactcttccgggtatctctcttgcagatctaaaagtggcctacttttgtgaaggtggtgtcttcttacttaggaaatgtccacataaatatctcaaattgcttgcaatgcactatcttttgagatacataaagcacacgtttcactgatgaacttaacactttgtttttgaccttgttcttattatttctagtaaaacaatttactattggaagtatcatggatagaagagtatacaaccaaatgcatgagtgactgaggcaatgtgggaagtcctttctgtcgggtcaagaaaatgttatagaactaacagctgactgtccaccaaagtgtcattttatagggcaaagttaaacttaacaacccaaaatgatagaggagatatatctactgttttaagataaaggccaaagaagatgttacaaaggatattataaatagacaaataagggagtttgtggaagagtccatagtgaatgagtcatgctgtgttttacattaaccaaagggagctggtcactcttcccctaacctatagttacaggaagaatgcgacttctggtggtatacatttaacattagcatattagataacttgctaatgtttttagaataatctttttacgtgttactagacttaactcactctagaaagcattcatccaaatgtgttttcagagagccaaataaatataagcatttatttcattaaattaattcaatgaacatatactaaacttcatgggtgcctggaatattactacatagtgaattgatggccatttaataaacatgaaggatctgtgaactttcacggcattgtagacaaaattttgtatacatatgtgtataagaatatttctcttcatcatcctcagcaaactaacacaggaacagaaaaccaaacactgcatgttctcactcataagtgggagttgaacaatgagaacacatggacacagggaggggaacatcacacatcggggcctgtcgggttgtggggcgaggtgagggagagcattaggacaaatacctaatgcatgcagggcttaaaacctagacgatgggttgataggtgcagcaaaccaccatagcacatgtatacctatgtaacgaacctgcacgttcagcacatgtgtcccagaacttaaagtaaaattttttaaaaaagaaaataagagatactctccaactcccaactcccatagaaggtggagctgagtccaggaggaagactgaggaaataaaagtgtgtaaaaattaaaaaaagaagaatatttctggagaggagttccaaaatgttcatcagactctcaaaagggctgatagtccccatcccactttcctcctctgcaccacccaccactaaaattagagaaccacaactccacagctatacagctaaaccaagaggaaacatttgcagagcaagagataaggttgctgtctagattgtattacttcatgggtaatgggaagatctttttttcatccaactccactcaccaaccaagggtaattccattatcaaatataaattcctaaaaatgtagacatccttgagactagtaaaatttttaagacatatcagttatttcctggaaaacagattttgattaaaaggtgagggaggactgcaagagatcatccatttattgagctcctgagagagtggaaggaatatgtgccaagggagatttaaatgggggaagaagctggtcgcatccaaaacatatttaacctacctcataaacttgccaagtacttagaaacacaggctagaaagaagcaagaaacaaaaccagctgggattgaagctgcagtggagcccggcagttccgcacaagggttctgcagccgggtgcctgacttcaaatcccagctataccacgaaccctggctttgtgaaggtgggaaagttattaatttctctgtgcctcatttcttcagctgtaagatggggataatgatggccccacttcacagggttgttgagagattaaataagttagtgagacatgtaaagagtttagtgttgtgactgacacatagtgaacattgctattcttaggaggactagggccttttcctcctctgagtgcatacaaggatataggcgctggtctgaagccaagctttggtctatttcccctggcagctgaatgcactgtgatgggtatccccagtgtgaccacgaatctctccgggtttggctgtttcatgcaggagcacgtggctgatcctactgcttacggtgagggttttcatcattaacccatgctggggagacatgacctctaaccaaacaaagcacagggtctttacagagcctaactctaaagctatcctgataattaaactaatgtttttatatttcttgtttaattaaaagtcaatttaggctgggcacagtggctcatgcctgtaatcccagcactttgggaggccgaggtgggtggatcacttgaggtcaggggttcgagaccagcatggccaacacggcaaaatcccatctctactaaaaatacaaaaaaattagccaagtatggtggtgcacgcctgtaattccagctactccagaggctgaggcactataatcacttgaacctgggaggcggaggaggcagtgagctgagatcgtgccactgcacacctgcctgggtgacagagcctcaggctgtctcataaaaaaaaaaagtagatttataaatagaattctgtcctttgcagcaacatggacgcagctggaggtcattatcttaagtgaattaatgcgggaacagataaccaaatactgcatgttcccacttataagtgggagctaaacattgaatacacatagacacaaagatgggaacaatagacatctggggactgcttgagtggggagtgggggaaggggcgtgggttgaaagactacctaccaggcactatgttaatcacctgggcgatgggatcatttgtacaccaagcctcagcagtatgaaatgtacccatctaacaaatgtgcacatgtaccccctgaacctaaactaaaagtggagaaaaaaaagtagctttaaatatgtggcccacagataacataagaatgctattaatattaatatattgcccatgagacaaactgcaaaaagagtgcaaaacttggacaaactttgtcctttacctttttcctccctgaattttgatcccttctgctgcctagaaatgatatgacaataaccatggtcttagagtgcatatattggtcattagatagtacatatattattattattgttatcattactgttattattttaaaggcccgtgacaacttagcaaagttcacctaaattgtttaagatggcagaataatttgcataccattatctgtctgttcatattccctagcagcaagaaaagttaaaatgggatatattgtctgccaatacattgccatttccctgggttttttgtttttttttttttttttttttttggaaacatggtctcactctgttgcccaggctggagtgcagtggcctgatcctggctcactgcagtctccacatttctggctcaggtgattctcctgccccaacctcccgagtagctggggctacaggcgcacaccaccacacctggctaaattttgtatgtagagatgggatttccccaggttgcccaggttggtcttgaactcctgggctcaaggaatccacccacctctgcctcccaaactgctgggattacaggtgtgagctaccaagccctggccttccctcagtcttttatgggtgtactgtggctctttcctcaggctagatctggggttttcagcctcggctgaacagtgggaacactggggaacataaaaggcacagatatccaggccccgccctggaaattctggttagtgagcaaccccatggaggatcactgatccagcgtatccctagactgccagagtttttttcagcaagatccacttcgttggctgtgtgtcagtgatggttgtaaaccattagaagggaattagggcctcagaaaagaataaagtgggggtaattcctgagtcagggggtagataatgcataggtttttgatggaaccaaagagttagtaaatcacaggagaacaaatgtttaaggttagtcctacttttacttgtgctttggcttttgtgttcttcaggtatttacatcgttgacaggcggttccgttctccagatgattcttgcaatcagctgactaagtttctctatggattttgcaaacagtcacgccgccaaaggattatccagaggaacagaactgagaggctctcagatcttctggattggagatacttaggcagagtaagcaagtttagataaacacagcagaccacttaaaaaattccactggactataaacatattgattctagtcataatctctaaagttaatccaatattataattgttaaaatctcagtgtctccatgtactttttaaaatttaataagtttacaaagtcctatatgtatttcttcatgtttcgtttgagtctattcataatagcaagtccatcaggatctagcactgatcttactagctattccattgtcagtgcctcacttgatgtgttactggtataaggaaacattttatgaagttgaagaaaacatcaagagaaaagtccctactttgtttctctctagagaaatagtgtagtcatatttctcaactgtagtgagtaatgggtataatatggtttttcaaaatgatgactacaggaaatacctcctttcagtcatgcaataggtttataaacacctggatgctcacacagcttagcagtggtgatttaataataaatgaattgactttgccttcacataatgtgtctgtttgcacagtgctgaacactcttggctgaatgagagatgctgccatttgctgagtatctgcacacacaaatgccagtgctcattacaacctggatgattaattttactatctccatcttgcaatgaagatagatacactaggcttttagaagtgatgtttcttgcctaaggtctgaagcaggatttacacccaatttatctgaatattcaggccctatcttttctccatgccacactgcttctctgtggaatgaaaccagtgttttcagtcaccttaatgctcaattcagagctcaatatgaccagtatgggcattcttccccagcattttatagtattactctgcctatgggttgaaaaatagtaaaactataaactgtaatttctttcctgagtctcaaacttagactgcatagattctgtcactttaaaaaatacatatgtttcagaactaggagaataaggccttatttaataacttgattattgagatatctaagggtttttattaacctgtgatttggctttctatcaatagtattaccagcatgccagacacctgacattaagcagagcttttccagataaattccatgtggaactaacatcaccaccaacggtaaatattcaatgtatttttttttgaaagctatatttctttttataagtttaaataatacatttaaatttggaagtagctatgcacacaagctatgatactttttcataatgttgaatcaaaccaaaggagagagagaggaactcacaaatcagactgtcctaaagctctcaagacagttaattcatctcattggagaagcatctctgaattaaaactttctctgccttaatgcttgaaatggttctgatggacatttattctttggggagttgttcaaaaacaaactggactgctttaattgaaagtgaatttgctctccaaggaagtgtttaaatatagggtgaccgcttggcaagagtaaaatagagtaagttcagcaccccaggaggaattgaactagatgagcatttatggtccattcatcagtgcccaccagggtgtcttcttctaaaatccaactagacgtttatgttcataagactgctataggccacatttgtcatcagattcacttagcagggagaagacatgaggtgccacttgaagcaggggagcgtcaggcatttctctttagtgggatcagtccttgcagtagtctacacagcaatccaagagctaaacatctttggccgcctacacactaggtgacagcttaggtgcaagaagataagacccataccattgcaaatgagatcaccttagcttagtagctgcatgccccacaggagcctctatctcatgtaaatctccgcaaaccagctttcatgctccctgcaaggaatatgcccaattatgagtcatcttataagagtcattcagagattcccaaaaactctggcgccttatcaagtatttatagatttttcagttcagatataatttctcaatcaggggtcactgttaccataaacaaccatccctaataacatgacttatattccacctatatcaggtttccagaggaacagatctagaaagttaacctgaagtaaaatttgcccgtaaaaaaggtgataaggttttcttaaaccctcaggctacaaattctgactttcatgtttatgattctagcattcagagttgattgcttagcttattcagaggtggtcattccacttaatgataattcagcaatattcatccatttatctgcttatctacttatttatccagttattacgtctaataagcattgagcacctacttcaagctaggtctcaagtgcagaactcagttcttttgttgtattgctgacaggtaaagtatctgaaccttaaaatgactgtacatgtatgacatgatataatgtataaagtaattgaaatacagagtgacgagcgctataacacttttacacatctgtctccccattcaattatatgcactccaatcatgttttttcatctggtttctttagtggcattgcagtgtgtgtttatcaaataagttatctcagtatctcaagtagaagggcaaattaattaaagtctagtgatattttctcattaactgaaataacagcaactagtggaattgtagagtcaattaagtgacctgacttccaggatgccttctagtggtggccatccatggcatttccaggctatccacatccaaaagctttgctgaacaaatttgagacttagagactaacagtatcagcagtgtaaggtggcagttgacattaaagtttctggagtcatcacagacctggtacaaatctttgctctaccatttatgtgctgagtgatgttgggcaagttacttgacccctctaaccctccattttcttctgtactgaaaaaaacatagttatcagagtgttgttaaaagataagatgataataatatgtatataacacttagcacatttcagtacttaataaagaatagctatatattgaatgaatccctcttgagattggtggtatcaaaatcaaaatgaatcaaagtttaatagcacccagactacaaaagatagataactacttaaaaaattgatagtgcatgcatagtatttacatcgttgaaagccaagaaactgttgtgatgtttatgtcttatttttgtctttggcagacagaaggatttaaatatcccaggccttcctcagtaccaccttctccttcagggtctcaggcctccagtcctcagagcagtgatgtggaagatgaagtggaggatgagagatacgatgaggaagaggaggctgaaagggatcggttaaatatcaagtcaccattttcactgagccacgttcctcatgggaagaaaaagctgcatggtgaatataagaactgaattctacatgtgctgcatgaagagctaatttaaaaaagcaaagtaagactaattatttaaaataaaaatgccacaaatttcattttctccttctaagtattacaatggagtttattctctgcctaaaaagtggaagaaattgagtgaatgacaattttgtaatttaggataagatccaagttattttccccaactcttgtttcccccataaagttaggcatgaggaggagcactcattaaaggcagaagacggaaaagtgtttttaaaatggtgaatttaagtggtaaggattttctcttactctgtttatttttaaatgatcatcataatcctttgcttactatttatgcagcttctctaccccaccacacaaatttcccatttcccccccgaaaaccttgatcttacccatgaatgtgcactacctacattttttaaatagctaggtttttactgattattttcatttttcacatgcatcagaaccatgatttagatgtagttttgcagagacaaaaatccatgagtgaatagctatcctaagtccatattttgatgcatattaatggacatttatgtcacttttgaaatctagaattgatgttgtaattaatgcaagatattaccatgtacatggtaccaccatcttactgtaacatttttctattgtttaaatagaaagcctttttaaaatttggtcaatcttcatagatgataacttgtaaaatccaagtaaataaacacattaatatttaataacttaactttcactggtaatgccttgtttcttcatagatgataagttgttaaatccaagtaaataaacacattaatattgaataacaactttcactgataatgccttctttaaaaattgtttagacattcgaataacatgtgggaagcagctgttatgaataattcctagagaagctatctttttaaaaaatagttagaaaaaatagaacatctattcagttgtaataatgacaatgtctcaacatattctgtgatgtgcatagagtcatagatgaatgattattaatttagccgatttatgttttaagtgtaattaagtctaaattggcaacaaaacaaaaacaaaaatcacactcttggattgcttttttgctaactaagtagttattcattgtgagttccacttaactcacagtgagttcctttattgacatatcaattggccttgttctgaagaggttctaaaaaagttttggtcttctcagtgctggattattgatcacaaaaatggaatagcagcaacgacaaggtgtcagatggttcaagaccactggaaaactgtaatccagccctcctattgctgcagtagctagaaaaaagtagaaaactgttggatacaagcagcaaatcagacaaaaatggaagatagctggaaatttactttacttagatgtccagaaagaagagaaataattgacctaaaatctagcctttgacaaatgccctgtggatgccaattaaccgagcatctgcagagcagtttgaaatgctctgtactggagagtagaaaaaatatgagaaggacttatattataggctcattccctgaagtaccagaaagatactgtgataaactagggttcactgttacaataaccatgaaaatgtatccccagtaaactagcttaacgtgtctattcaaatgatactcttgattggtaactggttgcttgactgttattgaaaacatgcctacacagtaaaatacctgaagatgtaagtgctttttgttcaatgaaataataatttgatgataataagtgtgtacaaatgatagggcacatggaatttagctgacttacaaatacctggctttggcagtatgtgtaggaatcaccttctatcctctactcagtcccctattcagacagctgctgccaggtgactccatccctccactgtagtcatttcttcatccttttccccaagaccgacaaaagctggtgaggagaagcaaatatgatttttagtagaaggctctgtgtctagtacagtgccttgtacataatagttgcatagataaatggtcttattgggagacatagaggttcaaaaaattttgcttttaaagaatgtatgtattcataaattgaaggacaggaactatagaaaacgtgtgtggtgcctgatcagctgagagaaagacccgttttatggattgtaccacctgctatggtttgaatgtttgtgtgccccccaaattcatatataggtgctcctcaacttacaatgggattatgtttggataaacccactgatattttttctttcttcctttttctttctttctctctttttttctttcttaccttctctcttttttctttctttccttctttcctttttcttttctttctttttcctttctctctttatttctttccttctttttctttttctttttgacaagagtcttgctctgtcacccaggctggagtgcagtggtgtcatcttggctcactgcaacctccacttcccaggctcaagcaattcttgtgctgcagcctcccaagtatctcagaccacaggcatgtgccaccacagctggctaatttttgtattttctttttagtagagacagggtgttggcatattggtcaggctggtctttgaacttctggcctcaagtgatgtgcccaccttggcctcccaaagtgctgggattacaggcatgagccaccatgcctggccagcccactgatatttttaatttataatgggcctatcagaatataaatccatggtaagtcaaggagtgtactgtgtgttgctttcatcccatcataaagttgaaaaatcataaatcgaaccatcataagttgggcccgtctgtattgaaatcctaatccccaatgtgatggtatccacaaaggaggcagagcctttgggaagtgattagatcatgtggacagagccctcatgaataggattactgcccttataaaagaggccccagagagctgccttgccctttccaccacgtgaggacacagcaagaaagcgccatctatgagaaatgggccttctaccagacactgattctgttgacaccttgatcttgaacttctcaggctccagaattgtgagaaataaatttctgttgtttataagccacacagtttgtggtattttgttttagcagcctgaactgatcaagatactactgtctcttccatagtaagagttagagtgaacagaactggttttatatatgcagatgagaacataaatgttacaaggtgttatactaatagttttccagggtacaaggaagactcaggagggggactagttaagtctacttagggaggtccgaagagtcttcactgaatgaacccaaatttctatgagtactaagggcaataaaatggcccatttcacacagttgttgtgaggatcaaatcaaattaaaaatgagctctttctaaaggaatttatagcccagtatgaagcgaccgaacagaatgaagttacattcccaacttccctttctttgtggtcaagataaaataatgtaattcaagattgtaagatacacattttcatttatcataaccaggtaaagaagaaatgcaagctggaggctaatctgaacaagccagggtcacttcgccttcttctctcctctcttaggaacacaatgatggtattgagggagcgaaggcaactactggaaaacaaagaataattaagagcccaggatggaggccagatagccgaggtaggctatagaggcaaaaaagagaagggcaatgagaactgtgcagaaagtggctgaaagcgctccctgcagatcaaggtattctagtgcatgtatctgtgtgttgaagccagaaaattcccaattttaaaacacaagccatataatgtgaaggttttctgatctatgatcacttgttcattttggttttttaaaaatctagaaataaacagaatatagacaccataagagagttggaaagttatagaaaattgggaagagggaccttttaattaatcagcatatttgtacataagaacattcaaggaatttgagtacttagaatacttggagctatattttaacagctattgatcattgagacagcttttaaaacaatggttagtatgacatttttgagattgttctggttagttgtaggaagaattatttcataagatagatgttaaaagtgttctttgaatacacatactattttgaatagtcaatttgtacaattttatgtctgatgggtaaataatttttaatgtcccacccctcctaatggtgaagtggttaggactgtataaataaaagacaatgcttttggaaaaaattttcaataaatcagatgtaagcactacctagtaagtctactttcaaatcaaatcataattaatgacaggtgcctattataatgccatacagatattttaatgctcacaagttatttttcgacggagatcaacattacattaacttgaatttagtttcattattaaattatgaaacaagatacagataaatcttataagcagagttctgattacttaacacagtgaaattgcaattccaagttacagagacattcacataaagatattcttgagctactaaataatggctaaatactgatgacaataagaattaatactttccacttatgacatttgtcaataacaactctgattaggtaaaaaataattaacatgatggtcatattataattctaaataaatacattattatgtttgccacaggagtaggtgtgtatgcgtgtgtgggtatatgtgcatgtgtgtgtattcagatggtactgaactcaagttggcttttaaaaaggaagagatcaggcatattactgtgcacttatgttatcagagtgatttatgtaatgctatgatgtcaaataaaacctagagtctagtcaattagagtaagcagagtacttgaatctgttgagtctgtttggtcatggaaaatgagttacctctaacaaaactggcttgttcccttcttccaatacgtaaacaacagagtgtgtctccatctgcttatttcccagtaacttttagatccatgtttctaaactgaatgcaaggtaattcccaaagagcacaaagggagctctgagctctggatctttggcaaaccttctacctcaatgactgtctcctctcagcaaccacactgaagtgttcctatcacagagcttctccacagtcatccaatttatcttcttaattgattactcctggatgagctatagagagtcatactctcctatttcccatcctgccatgtttctcaccttccttccacattcttggggatgggataaaaggaaaacagagaaggagaatttctgctgagtgaaaacaaaatgcaagtgggtaacaaaatgaaaaaaaaaaacacaactaagatcaagacaggtactggctatagttaaaaggaaagaacactttagtcttcagccttataattataaatattctaagaaactcaagagtaagacacaaggtgatctgaaaacatttttggtcatctaaacaggacctgaagcaatgaaagaagatgatgttctcagctaagcatcctatatatattttgtttctgaaagaataaaactatctgtgtgtgttcttaagattacaaatggaataaaagggtccaaaggttttattcacatggttcatgttttcaaagagaatagaaccataattaaacataatccagtatattttcaccagttaagcagactgtcttccaggaatctggtttgatcaaagtttttttcttcatctgtaagaaaaaaaaattctttaaaataaatatacactctgcgttttaatagaggaaaaggtaagacaaagagaatctcaggaaataaacatttagccttctaagctatgttaacttatggactctgctactgaaaatttaaacaatatgggctttgatttgctcagtttaaaatctttttttctcagcttgggacacattggggaattcatattttacatctgaacctctataatgactgaaactacagtatggtatgtctggtaaaaatctcaaaagtcatgtgtcttgctctcacagattgacttatatctaaaatacccaccattaaaataattcacttgcatcaaaggactgtctctttatatttcctgttaaaatggatcttgctcgggaaagatgacatgggaacacatttgcaaatgttcttttattaggggagctagagttctggggaggaaatgagacaaaaagaagaggcactcgtttgctggctgggatcgcgaaactttagagcatgaggtatcacttctgaggtggggatacttaaagagttagacaatagcaggttcctgggactctaaaaataggatagaatgactaaaagttacaatacggtagggagaagcagtggccaggggcaaagtgcatctactaatttcttctaagatcacctctagataaaagcacattctttcagttagttgcaatataatttgaatgtttgggttacatcttaacctgaatttctagcacactttaaaccattgcagaaaatgggcttctctttaaagggaaggaagaaaacaaaacaaaacaaaaccaaaccagaacggcgtccctgtataaattccactgaaaccataattcactaaataagagccttctaaataataatgaggtagtatagaataaaaatactaaagaagactagtgattaatttatcatatgggaatcaaaaacttttctatcaatttagactaataaaattagtcatttcatcttcagagacaatccacttagaaaacttcaataattaaaaaaatacatatttattttccaaaaaagacttgagatggggacctataatcacatcctttcctcaaattgctaatgaagatacctctcctctttaaaattagctctctcttgtccattataagtcactttcctttctggctctgcacattttcccaacaatcaaatctaaaacgtcactatcaaccaatctccatcagagctcttttcgtactgactccaaaaatcgctgggttccatgtcttgggttttaaaaagaacaccttggatacagcatcctctacccgttattcaactatttcacaccttttcactgcaagagttctgagagtcatgccagctctccagagcctgagacctgctttctcttaactttgcagtttactttcttgtatcacattctgtaaacaaagtttcagatatggaatagcagcagcaagctgtgtcactgggcaggaggtggggggaagtcctgtgacacactgtttaatgtcccctgagttctgtattcttactaaccattctgctatagtaaccattctgatagtttccatccctggaaagtttcaagaggagcgggatcagtagcatcagctactgaatgaattctgggatactctcttattctgattttcctcttacctttctgcttgctccttttaatgtcccttcactggtactatttccccccatttcccttgatttttgggtgttttattgtcttcccttttcccactatatctaagccctagaaggtatctccattctcatgatttcaacctttattaacgggctctgaagttcctgttttcaaacctgaccaatcatcagaataatgtggaagaacttcttaaggacagagattcttgggcctcactcaagcagtacagaattagaatttctgggcctaaggccaagaaattctgggggaggggtgttgcactcaacacagaatcccgaaagtaagcaaagctgttctgttatgcaggtgaaagaggccactatgctagtaccttctggtgatttctgaagggacgccagtaagatggttgctgcctccggaatagttagtagttggggatttgggcttcgtctttctgcagaaacaaaaatgtatacagattctcttagcatttatatattgatgtagataagtcctattctaacatgcagcaatactagaaaaacctctatgaaatagattttgacccctcaacaaaggactacttacacagaagactaattttttaacatgtcacaattgccttggaaatgacttacaattggttatgtcaagtttacaaacagggtatggaagagaatgttaaactatatgccaaagagaattttagataataatttaacctttgcggccaaatataaggtaattatttgactgaaggagtatctgctaagaattcaaagttatttcaaatctaagttgaaaaaagacaaattgttctgattcagcacaaaacatgatttctaatttggggcaactgaagttgagaaacaaatcttaacctcataaaataaataagctcaattacacagcatgtttgaagagcctaaacaaaaatttaagcacctactatgtgttcaacagtgtttggtatttttccaagtaagtatactttttaattttagcatttcaatctttacaatttcatcaaattgtattgttatttgttaatacaatacgatggaaaggtttatcatgaaaaagaacagtccccggtcccatccttaactgcccgcatgttactcttttgattttgaacctttgatagttctttctagtcaaacaaaagcatacatttgaagttcctaggtaagttcttattttaataataacagcgtttaagaggaggctgagtaaagttcctgcacaaacgcgcagatacatttctagaagcatttgcatagttcttcctatctcgccttacccctctgagctgcacctcaggtcctaactccctggggacctctgcacaccctggcagccagagggctggctgaacagccgcaagccaataaggcttggggagccgcagcgccagcctgggccgcccttgccaccattggcgcggggctggacgcgcgagctcccagctccggcgctcggcatccagctgctgctgctgccaacccgggctgccctcgggcggactgtatctgagggcgcctcagagccgcgtctttccggtgaggagacgctttctttcggcaccagcgcggagcaagccctgcccgccccatcctattccaaaagcgcaggactagcgcccttgcacccttggtcactcacccggcagtggccggtcggagaggtcctttctccggctctggtcggagatgaagcggcgaccctctgcaaaaacgagacctggggctcagcgacagcctggcccgggacaacccgggcttaaacctcagctcctcccggcacagcgcagtccccgggcgtggggagggggcaggttgctccaggatagggtcgcgcggggctgccgagtttccagcgctcccagcgcaaccccgggctgagccaggagccctggagctctggaggaaagccccgcgcctgaccggacgccgcaagggcgctttggagcggaggtcgggttactgagatatttcccaggcaacccgagtccccatttggaccaagagaagcaaccctccagttttggatggagaatttctaataaggatggaggatttccaataatcagggactcttcccctctcccacccctccctcacctaccggtctctttgatggcctcgatgatttaagggaataaactcgacattattctctctccataactctccatctatctgttcctgactcctaggggtcttccattattgtaggaagagcgaaatatttggaacttacgtgcccctttcaggtagagcatagcttgaggagtccagttccttctctccaacagtctctatagcccgggggaagggaagagcagttaataaaacattgcagctcagtcctctattacagcaaaataaaggaaaaagaagagaataaaacaagaaggaagaaagaaagagcagagtggacacacagtgcgcattgttttaaaattttttattttgcatttgattacctgcg

SEQ ID NO: 1769 - DNA, 2140 bp, Homo sapiens
aaaggagtctcggaggactgtaagaagaatgcttcgaggccgatccctctctgtaacatccctgggtgggcttccccagtgggaagtcgaagaacttcctgtggaggagttactgctctttgaagttgcttgggaagtgaccaataaagttggaggcatctatactgtgattcagacaaaggccaaaacaacagcagatgaatggggagagaactattttctgataggtccatattttgagcataatatgaagactcaggtggaacagtgtgaacctgtaaatgatgctgtcagaagagcagtggacgcaatgaataagcatggctgccaggtgcattttggaagatggctgatagaaggaagtccttatgtggtactttttgacataggctattcagcttggaatctggacaggtggaagggtgacctctgggaagcatgcagtgtcggcattccttatcatgaccgagaagccaatgatatgctgatatttggatctttaactgcctggttcttaaaagaggtgacagatcatgcagatggtaaatatgtcgttgcccaattccatgaatggcaggctggaattggactgatcctttctcgagccaggaaacttcctattgccacaatatttacaacccacgctacactacttgggaggtatctctgtgcagcaaatattgatttctacaaccatcttgataagtttaacattgacaaagaggctggggaaaggcagatttaccaccggtactgcatggagcgagcttccgttcattgcgctcacgtgttcaccacggtttctgaaataacagcaatagaagctgaacatatgctgaagagaaagcctgatgtagttactccaaacggcttgaatgttaagaaattttcagcagtgcatgagtttcaaaatctacatgccatgtacaaggccagaatccaagattttgttcgaggtcatttctatggtcatctcgactttgatcttgaaaagactttgttccttttcattgctgggaggtatgagttttcaaacaaaggagctgacatcttcctagaatccttatccaggctaaatttcctgctgaggatgcataaaagtgacatcacagtggtggtgtttttcattatgcctgccaagacaaataatttcaacgtggaaaccctgaaaggacaagcagtgcgaaaacagctgtgggatgttgcacattctgtgaaggaaaagtttggaaaaaaactctatgatgcattattaagaggagaaattcctgacctgaacgatattttagatcgagatgatctaacaattatgaaaagagccatcttttcaactcagcgacagtcattgcccccagtgaccacgcacaacatgattgatgactccaccgaccccatcctcagcaccattagacggattggacttttcaacaaccgcacagatagagtcaaggtgattttgcacccagagtttctatcctccaccagtcccttactacccatggactatgaagagtttgttagaggttgtcatcttggagtatttccatcatactatgaaccctggggttatactccagctgaatgcactgtgatgggtatccccagtgtgaccacgaatctctccgggtttggctgtttcatgcaggagcacgtggctgatcctactgcttacggtatttacatcgttgacaggcggttccgttctccagatgattcttgcaatcagctgactaagtttctctatggattttgcaaacagtcacgccgccaaaggattatccagaggaacagaactgagaggctctcagatcttctggattggagatacttaggcagatattaccagcatgccagacacctgacattaagcagagcttttccagataaattccatgtggaactaacatcaccaccaacgacagaaggatttaaatatcccaggccttcctcagtaccaccttctccttcagggtctcaggcctccagtcctcagagcagtgatgtggaagatgaagtggaggatgagagatacgatgaggaagaggaggctgaaagggatcggttaaatatcaagtcaccattttcactgagccacgttcctcatgggaagaaaaagctgcatggtgaatataagaactga

SEQ ID NO: 1770 - protein, 703 aa, Homo sapiens
MLRGRSLSVTSLGGLPQWEVEELPVEELLLFEVAWEVTNKVGGIYTVIQTKAKTTADEWGENYFLIGPYFEHNMKTQVEQCEPVNDAVRRAVDAMNKHGCQVHFGRWLIEGSPYVVLFDIGYSAWNLDRWKGDLWEACSVGIPYHDREANDMLIFGSLTAWFLKEVTDHADGKYVVAQFHEWQAGIGLILSRARKLPIATIFTTHATLLGRYLCAANIDFYNHLDKFNIDKEAGERQIYHRYCMERASVHCAHVFTTVSEITAIEAEHMLKRKPDVVTPNGLNVKKFSAVHEFQNLHAMYKARIQDFVRGHFYGHLDFDLEKTLFLFIAGRYEFSNKGADIFLESLSRLNFLLRMHKSDITVVVFFIMPAKTNNFNVETLKGQAVRKQLWDVAHSVKEKFGKKLYDALLRGEIPDLNDILDRDDLTIMKRAIFSTQRQSLPPVTTHNMIDDSTDPILSTIRRIGLFNNRTDRVKVILHPEFLSSTSPLLPMDYEEFVRGCHLGVFPSYYEPWGYTPAECTVMGIPSVTTNLSGFGCFMQEHVADPTAYGIYIVDRRFRSPDDSCNQLTKFLYGFCKQSRRQRIIQRNRTERLSDLLDWRYLGRYYQHARHLTLSRAFPDKFHVELTSPPTTEGFKYPRPSSVPPSPSGSQASSPQSSDVEDEVEDERYDEEEEAERDRLNIKSPFSLSHVPHGKKKLHGEYKN

SEQ ID NO: 1771 - DNA, 33634 bp, Mus musculus
gaatccctggagggtgtgacaacatggagatcagttctgtacaggtgttaggtgataagaagcaaggacatagagaaagcagtgtttggtgtttttttggggagggtggggtgcagtttctctgggggcaggtggggacctttagctcaatggcccaaccattagcaggacctagttatagaggggctggccctcctgggtcaggacatcataattcgaatccccagcttccactgctaccctgacggctgtccagacttccctgcctgcctgtggcactcaggggccaggccctgagccatccttgaagttcagcttgtattttcagacctctgtgtttttgtctgtgctgttcctctgtcccgattccccttcctctttctcccctagatgtgcttggtctgttaaagctgtcaccaaacttccttcttcagtggtttttctggattgcgtcctccacggagggtgggatcttggcaagcatgtgtgtttctgtatcctaggggctgagaacctccaagttcatttggtgcgtctctgagggtcagggtgctcaccagacagagggatgggtgcagcaggaacaggcctaggtgaccaccattcccctttacagagaggagcagtcagccagccacatgcctcgagtggctggaacatacagggctggctgggatctgcttgcctggtgctcagcctgctgctctattgcaacttcatctctgcctgaggttggtacctatttgacactgatgtgtgtttgttgattgactacctgacttggccagttccaggctccatgacactgagggctgtgacttgcacagaagagtaaggtctttctcaggtaaagctcacaagtcgaggcacttgagaaatgggtgcaaaactgtaaccactgactgttgctgccagggatgtgtgggctctccggagaacggtgagatttttgtggctgagtcattgcagcaaactggccgttcctctttctgcacgtaggggcctctgcgatggtgcaggctgctctgcggtgggctaggggaaagaaaaaaatgacatttcaaaagtcagaaaaccacatgctgcagccctgcctcagcagagatgtcaggaggtgtggttgcacccccctctacctgccctcgcctccgcactgggctgaagctggagaggctctgttgaggtccttgcttaaaggaagagtctgaagacttgacctggggcctctgagccaggatcccacagacatcaaccgagtgcacacaaggtcgggatcccccatcaccatggatttgaagtaggggtgcaggtcctgtacgggaacgaggggccttgaacttagatttacagtattttgtggggatcggggcagtacatgggtgccactgcacacaccagaggccagaagacaacctggagtgtgagtctcagttgccaacttgttttaggcagcccctccctccctcacggcttgtgtatgctaggttggctgacaacatcctgtctggtgtccatctccttgcaggagcgtgctggagttacacatgcttgcacgcagcttttatgtgagttctggagactcgaactcaggtcattagggttgtgaggccagcattttacctgccgagccatccctccagacccaacttaagaacttttccattcatcctttaaaaaaaattacatttaatcattgtagtgtgtttgtgcatgtgttacgtatgtacatatgtagaatgtcgtggcccatttgagagtcagttctttcctatcatgtggggcccagggatcgaactcagttcctcaggcttggcggcaagggcctttagctgctgaaccatctcaccagccctctcttgcttcattttaaaattcttttcctaataatgtagtatttggatatgtggatatgcagttagaagtatgcagattatcactgttggggatgtgtggttactgaccaaacaagagccctgggccaggtcttagtacttactgaccagtggatcctggcctggttagtcactgttatttctgagccttcgatcttgctactgagatgggaaggcagctctgttaagctccctgctgacctagcagagcgggggcggggtgtgtgtgtgtgtgtgtgtgtgtgtgtgtgtagagatacgtgggacattcaggagttctacagggcctggggcagaaggactagctgggggggggggcagggagagtcacagctaaaggacttagcccatggcgctgcctagtctttgtgcagccagactttcccaagcagtccctgtctctggggaactgagtctagaaatagctgcctgatgactttccccaactacattgtgagagcatcgcccaagtgccccccagaggctcaaggagaactccaactgctcaacctcagaggatggggtcctataccatccttgacagacttgctcacgctggtaccaagaagctggcttctacccacgtctggtcttcattcctgttctactctgggaaaggcccttccctctctgggcctacctttatagacactaagtgtgggcagtcacagttctttgatcaccgagtggctggcagcccctaggtcctgtgccttgatcccgaggctgggttgattgagtttactgcggtgattgacacaggaaataccagcaaagagtcagaagcagagtgtgaagggagaagagagaatgagggcaagaggaagtttgtggggcccctccttgggccacctcccctgctaccagggcccctcccacagtccctctgtggccaggctctgtggtacagtgtctgagcaatatcgagggctgtctccaatggccccttggctgggctctctgcctggagagtcacagacagctgctcaggatgtcatgagaagcttgcagagtttggcctccccaccctccagcactccctgctgtcagtcacccatcttctgtattctcaggactcctggcctactgtgttgtaatatattttttttttttttgaggcaaaaattcatataacatgcaactaagcactcagcggcacttagcataatcacatggttacatcatgtctcttccgctttcagaacattccttcaccccgtaaaaaaaaacccagtgcccgctgagtagccagggaccttctccccgcccccacatcaccttgacagccctcacttggccaccttcctctctggactcaccctctgcacactgcaaccctcaggcccagactcacaggatgcttgtgcctgccttttcacaattagcatagcacttccgtggcttacccggtgtcacacatgttgggacttcattcctttttctgccgtaatcccattcctttctgcagctgagtaatactctgttgtatgtagagaccgcaaatggtttctccgtgcagatgcgtggatgcctagatgtcgtgagcatggttgctgggacatgtgtggagctgtgttgcttgcacgcctgctttcgattagttttggcattggaagtggcttgccgtccccagccttcaacctgaagttgtatcccatgcccaaaggaagccatgtggtgccttgactgccttcctgggcttggaatgactgcagccaggaaatcctcaccccttcccacctggatggtggctgccggctactctttgcattcccctcccttgggcagtcagtgctgtgacagggcctggtgcctggtgcctgtagacagagctaggtgtgcggtgacaggagctggcatttgggggacacttgttacacagtgtgctgccggctagcactccaccctgtatcctagagggagaggaatcctcatctcattgatgacaaatgaggacagtgagtcaccgagggtcacacagcagagggctgcctgcctctggcgctccagctgatgagttcctggacggatggtggaagactcggaggattgacattatccattatcccaacaggccacaggcaggatggctggtgctgagaggaaccacttgtgatttggacccccagctgcagctcagtctcttgaagatgaagtggcccaggtgaagccaggccaggccaagtcccatggccagctcaggggcaaaggcacaatgggttgggccaagcctggggcaagggccccgaaggcggcgctgggcttgggctgaggaacaagatacagatggaagaagagaccagggctggggaaacagccagtctcttcccgaagcccccagtcctgagctcctagaggacttccgtcgggcacaggagcacctgccacccctggagtgggacccagacatgcaggactccgaagagtcttctggagaaggtgaggtggcctcctcttgcctgcagtggtaatgtgtttccccaagagcccaccttccggcagaggcaaggaaataggggcatctttacaatccccatcctcccaatattcccccacaagtctctcccaggacctgcatgcagcgggggctctcccataatcctttggtccagtctctcctgccctgcagcatacactttctggtttgtatcgtgatgactaccacagaggcaatacatccagccctctctgcatacttgccaccattctgtctttggtaacttgaattacttggctcaggggttgggctgattctaaaccccagtcagcagaggggatgttagcattcttcatcctcaccagtggctgggctcccactgcctggagaccagaatgaagggatttcccaacttcacctataagctagtcccttcttcacccagccttggtttccccatctatgaaatgggtgtgatgacaccattgggaacaggaaagtcttgatgtgtgttggctcctttactggattatgaataggacatcacatattagactccccgaaatcaagagaacccttggaccacagagaaaccagttgtgccagtatcctaagtattttatgactgccacagctgtccacctgggagctggagctggtgtgtgtgtgtgtgtgtttgtgtgtgtgtgtgtgtgtgtgtgtgtgtgtgtgtgtgttttactggaaattgaagcttgagccttctataagccattcaatgctctaaggctgaactatatctccagcctctaaaaccaaagtgtatttttgagatagaataatttctgagggaatggaggctgagatgtttaaggcaaccggcagaggtgcctcctactaagagacacttcatactatgcggcagccatccctgtgtcttgtgacccacttccctccctctacacaactctcagcaggcaagagaaacaagtcccaagcataagtaagaactaccagtgaccagtgacttgtccgtggtccccaggtagcaatcagaagagcctggcgtgcagccccttcatgccctggtggtagacccttgctagagttccaggtcgaggactgctctgaaccacagtgtgatcctttgtcagttacttagcatcacagggctttggctttggttgtactgctatgaaacagagtgattgggtgaagccagctgtgaataaccaagagatatgcagtgtcaagagtcagggggaagagctgtgtggagcagcaaaccctacaggggttatgacaaaggcaccgccatccagagcagagtctgtgcagcgttaccagcgtgtctcctgaatagctggatctatcccagacagagtagactaggcgctctgtgaacatggctgcctgcaggatggatgcattttggatgatggatggctgatggctgggtgaatgcctgaatgaatgggtgggcgaatggatgacagatggatgtttagaagggtgaatgggttgatggatagttgggtggatggatggataaatggatggtgggatgggtggatggatagaagaatgaacaggtggataggtgaatggataaacaggtccttaaaaggagaggtggatatttgcaaggatggatggtgggtggattatgtatgcagagatgtgtgatggctgtggtgtagcctgaaggaccaatagcacacaagataaaggaaggagatgggaccctggtggaagatgaatgcaagcacaatgcttttcagggtcccctgggattggggatgttggagcagcaggggccccaaggaccccaagaaaggctttgctttcatgctgggaacaacagggagtcatgatgagattccaggtggtggtagaggatgaagaagaggagatcacatggttattgcttttgttcttctgtaggaggtaaacgggacagggtaggggacattctggatcaggggctaaggtgacaatcaagatgcctcccggggtttgccttctgcaactgtgtgggacggtgttgccatttgtagaaatgggatacactttgggaagactcaatctaaggtttgagtttggaggacctttgataggggagaagttacataagtacctggttatgtgggggtggccctaggttcttgtcctcctcagcatcatgaggtcatgaagtgattcaggtggcattatagacccagcacatgctcactcatcagtgagtgacctgcctgtctttccagagaccgaagctgacgatgcaagcagcccagagggttccaccgtgcctctgccctggctctccaggagcaaccaacagctggacatgtctgaagaggagctggatgaggcctctgggaggcctgaggtagacttagctggagagagttgtacggagcttgagtgtgaagaccagggagattccagccctccacctccaggacaggggccagccaaaggctgggtcacctttatcaaacaaggcagtaactacagaccttcagagcatctcgaggcccagccatctgttgaacatagccgcacaaagtcttggagcagtggaactgtgagcctccgtcaacctagtgacagccttggttctacctgggaaggagataccgaagtccctcagccttccatcttgcccaaagccctgccacagagtccgtgccacaactttccacacccaggtgacagaaatggaggtgacgttgctccggcaacacccacagaattccgggactccttagcagcgccagcccagaatgccgagtgctctgcaggcacgtggggggaagaaaccaccagcctacccagctctcggcctgaggaccaaacctggaagaggactaagacatcacctaagccactgccctcccggtttactggttctgtcagccccctgagtactcggcttggggcaataaagaaagttgtgccccagcacaagcagggagccactctggctggtcactcttcttcacaagctcccaagtatggcagggggcgccgcctgaactacccactccccgacttctccaaggtggggccccgggtgaggtttcccaaagatgagaactaccgacccccgaagtccagaggccacaacaggcaacaaggctctaccagacccctcatcttcaagtcgccagctgagattgttcgggatgtactgttgagtagtggagaggcgtccctggccaaggaatcttctcttgctcacaccatcaccagggtgccccaggagttccagacacccgaacaagccactgagctagttcatcagctccaggtaagcaaggctcttttccgtgttacctagacacttgttgattagagaagctttggcttgggatagaggccctgctggtgaagggagagttgtttctgcactaatgctagaccctgcccattgctcaaagaagagcagtatgagagactgggagtatgacgcagtcagtgtagtgctggcctcccatgcaccaagcccagcatccaatctcagcacctcataaatggacatggtggtgcatgtctgtaaccctagcagtctacaaagtggaagcaggaggatcagataactgaggccaccctcagctacataacaatagcaagttctgggctagcttggactagagaccctgtctcagatcaacagagcagtgagcatgtccatgtctcacagatggcctgtttattttcaagcacagctaacatatccaacgtaaggagaacagtctagtgggcaccctcctcctcacatccacacggagcagctccccggatcctttttctatctggggccagcctcttcccccactcccacagcccccactgagttaagcaaaattccaggtatgcagttattttgtagtttattgtttaactctaagaactctgcccacagggtcgcatgcggaggcagaaacaggtcccccacgcactcagcagtggcttgttctttccgtcccctgcagtcagatgaaacttgtgggtggcacttggcccgtgtgcccctcaagtctctgcagcccttcttgcatttcttctttccaaatatcttctgtctgccttttctcctctgctctctttttgatagataatcactgtggagtcaggtcttcccggtagtcatccacatttcgcaccctgctgagacataggccttgtctcaggggaccttgaatgtcctccctgaccttcagtacgatcagagtttggggcttggggttgtaagctcctatgtgcgattctccctactagaccatcagctgctgggaagggtgctgtgagcttccttcaggtgtggccacttgcagcttctcctgacctgtgaagtcccctacagtccttgccttgtcctgaggccttcccttgacgtgaaatcgtatcattgtgacattgcctccttttatatgcattgctataaatctcctaaagaaataacacctcgaggttaccaagatcttgtcaatatgggaaaaatgaaacagtcatgtgactcccttccttccttccttccttccttctattctttctttttagatttatttattttattctatgtatatgaatattttgcctgcatgtatgtatatgcactgggtgcgtgcatagtacctgagacggtcagaagcagtcatcagatcccatgacactggggctacagatggccctgaacaatttatgagtgttgggaacctaacctggacccctctgcaagaacatcaagtgtgcttaaccactgagccatctctccagccctacccctcctatgacgccaggggcagtcttatatctctctccaccccattctgttgtgccagggtaactgagggtggaactcctcactcaggttggctgaccatggagcctgtggattctcctagggttacaggcatgcatcgtcatgcctggctttgtctgtttttggttttggggggaacaagatctggtctttttgcatagctctggctctcctggaactcactatatagaccaggctctcctggaacccacagagatcctcacacccctgcctcccaagtgctgggattacaggcatgcaccgtcatgcctagcctcgtgcttgactttttagtacaggtactggagatccaagctcagttgctcacgcttgcacagtgggcactttacccccaggcccaccaccccaccttttacaacagcggctcattttcaggtgtcagttccttgcatcgtagacaacctatggcatctgttttgttttttccccactgtgagttgctttaacaaaactctgggctttgtgtaaggccagtgatccagagtatagaagagctataacttttaattagttttccatcctttctctgtgtttatgcatatgtgaatccatgtgctcatgtatgtgtggatgcacgtgtggatgctatgaagcccagcagtcagctttgagtgtctacctaagttctccaccttacttgtgtttttggacacaagatttccctctgacctggtacacaccagttctgctaggctggctgcccagaattccagagatttacctggctctgcccccccccccaaacgtgtgccaccacacctggcaattccacctgggtttcgggaatcgaacacagatcctcacgcatatgtggccaggagtgactgcatcttttctctataggaggactatcacaagctcctcaccaagtatgcggaggctgagaacactatcgaccaacttcgccttggggccaaggtaatgattgcctggagcagactgagctgtgtggatggagccaagagctggggagggggcttcagggagggggtggcgattcttagagagatggccgaccccagagtcttagagaaagatcaccggctctgggatcctgaggctgtgtactggagaatccgtagtccttgaatcaccaccaggcctctctctgaccttgggctatctctctcactgtttgatgtctttgagtgatggagcctggggtactaaagaatgtcaccagatgttgtctccttttctgtgcctgggggctgggggtatgactaccgaggttgactcctgatctcattctagccagctgggtgactttcaggctgtagcgcagactttctgctcaatctttctttggtgtcccctttttccagtgtcttactttcacctttctccagtgtctccctcaaaacctcctcctcttatccaactggaactgagcaccccgtgtaggacagccccgtgtggcaccgaagggatcagctcatccactcagaactgggtagcatagccctccaccaagacctgtctccagaggaggctgagaaccctgaatggggcgaggcaggaagtgagccaatcagcccctggcacttcctgctttcctcagacccttgtttgctcaaacaggctgcagagaggaggcaggacagctgctgaataaagatgtacctcccttcccccagctctggttgtccccctagaaagaggacaccccacctttctgcagagtgcttcccactccgaggtcccccggtcatgtgctgacctcatgccttcagccacttttggggaacacgggtgtagtctatcctagcaagaagttgaaaagggcctgcctgtctccatgcctgtggccctgccaggtgcaggcaggacccttcccacatggtcttctagacacatctattgggttacatctgtggggctgtgagcagaccttttggaagacaataactcccactgatgtctttaggtgacccagagctccgagcattgagagggagtctgaggacaggcctggggagagctgcagagagggctcccaggataaactgtaggagatgctggatggttcagcctccctctgctgctctctgaaatgataactctttggcccaagaaaagagtgagttctgttcgagtgattgcactgaaaatggcccataattccctccaccccagcctcattgccattttgggagtaactggggcacagctcagggtcccaacttgcaggggagaacaggggatcagggcccacagatgcttcaatttctgagttccatgttctctaccagaagatgttctccacaaagtccacctgaacggacctgaattaggagaaacctgaatgagaggttctggatcccatcggcttcctgtctctcacagggatctttgaacatgacttctctagcacctgctgaggctctggccagagcccagaacaatgtagggggcagggctgggcccacccaagagggaaccaggctggaatacaccctctgtggtggggaactgggaaccacagtccgatggaactgagaccaacatcagctgaaccagaatccagtcccagactaagggtgtcccctccacttgcagacaaaaggctaagctgtgagtgtcctagagcaagtgtgagacacaaaggtggcacgtccccgtggatctgtctgttctttgcagatggtatagtttcctcaggtctgggatccctagatctggtccagcatggtgtgtgggacaagcctacagacaggcaggccatggtgataggagaatatccactggtgattctgttaactgctatcctaagtcatttacaactgggcacagagataacctctctgtcacataaaacctagcagggtcacacaaggtagaggtgcccgagctaggttttgaccctgaacactggctgcagggcccatggctcacttactctgacaaagccaagccagcaacgctcaccgaatctgcagccagaaaaactgccagggaaggccgagcttagatctaggagcgtctaggaaccacacagtctggggagcatgggctaggggaccaggactaattaggagtcatgggtgggctttactctgtgtgctgactctagaatctgtggtgatgtcaccactcgctgtcctattgcgacttcctcccagctcctgtctcggctttagggggatgtgaaaccggtgaggagacagaagccacccttaaaggaattggggatgatgtcagcacctttcgtgaagtgtgttctgctgccactctggagcagaagctcctgatggggttcagtgtatatgggggggggggggcgagggcggctgtgttttcttcccaccccttttgccccattcatagagctcattaccattttaaaggcttgagaccccatctgtgcccagaatactcataggtttaaccccatgtttcccaaactcgctggtccaccctgcacagagtccctagggcttctgagtgtcactgcatggcagtgtcactgtctgtccagaatggcaggtcatggcaggcacaggccctacggctcagcagttgctaagtgccctccctactccctacttcctctggatggccagggcctcacagtcctggggctctgtctccctcgtttccatcctctgtatctggaagctgccaggttcctgctgctcctcaggtggggccttggcacagtgggcggggaacacaagagggcagggccacccctgggatttgggtcacctcaggaagaaaagggtgttgataggcaggcccccacaggcgaagctgagcagatggcccagaggattatgaaaatccagctttgttctcagctagggaggctcaggcagggggaggcagtgtcaccaaattacacttgagacagccaggcttcaaagaacagcttatgcaaaggggcttcctgtctgaaggctgtggaactcctaagtcaggcctatcttcagctgcttagtcccgatcatggggtggcagagagcagtcaggatagcccacctgagctcttaaatgggtagtaaggcatcataggagtgtatcttttttactggtccactttcacggtggccatattcacataaggatagggaggatgttgaagatacagggatgatggttaaggttacggtaatggtgaagactatgatggtgctgatgggagtgatgtggtgatggtactattggtgttgcgctgacgacagggaggatggtgatggtggagatgctggtgactgtattagttactctcttattgctatgataagataccatgaccagccaacatacagaaggagggagttaggtgggtttatggctcaagggtccatcaccatcacggtggagaagcacagttggcagtctgaacagcaagctgagcgctcacagcataaactacaagcagaaagcagagggagcaaactgagacttgcgtgtggcactcgaagcctcagcgctcgctcaccccagtgatacacttccttcagcaaggccacatcgcctagtcctacccccccccaccaccaaaatgccaccagctgggaccaagtattcaaattccaaagctattggggacagtctcttccagacgatcacagttcacagtgccaggtgagagctaccatttacttacactgacttcatgcacggtgatgccaactgtgccatccactccagaactgaggtgtatcatgacggagcctgagtcggtgcctggcctctgactttggagcacacattaagccaagcaagccagactgagtattttcagctgtggtttccacaacctctgtcagggccggcccagcttggctgctacggtgtgaaagctgccattggtggcacacgatggcagatgtgcctgcagccagggagcccctggatacaaaagcagaccctggctccccatctgtgttcacacccctgcttggaaccaggattccctcctgctgagctccagtgtatccccccccccatcagctgcccccctccctacacacttcccacaccatcttcaaggtcagagcacaactagaaggctctgtttgtgcacgtaacatctccttccttcattcagacagccatctactatttactgtttatcattatcaatgtagttattattggaaatatttcattaaaacgttaatgattatcatatatgtgttacacacatataataaccatcactagtaaccattattgttaccagtgtaagagctagctggtgatctcttgtggcacttaacttctgggagtctagggctcgtaggggctcacagagactgaagcgtcaatctcggagcccgcatgggcctgtgctaggtcctctgcatatatgttatggttgcttagcttgggttttttgtggggctcctaaaagtgggagtggggggtgtctcttactgttttgcctgctcttgggaccccttttctcttactgggttgcctcgccagccttgatatgagagtttgttccttgtattattgtaactggttaagctgtgttccattgatatctctgtgaggcctgctcttttctgaagggacacggaggagcagtggatctgtgcgggaggggaactggggggaggaactgggaggagtgagggagggaaggctgctgtcaggatatatcgtaggagagacgaatttacaaaaagaaaaacagggaaagtcatccctacctgcctcgttttcaggacctctggaaagacaataggaggcggcttttaagtcctccgcccagtgtaggacccactgaaaagtggtgttcgtgattcccaggctaaggatggggctcctgtgtggtggaaggaggaaggaggaagcctggataacagatgcgctgtggcctctttgcagtgagctcgccctgtctgactccttccctccctgcctccctcttcctcaggtgcacctgtattcagacccaccacagcccagtcagagcttctgctcggggtcaatgccacaaggaagcaaggtcttatccttctctatcccgcaacccagagtagcagagtggtggcctgaccctgcccaggatccacaggcctctgaggccacaggtgagttggggaaggagccagggcttttaagcatccccctgctcatggagggagaaccttaggtccaccctggggaccatccagggagagccttggctcagccacctggcctgttggttctgtggcgtgagcagtgttctccctgagcccattgtagaccctgaaatggacacatatggccccagttagtcctcacacggagctggtgagcaacacaagatttataacaccagcttttatagtcccgggatagttggaagacttggggctcagagaggcaaaggtatactggggtcacatagcttggaaaggaaagggcgaggatttgaacctgcttttccatgaattcgagcctgtacttacaactgagtccatcaatcccccaggcctgacaccatccccttacagctttgatctaggctagacccatacctcatttactctggtaggggagcagcagcatagtggccagccctctccctactactgtgaaggttaggcaggaagggccaagctatagttgatatggtggtctgaggaacctcagggcttcaacctcagcggactcggggactgtcctcagccccagggttcagcggctgtgtatttcagggtggccgttcccacgaacagacctgagtccctcctcgtcccccggcgtggccactccagggcggcttcctcagagccagggcattgccacagaccagccctccacaggacagacccaggcactgacctctcaggccagccggctcctggccaaggtgagtgaaccccagctttgtcccacaagacacctcatcccaaaagcacggggcctccacctgacattttcctctttatgacaaactgccccttcttcatttgttcgttaccgacgccaaaactgtcacctcttgaggttttgtagacggcactccagctcagagtcggctgcaggtctttgtctaccttcacacttggctctgttccaaaggtgtctaaagagacttaagaagacacaacgccctaaccacattctgaaaacggaagtggggggagccaaggcagaggggaagtccacacagagaaaagtaaattaagctagctcaaagccagtaaacaagatgttctgttgggcccgagctctcaaccagaattgcaccttgggctttgagcttccggctgtccattaccaacacataaatacggttgttacattaccttgcttgaccatcccaccctttgggcccagcagccactcacccgcctttgtcttttcagtttgcgggatgtgtcaaataagtagaatcagccatgttcctccttcccctctgatttttttggagtttccttggtgttttctgcctcctctgtggtccagcagtataacattccactgccaccattcttggtcctgtacctgggatagcatttcctctttggcaggcagggcacactgagcagatgcagggcatggctgaggctgtcccacttgttgcgctgttcacttcttgacattgggtaggtttgagggaggatgggctgggagttcagagcacacaggagcttaggacatgtcaaaatgagactcccagtgatctcacagactggtgactcatgactgtaacgccagcatttgagaggtgggggcaggccgatcactgaattcaaggccagcttggagttctgaatgagaccatgctataaaacaaaacaaaaacaaaatctctcactggaatcactggtaatttttgttaactgattacatatgaattgataattgtgatcaagtaaaaaattttatgaagggcccacaagatggctcagcagaaaagggggctttctaccaagcctggtgacccgagtctcaactccaggacacacactgtaggaggagagccctgactcctaagagttgtcctcggacctccatatgcacaatatagtgtgtaatgcacacaagtgcatccgtccacactctgtgcatgtacctgcacacacacacacacacaaaaacacacatatacatgcacatgcacacacactaaatgcaatttaaaataaaaatatatattattaaaattgacttccctattttcacatacatgtttaattgtataagatatgtagctcatatcacatttctacttcatgtactatgtgacatgctataatgtagttatattcctatttcagtttaccctagttgccctcaataaatatgcgtggtgatatttttgttgttgttttccagacagggtctcattatgtagccctggttgacctggaactcactttgtagaccaagctggcttggaactcacggagatcctcctgcctctgactcctgagtgctgggattaaaggcaggcaccacgatgcttggctttgatttttattttaaatatttctgtcctttattattattattattattattattattattattattattgtctgcagtgtcatgactagaactcaggtccttgtggcttctaagtacacactccaccactgagccacaccctcatccctagactgacactatagacacgcccagagttgaagtctttctccacccacagaggattgagcaggttctgtgaaaacacaacgtggttttatatgagagattcaacatccctgtgtttggtggttactccctttaccataccccaggcagcacattgatcttgactggccctggaaatgaggccttggagcctttgtgtataggaatatcccgtgagtccttctccttggtggcttcatactgctcctcagacagcacgtgtgctgttcctcccgccagtcagactgcaggaagtgtccctcacaggtcttcctacacatgagtgcaccttctagattctcctcaaggctgtcctggccaaggccagaggtggaatgcacttccaggacccacctccctgctgggaaggcaccttgcattctgaaggcagacccagcccttgtccccagagagcagtgtggctgaatgtgtgagagtcaccacggggtctggatttatcaagcttgcttctttccctcctcttgttcaggtgcagtccttcgaggaactggtactggctggacacctcccacctcaggaccaaatcaaggtaccgctacccagtgtggacactgcaccggcagtgaccagatagcccgtccccagagtagagtctctgagcccccttttgctaaaggcaggtggctgtgtcccagaccagtcttcctcagaagttgagacaagctcctacttagtgccccagacagctgctgcctgtgtcatggcagcaagcccgcgctgagccacggtggcttgccaggcagtctggatgcgttatcactgttttatatcctcatcataaacgcccaccagggagctgtgatcatcacccctgcttaactatgatgaagcagaggcccagagagaaaggacaccgaaaccacacagtcgtgggcggcagagccctgagctgggcctgctgccttctcagtcatgacccctgctgctgtacgccggggctcccaggaaagggcctttgctttctaacctacttccctattactttccaaagcttggaaccaggggcaaaaaggagacagggtcctttttcccatgaaaccgttacactggagatatttgtttcccttgggttcaggttttaggtagttatagccaggtatatccaatctttcctgctgccagagagagcctcaggaaggtgtgtgtgggacccccaaacctgagagtttgtgcagggaaagactgggcacggcatgggcgtgaacctacattctaggttcaatctattcctaggctcctataggaaggacctagtaggagagaggtacagccatatgttgattggctatgtttatgtttgctatgagggcctagcagagtctttaaggaccaggagctctgggtccagtgggcctgagagtcaagtcttgcctgtacagcttgctcacttactgtgtgagtttcaacaacttaaataatttcttttgtatgctatgtggcaaattctctctctcattgcaattctgctagagcagacatgaatttagaatgctttatctcccagacaccatgccagtcacccctatccatagtgtgaggtgataatgccatctgtcctcactatctgtaaggagtggggaagagagtgacttttattttctgaatggctcggttttcacatcaggagtgaagatcggggctctctggaatattcaatccctatggagacacagtggtaggatatttgctgctgcatctgaccaggagccaaggggtcctggtttaccaagaggaaccagtggtttctaggctggttcctaggctattcaagtgattgatggcagagagccccatctagggagaagcccccagaggcactcagccatagcctctttctcaagcctcacgtgagtcccatagccgcccatccaggagccaccagtccattgtgtgagcatgaatcccctatgtccaggcactgaaagttctgacccttgtgtttcagagcttggagcaactgagggcagcccacatggccctagaggcagagtacctgcaggcctgcagagaagagctcctggaccctcagcttgatgcctctcaggggagtcccaggaccctcaacctctgcaggtaggtgctggagagacaggcccaggaggacaggagagtccctggctccctctgtctccaggaaggaggcatttcacatccatcattgtgccacagggacacaggaacccctgtcctagtgatgaaggagtctagagctgagaatccagtcctttagataacattttggggatcagaactgcagaactcctcattagataatcaggaaattgaggccagaggaaactgggtctacttcagaatcacacagcatcgtcatggcagaaggcactgagctgagacctcctgagtcccactggagtctaatcatcttgctattgaagtttttgggtccatctttgtggaccctgagaggccactcctagggtctcagatttgacactgatcaccacgctgatatcttttccttcaagggagctagaagcagagatataccacctgggacagcgcctggaagagctacaggaccatatggaccagacccaaagagagacagagccatgtaggccagacctgcaagacagcaccccaaccatgtcctttctgccccagtcagctcatctgtccatgccttcaggacctgtctccttgccagatggccaaacctaccaggaggtactgcttcattccatctcattggtccggtccccttttgcttctcttattcattccatgttaatttcttcactaaatatttagggactgtgtaccatattgtaggtcccatgacacacagtggggatgcagtggggacagaaggtagagagggtgacctctgcccttacggagttttctgaatacatgcactagttgtagagttatttatcattttgatagcatgcgtaaagggaaatgcaggctctatggaagtgaagggcagtcattggaactgactcgaacggggacaccaactctccctgaagtgtttaaaggagatgggagagtgagtagggcctgttcggtgctggagacactcatgcagtaggaagcgagtggtttcatggtctgccgtgttgctggagactccagcatgggccttgtgatgtcagagcttgtagttcatgtcacaattagaccttccttgggttttcagtagagggtggcagcaggcacgtgtgggtcaaccagtatgaggctggggagtgacagggtagagggagagatgaggacatgagcttagacaaggctcaagggtttcatttgatctgacttggatgagagtgagagcgaaggcagcccagttggctcccaggcccccagcctgaagtgagggacaagggaggggtatgggtgcttacaaagctaagacaccagacacagcctctgcgtggaatgtgctttcaacagagccctctctccacaccatggtctgttaagggacagccattctcccccttgggtgggtgagctgtgctcacacgtatggcagtggtggcacttctgtgtccctaagctcctgcccttggcccatggggacttgcctgctgctgctgagcagggtagggctagtgcattaggtgagtgggtaaggaggctggccctgagggctagggattcaccctgagccctgcccagtaggcagaacaaccctggcggatgtcatttcctgtactgacaggaagcctgggtgtccaggctacagggaaaggtgaacacaggcaactctggcaagcagactgccttggcttctgtatggctttagcacatcataccagcctcaatttccatgtgaaattttgtgtggtttgggacactgaggagaaatggtgtctgtagtatccctggcaggcaccagaagctccgttcccagcagccagtcatgaagaccctttagtcttcacagggtctcacacacatgagtgaatggcaggagataggctaatgcattcactgtttcctgttcctcggtctgtggcatgagatggcagaggcagatgctcagagcgatggttaacctctgttcctcacttccttggccagcctgccaccaccaccaccacctcccctggaagctcttgcacgctccccatcaacaagaagttaagcctgagcatcaaaactgaggaaagcccaagaggtctcccggtcccactcagggacaggacgcttcaggtggagcaggacttccatggccttctggagaggtgagtgagtaggcataggatgaagacactggccactgctgggctggccactctgggtctcgtttgtccccatgggcataggtgagaccctcttgggcatcttcctgcagatacctcagcgttaaatccctccctgaagccttgagggatgaagatgaggatgacctggaggaggaggaagaggagcaggaccatcaaggccccttggaagttgatagtccagccacagctccagggaaaacagaagccgtgagggtaccaccaggagagcgcccaacacaggctgaggaaagccatagggatgctacccagtaagtcattggcctctgtcacaaactgcagtgtcccacaaaggggtaaccattggcagcacaaggcaaagacttaggggtgtggctcagcatgccctgagttcaagtctcatttcaggaagaaaaaagtatccagcctgtaatgtttcttatattattttcaaagttagttcctatttgtaacacaaaattgtggccttctgtttataataacattgtcttttgagtccgtggaggtctgtgcaaatagctaaaataggaaattcagggtatttctgctatggtgtgctgggaggttaatttggcttcccacattacagttaagagatgtatgaggttcagagatggaaagcactgcccaaggtcacacagctaggtgacagagccaggacgcatccccagggaagtgtgtctgatgccatcgcatgcccctggactggtgatgatccccaggtctgggtcacctggctcacacgggggctcaaaaacgctgttcatctccttccctgctagggaggatgaggaacagatgggacctatgaagtcaccagacttccggccatccatggccagagatacgtacacaccagtcctggatacagctgaagtggctcaacggggcaccaaagccatggtgtcacatcagagcagtctgaccagcctggaagagagcaggccctcagagctccttcctcgaaaagccctgcttcgggctggtgggccccacactgaggtgagtgtgcttgtgggctggtcagaagatctctctcctggtgtctgaactccgttcctggcctttgctctcattggctcttttcatgtgtccccgcttcttgcactgctcctgtctctgcagccgtaaagcctgcccaccagtcagtattcaagcccaaggccacttgtcctctgctgacagcgtctttcctgagctgtggcttgtgcccatatgtcagtgtgtcagagctgggacctggtttctaactgtgccttttgcacctgcaagtggtaatttgaggagctgttgcaggggtgaaagggcacagacaaaataccactgaggctatgtatttttatgcatacacaagtgtgtgctataaggtcagacagcactggggtcttggagccccaggaataccaggccaggatctgggaggggcttcccagtgcacaggaacactttcctcaggcataaaggatgtggtctgttctaggagccctggatggtgtcaccagagacagacagtggcttcgtgggctcagaaaccagtatagtgtcacccttcacccagaccccagagcaccggctctcccatgtcaggtattgtatcccacctgggacatcttagaatgtaaatgtctgtggtagcctggaaacaggggtcaatggtcttagcatctgcacaccctcacatctacgccagttttgggtcccattcctatcatgctgacagagagcctcagagaacaaaactgacttcttgatatcgctcagcccattcgcaactgttaggggatgttttttttttttttactatgcaaaggcaggagtaaagggagtatgtagatggagccgtcagggagggtggtgtgagatgacaggtcagtagagcatcagggtggcaggtggaaagagaccagaaagaactcaagagataggtgagggttgggggagctctataagaaagggaatgtggtgaggtcaccatggcaactggcaatccccagggtggggcactggtcacctggaagcccacttggcaactcgggtgtgcctatgaagaaaggtctggaactgtcaggaatggagagagcttcagtccttccctatatggccgacaggtgcactgtgacgcacatgtcagaacaaggaggccccagatgaggctgtcctcagtcctcagatgtactgagatgctggaggcgtgcagccctaaggctaagagttcaagccttagcacacagaggggcccgggtatcatagcttgagccctttctaaccacagtgtctctccttccctgacctccagcacttcaggaccatcagctcaacacctcactgcctctgtgcctggtgatagaacctcccatcccaaggccaggggtctcatggttcccagaagagccactgagactggcatacccagaagccgaacccagcagcatttctccagcctgagctctcccgggagaggggcacagagctgccacctagaggagacatcagtggctaaaataggtgagtggggagcctgggtaggctgccgcctgggagggaccaagtggaagcatcagacagacagccttgcattgtaggtcaagatgtgagatactatgggagttcaccacaggaaaattaaagggagggtttacagacagggaaacgggagagacgcctcagtcggcgaaatgcttaccttgcaggcgtgaggatctgagtttgattcccaagaacccaaatgaaaaggcaagcgagtgccacttgtaattccagagctgggggtggcaggcagcgataggtgaattacaggagcgctctgctctgctagtctagccaaattggcagccccaggacggtgagagagccttcctcaaacaagaaacagcaaccaatagggactgggaagatagtaagtggtcaagagcacataccgttttttgcagaaggtctgagttctgttcgtagcatctccctcaggctctcagaagcgcctatacctccaaccccagggggctctgacacccgggcctgcaaggacaccagtagctctcgcgcgcatgcgtgcccacgtgcacatgcgcacgcaccccttccagcctcttcttcgcccctccctttagttgaagctcccgggctcatttctgctgttcctgttggccttcctctgcctccctagcggttcccaggtctgagttcaagagacagaagcagatttccaaacagctccttcccagtggaagaaccagccccgactctgccccagctcccacagctgcctccacgccccatggatcagcagagagcactgccaacctcctcctcaacaggacagagcgcgagtaagtggacacagcctgggttatcccaccttcctgtaggatggagagcggaggagactgaaggctatggcagtgcccctagcttacacattcaagctgcccgtgccggggccggatgtgcctgggtcttgcttcctagctgagtgctgctttacaggactttaatggtactgatgtcatgaactcttctttagctactgggagatgcaggtgcatcttcctggctcggagacctccccaccccactagccctgccatgtagcacctgcattcccaatcaacagcaagctaggtttgggggccatgtccctgtaattccaacaccagagaggcagagtccggaggactatgggtgctgtgtaggcctggactagatggtgagagcctgtcacctctcagcagctttctcctgagatcattccttgattggatagaagctcctcttgttaacttggaacgcgctgggaatgaggctactctggccagtagtgcagtcatgtctgttgctatgtgcgcagttctgaccagcagctgttgttctgtctcatggtctgaactgaatttgtctactcctgaggtctgtggacctcagtgtagttgtgtgtgctcatgcacgtgtgtgtgtgtgtgtgtgtgtgtgtgtgtgtgtgtgtgtgtgtagaggggagagagtatggaggaaacagagactagcttagagaatactgtatggctatgtgaaggcccatcctgaggacactgagggactttaagtagcaaagtgccatgtcactactgagctttataagttccctgccacaggggtcagtacagaggcctaggggtagaggccacaaaggatgcctcaacaggggaaaggtttccctggactcaggaaaggagggtcattttttttaaagaagagccgttgtggcatgttgctgtgctggtgtaccgtggggcttggtggtcattaaacccgggggtatgctggggaaggcagacctgaaggactctaatggctattcagctgattgctggttctttagtggggtcaggatcgaatccacagagaaagatgagctgcagtctccaataaacctcaggcaactaaagtgttaagtcaggaagcccaagagcctgacagatccagccagaggacagatgacaccccaggctgtgttccaggtcccaggctaggaagccaagctgggattaaccagttgctgggagctctcgctctcctacagctacccctgggctttgccttggaaaccccagcaagcatctccctggggatcaccaaggagacccatgcccagtgcacacactgcttgcttggacatgaccagagggaggtccctaagccttcctgagcagtcaccacacaggtcatgtttgcagggagcaccaagagtccagggatcctgaggggagtccctagcctgggtacctcacacagaatggctgcagagcccacctcagcccgaacgatggtcatgccaaggccagcctccagtggtgctccctacatgcggtctgtgtcggggcattggttggtttgtctgcagcagtgttgacaaagcccgtaggactctgagagctagtgaggcgggggcatagcaggccagaataggccatttactccctttggacaggaggtgggcctgtgtccagcaggcagccttgctgacacctttatcttccagcctgctcgctccacagcacccagaagcgtgtgggtttgtttcccttgtctactctagaaccctcggctctctccctcctgaagcctgaattggggagtgctccccagcatctaatgtgtctggggttatggagtgggatgctaatcttgcctgcctgtgggtcagggcctgggaggcaaaagcagggcacaagtgtcttctgctgggaataaccacagactgtaagaatatctgcaggaataggagcagagagccctgctcagaccgttacagcttctgaaaggaggtgggaaggggtcttgctatgtaacccaggctggcctggaactcatggtaatcctcctgcctcagcttccaaacccgattcagtgttgtgtagtcactgtcttgagaggctgagcccgtatgctaagagggtcaccctcataggtaggttacccagatgtgcttgtggaatatgaactcagaaagatgtcaaggctgttgttactggactgtacagcccgatcttgtgtctgcagacacaagccactccacccagagctatcggcgtcccgatagctctgttcgttgctcaaatgatctcgtttctgtctcttcgccactccagccaggccatcaaggatctgcaggcggaggtgtcacggctccgccttcaactggaggacagcctgcaccggccacacccagacggcccagcctgtgtagcttctgctttcaaccactccacccagacccaggaaaagctgggttcctcaccctcctggggcccccactatggcaggtagaagccccaccccaacccctacctctgttccctatagcattagccagtctctggctctctgggcacagggactcagacactatactctcccctccccccagcatggccactggtccattctcaggcttttcttctcacatgtatttaatttaaggaagggtgcacatatgccagggccatatgtggaggctgcctccaaaatctcatccggtgacgtcatatctctcttccttgttgctagtaaatccacagagaggctgtctagggagcctaatggtgtagagccagctgagccaatgggaagacgtcgagccaggtcctcttcggtgcctcgggatgtacccagactgtacctaagtaagtgaccagagagcagagaccagggctgttttctagggatcctcgtcagtatgttggctctgtggtctgagaacctagaaaagccctggagaggtcttctgtatgtatgtttgatgctattgttttgctctgggacaaagcacatctctagtcctagccatgtagactctgccgttaccatgagggttgggactgggggatttgtgtagatgctcaccaacctccattgcaaatgggacaccgcagtgaagagtgcaggttcctcactggcagagcagagccatggagtttgtccctggccaggctgtcacctgctctgaggagataaagtgacagcagacgacatagaaatagcagcacctacctcttggggttgctgcacaggcatgtgatagccacagggctccaggctgagattcaggaggtgcccttggtcccctgagaagactcaagatcaacagcccaggcatcgccctgagccccgccctccacgtgagccccacacctgccccctctgaggctccactcccaccacaggttctgaatcggagtcgcctgcccctcggctctcatctgagaagagcaggacctttgaggagcaccccgaggctgcacagtgggggacaagaccacagagcagctcgaagcggagggaaagagtttccttccggggtcaatacacaggtgagcttgtgcacactcaacacacgctcaatcacggagtcccatcctcagcccttggctgatatttaccgtgtgtgtgtgtgtgtgtgtgtgtgtgtgtgggcatgtggttcatgtgcttgtgtgtcctcatagtctgctgtctttcttgatcactccccactttatttactgaggcagtgtcttcgtctgggtctctgttgctgtgatgaaacaccatgaccaagaagcaagttagggaagaaagactgttcatcccccaaaaaggacgaaaggaaggaaatcagggcaggaactcacgcagggcaagatcctggaggcaggagctgatgcagaggccatggagggtgctgcttattggcttgctccttgtggcttgctcagcctgcttcttatagaacccaggaccaccagcccagggatggcagcacccaccgtggcctgggccctcccccatcaatcactaatggtgaagatgtctcacttgtagcatgatctttatagaggaatttcctcagttgagtctccttcctctctgatgactttagctcaagtcaagttgacacaaaaccaatcagccactacaggcaaggatctctgactgaacctgaatctcaccaattcatgtagttcaggtgactgtcttgccctgggtgtccatctctcccgccgaacccctgcctcctgagtggttggattctaggtggtcactgtacccacccacccaccttttataggagtgctaaggatacaagctggtctaaatatatgggtgttgtaaggactttatccactgagtcatctccagcctcagcccttgggttttttgtttttgttttttgttattgttgggtttttttatttgcttgtttgttttcacctctgtccagtggaatttcaggagcttaagaccatactgggatcagccaggtacctcatagaatggagagctttccattggctgtctaatatagacccgttctgtccttaacacagttccagaaattggccctttgatgtccccctttccagctgtttagcacccaaggagagacgctcctgatccctcaactgagcctggggcaaggaagggacagtgataactcctgactcatgacactagtcatgacacttctgcctcaccagcttccacatcctgcctctgctgcatgccccgtcgcttccacacacaagaactggcagttgcttctagaagcagaaatgcaacaagaagccaggagggggcagtagcaaacaggcatctgtgtgcacacatgtgtgcagtgggtctatctgtggggtttgctttcacatgtgcacaggagataggcagagagcaactagtaaaaccactgaaagagaagagagacagtgaaaccagtccctagttcacacaggtctggacactgatctttctggattcttctccaggccaggagtaccacattctatccccaaaggccatcctgaaggacagtggcacaccgtcctgtccccactgccatcccattaggacccaggacacaggtaagagacagcattttgttcagtggaggcttaagcctctccccactgagaagttttattagagctgaacacagactattttatgagaggagagtaacttgctcaaaggcacacagtttacaagtgatagagccaacatttgaactcaggtctttatgctccggagcactggcccctccccaccatggatcgatgtcctgacagactttccaattcactcatttactctcttgctcagtgcccaccagtattgtctccaaggagccagcatcaaagcagagtggtcagggccaacacagaccaaggctgtgggcagttcccagaggatgtgctggccaagagtggcctgaaaagcaagtctgatgctcaggcagggaccacagtggatgtctgaaatgttcctttgacctttcactgacccagatttccctcttctggactcccatgaatacactgaggctgtctcaaaggcaaaatgggcttgtcatctggatggcctgggccttcccttggcaaagtactgcctcgtggagcctctgtttcctctgctatagaggggagatggggagagtggctagcctggtgagctgctaggcactgtggagtgatacattaagtcattagtggctagcgtgtggtcagtgcctgcttacctcttcatggttactgtgcagtgtcctccatcaggcggcctgggtggtctctgcaggggacccgggtctgataatagagtgccagtcattgtctgcagacctttccccctccctctctctcttcccttgcaggcagtgctgtctctagagacaccacacggggctcatctgccgctgacaccctccgctgtgccctgtgtggtgaagtcaagtcctctgcagaagcagatggctccagctcaggtccctctggtaggaatgagccctcagcatctttcttcagccacggggcttggccagaccttggggatgctgtaagctccgctagagcaaaataaatgcaacagaggctcaacatcccagagggatgccctccctagggtggtcctccactgcccatcagccacaagtgcaggggtagctggctgacccaccgtgcttggctgcatctaagtcctcatgtaatttctctgtctttccttcccttgcagagaagaacacccccaaaaagccttccacccccatcctcaaacggaagaacaggcagacgggctcgccagtacgaatggcccctggactctggtacctggctgctgcgcccccagccccagccccaccggctttggcctacatctcctcagctcccattatgccttatctaccacccactgtgtgagtccccccttccagctgccccatgctacctgggtacccgcaaaaaaccaccccagcattcttacatcatgtcaggatgctgtgagccaggggtagtgtcttcctgtatggaaaatggagtataagcctgacattcttgtagtcactcaacaaactctcatgggacaggcttctgggtgcttggggacccagtggtgaactagactagcaagagggccctgtctctggagttacagcttcttgaggacctagaaccataagccatctttctttcctaatgagtaagcctataataaggtgtgtgtttgtgtgagtttgtgtgtgtatgtgtgtgcacacgtgtgtataaagtaagcatagtttctattccttctcccttctttttttcaatcaattctcattagtgggatggttttggatttaggagaattgagtgcacactacacagctctcccatgcactgcccctcccccacagcccattcccatggctgtgttcctatgcaaacccgtcactaggagaaaaccaactggaatgctttagtattagccgaagcttgctcttttcctctagcatgcttgttttaggcctgatgcccattctattccggggcaccatccaggatcccctacatttcattggcaacttgggctcctcttggtggtggcagctgctccatactgccctgtctctgtgactttggcatgcaggggcaccagctagatggatttggtcttaagcatcacttaccaaaaaggcggagagtgggcatggcagcctggtgacatttcaggaattggctgtaccagaatcccctctcttatgagtactatggcggaagcagaggagtgtttctttaagcctcagtttctctatctgttcaatgaggaagtgactctgctaggtcctgatgtgtgaggattaagtgagacactgtcagaccccactgggatatgtgtggagtctgtcttgtgactccaggaagtgtcatgactgactaaatggaacattagccaccccccccaagcccctttctagtcttagcctcagtttcctccactgtaaagtgggcctgttgggctgcagtgttaccaatagacagcctctgtgattaatggggtagtagttggctctgtagcagctgatgccagcagaagagaagcccaaggcaccagcaggcatgaggggtcaggcctgaggtacattttcttctgccttcttgcttgagtcctggtgggtccctagggccagcctttcttcgtgtccagaccctggctcacgtggtatggacacctgcccacgtttcctgtcctcgggctggggaggtttgatgtcctttagcaaccctatggtagcctcagcattctctacttgtctcaagacaaatctttacaatctgggcctggggggcgggggggagctcaccacagtgtggtggccccaaggaagggacaattgagtggacagcacttggagaatgactttgggctcatcactttgtctctctggtctgtttcttcttctgagaaacagatactcgagatgattaggtgaatatatgggaagccatggcttcatcaagccttcaggtcttgttagaacaagccataccttggttttcttctgtctgggcagcaggactaagcttgcaccatggttgaaccagcaatcgcagtggtgctgtgctgccacctgctggccagatgcagccctgcagctgactgaggctctctaatccagtgccttcagggaaggcttggatcaagctggccctcctatgagctgcaaggatggaagccacagagagcccaggttctccctcaacgagggtgtctgagcagctctgctacccccaggaagcccagtcgttcattttggcaccttcca

SEQ ID NO: 1772 - DNA, 1268 bp, Mus musculus
gaggactatcacaagctcctcaccaagtatgcggaggctgagaacactatcgaccaacttcgccttggggccaaggtgcacctgtattcagacccaccacagcccagtcagagcttctgctcggggtcaatgccacaaggaagcaaggtcttatccttctctatcccgcaacccagagtagcagagtggtggcctgaccctgcccaggatccacaggcctctgaggccacagggtggccgttcccacgaacagacctgagtccctcctcgtcccccggcgtggccactccagggcggcttcctcagagccagggcattgccacagaccagccctccacaggacagacccaggcactgacctctcaggccagccggctcctggccaaggtgcagtccttcgaggaactggtactggctggacacctcccacctcaggaccaaatcaagagcttggagcaactgagggcagcccacatggccctagaggcagagtacctgcaggcctgcagagaagagctcctggaccctcagcttgatgcctctcaggggagtcccaggaccctcaacctctgcagggagctagaagcagagatataccacctgggacagcgcctggaagagctacaggaccatatggaccagacccaaagagagacagagccatgtaggccagacctgcaagacagcaccccaaccatgtcctttctgccccagtcagctcatctgtccatgccttcaggacctgtctccttgccagatggccaaacctaccaggagcctgccaccaccaccaccacctcccctggaagctcttgcacgctccccatcaacaagaagttaagcctgagcatcaaaactgaggaaagcccaagaggtctcccggtcccactcagggacaggacgcttcaggtggagcaggacttccatggccttctggagagggaggatgaggaacagatgggacctatgaagtcaccagacttccggccatccatggccagagatacgtacacaccagtcctggatacagctgaagtggctcaacggggcaccaaagccatggtgtcacatcagagcagtctgaccagcctggaagagagcaggccctcagagctccttcctcgaaaagccctgcttcgggctggtgggccccacactgaggagccctggatggtgtcaccagagacagacagtggcttcgtgggctcagaaaccagtatagtgtcacccttcacccagaccccagagcaccggctctcccatgtcag

SEQ ID NO: 1773 - protein, 423 aa, Mus musculus
  VARIANT (1)...(423): Xaa = Any Amino Acid
EDYHKLLTKYAEAENTIDQLRLGAKVHLYSDPPQPSQSFCSGSMPQGSKVLSFSIPQPRVAEWWPDPAQDPQASEATGWPFPRTDLSPSSSPGVATPGRLPQSQGIATDQPSTGQTQALTSQASRLLAKVQSFEELVLAGHLPPQDQIKSLEQLRAAHMALEAEYLQACREELLDPQLDASQGSPRTLNLCRELEAEIYHLGQRLEELQDHMDQTQRETEPCRPDLQDSTPTMSFLPQSAHLSMPSGPVSLPDGQTYQEPATTTTTSPGSSCTLPINKKLSLSIKTEESPRGLPVPLRDRTLQVEQDFHGLLEREDEEQMGPMKSPDFRPSMARDTYTPVLDTAEVAQRGTKAMVSHQSSLTSLEESRPSELLPRKALLRAGGPHTEEPWMVSPETDSGFVGSETSIVSPFTQTPEHRLSHVX

SEQ ID NO: 1774 - DNA, 60787 bp, Homo sapiens
  misc_feature (1)...(60787): n = A,T,C or G
cttgtgagagcaggccatgtctctgtgcctcagtgtcttcatctgggaggtgtcagggtgtgggtgggggtagaagcagggtggcaccctggccagctctggctggatgggaaggggctgcagagggcacggggaggctgtgcgggctgcgtagctgtgctggcaaaggagagcctgggcgtctgggcagttctgagggattgagccataaagggaagggtccctggctgtggaatgactgagcgggcggagaagccctgtgtgggtggtggggaagaagagtccatcccacccaggaactgaagatagacacctcaggggtctgttagacccttgagagagcaggggcagtggcggcttgggtgtaagaaggagatgtgcagaaggagggtgcagtggctgctacttccttgtggggccagtttctccagggatggcggggaccctgaactccatagccctccccagctcacactgctggagtcttcaccaaaccccactcactgccttttaggagcagccctgctgccctaacgagggctggctggaacaactctgcctttatctggcatgcagggacacctgcccatagctctccttcaaggtcaggccatactttcagacctacgtgcctttgcctccgtgctgttcccgctgcctggaatgccctccccagtcttctcccccaaatcctcattgtttctcaagcccaccttaaagcttcctttggtaacacttctgtattgtactaccccccaccgtttaaaatcttggaacacttttactcttttctatattctttgcatcttacgtagcgcctggtatatagtaggaagtcatagggcttttttaaaaagttaatttgcgcccactgggtgctcagtatgtatctttgtactttgaaatgtgacctcagggaggaggagagaggttaacagttctgaggctgttgcccttagaagctgagtcaatcagggacttcaaagctctttgagtcccataccctgcctcccaacccaccctagcagggtgatatccccttgcgatatcaagagcaggtggtactttctctattttacagtgaggaaaatgcaagcccagctatacacagtgagtaacagcagccaggactagcacctgtctcctgatgcccagcctgcttctctatcacagcatcgtcccagcctgaggttggcaggtagttggcactaacgtgtgtttgttgactgactagctgactggccagttctggggctttgtggtgaggagggccatggctcgcatggaaggcagaggcctggctcaggaaaggctcactggtttaggcgcctgggggcaagtgcgaaactctagtcagtcactgcagctgcctctgacgtgcaccttcccctggttacagtgagatttctgccacgactgagtcatcccagaagacaggatgttcctctttgtgcacccagagggctctgtgattgggcaggctgctctgtggcagagctagaaaaaaagccctttaaaaagtcaaaaaaccgcacacctcccccggccccttcctcagcagaggcttcagaatcagaaaagcaacagctaaattgtagcctcttctccacctgccataacagcaggagccaggaggcctagtgaacttcaaagggcaggccctgcctgaggccctggtttaaaatgcagattcctgggccctatcccagggccactgagtcaggctctctgcaggttgtttcaggaaactgcacgcttagaggattcttaagcacactgaagcttaagatccctggcagggatttccaagaagggtacaggccctgcagaaggtatgagaagcaaggattagagcttctatttaaaatatagttgaccagctgggtgggtggctcatgcttgtaatcccagcacatagggaggccgaggcaggaggatcatttgaaacaaggagttcaaaaccagcctgggcaacgtggcaaaaccccatctcgacaaaaaaaaatttttaaaattagccaggcatggtggcgcatacctgtggtcttagctactcaggaggccgaggtgggaggatcgcttgagcccaggtggtcaaggctacagtgagctctgattgccattgtactccagcctgggtaacagtgagaccctgtctcaataaaataaaatacagttgatccttgaataatacaggggttaggagtgcctcatgcagtcaaaaatctgcttataacttttaactcccccaaaactttatcaatagcctgctattgactggaagctttgctgataacataaacagttggttaatgcatattttctgtcttatatgtattatgtactgttttcttacaataaagtaagccagagaaaagaaaatgttattaaggaaatcataaggaagagaaaatctacttactttcattaagtggaagtggatcatcataaaggcctacatccttgtcatcttcacattgaggaggaggagttaagggggagattgatctactgtcttaggggtggcagaggcagaagaaaattcacatataggtagacctgtgtggttcaaactgtcattaagggtcacctgtatatattttctttttcctttttatttttagtagagacaggcttttgccacgttgcccaagctggtctcaaactcctgagctcaagtgatctgcccacctcggcctcccaaagtgctgggattgcaggtgtgagccgctgtacctggcccattttcgattgcatctttttagaagatcacttttgaaaatactctttccaatacatgtaatatattagcgtgatgtgttcgagcaaatatatttttactgatggattgtgtgattaaaaaaatattggggtaccactaggccagaattgacagttgcaaatcttgctgtggcaggaagtagctgggtgatcttagccaaattctaccctcatgtttgtaggagggcagattgagaatttaaaagtaaagcttcaacccaggctggcgccgagtgggctcttcacatgtggtagggactgtggggctggaggacaatacacagggtgatctggaggaaattgtagggctctgcatttgggggtagagaggaagactgggcggggacagaggatagaagccccgaacacccatccacagagcaggagtcgcagccaaggagggaagaatggtattccctgcacctccctcctccagcccttgagaagtcagcctttcccgggctgcactgttccctggggaactttgtgtccaaaaatagttgcctgctgacttttctcagccacacaaatcaagcaggatccaagtgttcatgaggataaagggacaaacacagaccttctgtcctgggaggcctggagtcatactgccttcaacacagcatgcaggggagaaagcccagactgtgggccaggaggctgactttcacccctgccttgtcctgacccctgtgtggctttaggcaaggcctctcccctctctggatcccagtttccccatctgtggaagaaggcctttgtgtgagctgctctgggggccgctgcactgatgggctgcagttctctgaaccctccatggcagggagctccctgggggaccgtgcccactctgggtcagctttgcacttcctgggcctggctcagtgctggcatagaggaagcgcttagggaaatagcaggagcgtcagaaggaagaggcaaaaggagatgagagggagaaggaaagagggaaagaaggagagggttgagggaaggcagcggaggagcccttctctggctaccctgttcctgcagcagccgcctgacgggtcccccgtgtggccagcctccctggttcattctcccagagcagcccaaggggaacttttaaaccacacctctgatgggctttccctgtgttcaataccccagccatcggcggcgaaaccactcccaggtccaggaaagcccctggtaggcttgctccccgcccccagctcgcctcactcctcactcggaaggcgttttctttaaattgaggtgaaattcacataacataaaactaaccatttttaggtaaacagttcagtgacatttagtatattcacagtgttgtgtaactgccacctccatctagttgcaaaacattttcatcacttcagaaggaaatcccatacccagcaagcatttagtgcccgctctcctctcccccagcccctggcaaataccagcctgctttcactctccaaggagttaccttgcctggatatttcctatccatagaatcacactatatgtgacctttgtcgcatctttcacttagcataatgtttttgaggttcatctatactgtagcatgtgttgggacttcatgccttttcatttgagcacctgtttttcaattatgttgggtacaggaatgctacctttttttttttttttttccttttgagacagggtctcactttgttgcccaggctggagtgcagtggcgctgtcatggctcactgcagcttcaacctcccgggcttaagtgatcctcccacctcgacctctggagtagctgggactgcaggtgtgcacaattacacctggctaatttttcgtagagacaaggttttaccatgttgcccaggctggtctcgaactcctagactcaagtgatccactcgcctcagcctcccaaagtgctgggattataggcgtgagctctcctacctggcctggaatgcttttttcatcatcctcccccacctctcaatctgaattcttaccccagtgaggtcagagaggattcttggaggaaccggcttctaaactgggatcaccagacttccctggcctgtgtcagggcagcccccgtgcctcctccagcacatctcacctggatttgtagttgcctggtgatcgtctgcttcctcctgggccatcagttctcccatgagcagggcctgtgccccatgcccacacgaagagccagtacgcagtaacactagctagcatgcattcaacacctgttcgttggtgcactggccactgggctcctcatcctgtgtctcatctagtttataaaaccctggagggggccgggcatggtggctcacacctgtaatcccagcactttgggaggccaaggcgggtggatcacaaggtcaggagttcgagaccagcctcgccaatacagtgaaactaaaaaatacaaaaattagccgggtgtggtggcgtgcacctgtagtcccagctactcaggaggctgaggcaggagaattgcttgaacctgggagacggaggttgcagtgagccgagattgtgccactgcactccagcctgggcaacagagtgagactgtgtctcaaaaaaaaaaaaaaaaaaaaaaaccctggagagagagaggaattattatcccagctttattgatgaagaaaatgaaggcagagtgacttgcccaaggtgacacagcttcgggaggacacaaccaggagttgaactggggctaattccagagttcctgctggtaacttcttgttccgaataaaagaggggatcaggattgattaatgttctctcttgaatgtgtccctgacagggcacaggcaggatggccgatgctgacaggaaccagcggtgactctggggcccctggcagcagctctgtctcctgaagatgaagtggcccaggtgaagcccaggccagccccaatggccagctcggagactgagatccgctgggctgagcctggcctggggaagggcccccagcggcggcgctgggcctgggccgaggacaagagggatgtggatagaagtagttcacaaagctgggaagaagagagactctttcccaatgccaccagccccgagctcctagaggacttccgcctggcccagcagcacctgccgcccctggagtgggacccacacccgcagcccgatgggcatcaggattccgagtcaggagagacttcgggagaaggtgagactgacacccctccccctacagtggtgtcctgtccccaaaacatcacacgttcttttttttttttttttttttgagacagagtcttgcttcattgccaggctggagtgcagtggcacgatctcggctcactacagcctctgcctcctgggttcaagcgattctcttgcctcagcgtcccgagtagctgggattacaggcatgcgccaccatgcccggttgtattttttttttttttttttttagtagagacggggtttcaccatgttggccaggatggtctcaatctcttgacctcgtgatccgcccgcctcggcctcccaaagtgctgggattacaggcataagcccggccatcacacattcttccagggaggaagggagtggacgctgcttcagcattttcaattaaattctacaaagtctgtaattaaaaatttttaaagatttaaattgtatacataataccattcattgcagaacaaccggaaagtataagcacaaaattaggtaaaatttaaaattactcattgtcccactccatcccctgataaccactgttttccatatgtgtagatatgcaaatgtaatgtgaataaggaacagtattctacatgcttccttgtaacctgctttttggttaacttaatagatgtgaacattttcgtagttcatcaaatcctctcccacaagtgattcctagacttccatggatattccatggttaattggccagtctcctactgctgggcgttttagtagtttctagattttgctgttataaataatgcagtgatgaatgtcattaatatatctttgcacacttgatttgatcatatctttggtaatttgaattacttagtcccggggttatgtccatttttgactttattttttttttttagtgaggcagagtcttgctctgttgcccaggctggagtgcagtggcatgatcatggctcactgcagcctcgacctttctggctcaatcaatcctcagaactcagcctcccgaggagctgggactacaggtgcatgccaccacacccagctaatttttgtattttttgtagagacagggtctcacagtgttgcccaggctggtctcaaactcctggcctgaagtgagcctctcaccttggcctcccaaaatgctgggattacagatgcgagccgtcatgcctggacatttttaaggttttttaaaatcccaattagcaatgggaacgttggcatttcttgttttctacaatagctgtgttctggttgcatccagaccaacttagactgaattcctagctttgcttagcaagttccttctgcctgaatcttgctttttccatctataaaatgagaggaatcatatcgtggagaatagtaagagctgaatatatggtaactattgcacttagattatgagcaagatgcccctgttttagggtcctgtgactcccgcaggctggtgtggttggtagagaagcctcctctggtagtggattgtgccattactcaaagtttcacacacctgatctgctcaaagtgggcactgcccactgaggagccatttctgagctctctctccagcaggggatggtgactgagatgcactgggtcgacagggcagaggcatctcttcctggggtcacatggtaaccccctgctatgatgtaacagctgctaccttgtcctgtgcctttactatgtgccaggcacagggctgggcagggtctggccctctcttgttccctcctcaccaccctctgtcaggtaggaggaactatcctcaagtttgactatggattgccagagaggtcagcagcttgcccgtggccccagtgaggggtgataggagccagaattgaacccagggctccctagctccaaagcccaggccccttcacccctagtacgtgacccctagtggtggaagcaaactcacctgcatggctggggcctgggtcctaggtccagggaaccactgggtgatctttggcaacttacgtaacctccctgggcttcaagtatgctgctgtaagcaagagtaacttgctgaaggacatgttaagtggttaagagacgtagaggcatcaagggtaggggaaagagcatggaggaacagagagtgcgacaaaggtgcatctgcctgaacagagagtctatgcctggtggtacccaaactatgtctcatgaaactttggacttatccctgaggtcaacacggggtctagagcagagtgggtgctccataaacaatgactgcatggatggtggttagatgcatggatgaatggacaggtgggtgatgaatgggtgcatgggtgggtagatggatggatgttgggaggaaggatggcgggatagatgggtgggtagatggataaatatttcttgagtacccactatgtaataattacaataactatctatttcctgggggctttatataccttatcttcctctctccctccttccttccctctcttcctcactcacctcccttttctccttccttctgtttagtcaacaaatagtgtcaggtaccggcactgcaaatataatcatgaacaaaacagagagcatccttggcttcatagaacttgcagtgtagtgggcgagacaaatgtcaatgaaacaactgcacaaataaatggaaaactgctgctatgataagtgttacaaagtagagggagccagtcctatgagggcctgtaaaagggagaacttgacctagtcagggagagctaagtcttccttgaggaggcagaggttgagcgaacgcctgaaggacagataggagttaactaggccaaggaggggagagaatccctcggcagagggatgcgcacatgcgtagcccccatggtgggaggagcgttgtgtgcacatagcaggagcagggggagcttgaggggccatggagagagatggatcaggagagctaatggggccggggtggcagcgaccttaggaccatagtgaaggttctgcttttcttccacaggaagacatggatgagttttcagatgtgggatgtgggtgaggatagaggagatggttaggtggctactgactgcagttagccagatgagaggatgggacgcgagctaaggtagtggtggtagacttcagagcagtagatgagtttgcgatctttataggaggtcccattggacaggaccaagtgacagaatggattcagggggttagagggagagagatggcaaagatgcctcccagccttctggcctgtatgcatagaggggatggtgttgccgtctgctgagatgggagacactggagggaccatccaccgggtttgggtttgagtttgagtttgaaggacctctgagataatcagatcaggtatcagacaagcacttggctaagtctaccaccaccttgggattctttccatccccacgtgatgaggaaatggaagccagagagttgaagtgacttagggtaagttacaaggtgggtgcagagctggtatatgctaagaagtgaatggcctgtctttccagaggctgaagcagaggatgtggacagcccagcaagttcccatgagcctcttgcctggctcccccagcagggccgtcagctggacatgactgaagaggagccagatgggaccctcggaagtctggaggttgaggaggctggagagagctcctcaaggttggggtatgaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggttagtgggactcatggctgtggatgtgtcaccaaggcccctgttggcttggggtggaggctaattggggtggggaggcctggagtagaggctggctggggtggagaggcctgggatagagcctggctggggtgggaagccctaggacggaggctggtggggtggggaggcctggggtggaggctggctagggtgggaagccctgggatggaggccagtggggtggggaggcctggggtggggagccctggggtagagcctggtggggtggggaggcctggggtggaggctggctggggtaggaagccctgggatagaggctggtggggtggggaggcctggggtggaggctggctggggtaggaagccctgggatagaggctggtggggtggggaggcctggggtggaggctggctgaggtggagagccctgggatagaggctggtggggtggggaggcctggggtggaggctggcttgggcaggaagccctggggtagaggctggctgcggtagggaggcctggggtttgggccaggaactccctgctggtggagggagggtgtacctggagccctgagatacacccaagccctttgctcaaaaagaccagtgattgtactcgtgtttcaaggatgatctgtttgcttcttttcaacttctgctataaaaaaattaaaacatatacaagagagaagatcgtagaatacactcccatgtacctaccccccgcatccacaattagcagccccgaaaacctttctcgcctgtggccttacctctcccctattcacccccactagattattttgaagcaaaatttcaggcatccaatccttttatctaaaaatgtgttagtgtgtgtatgtctaaagataaagaccttatattaaacataaccacataccatggtcacctaaatgttaacaccaggtccttaaatatgaacaaatatcacacccgcattcagatctctctgtgtctcataaatggcttattcgttcccgtccatgggcctcaggatccaaacatggcttgtatattgcatttggtgcctttcaagtctgtcctctccctttgtctttttctttctttctttcttgcatttactttttcagatctcttttactctcttagtccgtcctccttcttacttctgccgtgcaattcatttgttgcggaaatcagtctgtcctgcagagtcgtccgcagtctgggctttgctgatgtgctgtggtctcttttcatgcgtcccattgtcctctttttcttgaatattgttaggttttgagctagaggctttggtggtctggaggagaaacatgaccatttcccttccagaccatgagctccacgggcgtggggagttttggcaagagcacgtgagtgcctccttcagtaagcacaggatgcctgctgctctcttgttggtgattttgacagcctctgatggtcattgtcttgggctagtctttcatttgaggtgacaaagtggtagtatgctaatgctctcattcctgcattaattgctggaaatatgctaaaaagtaaaagtgtccctcatcaactacttggttaccaagttcttgttcctatgggaagggccagcgagatgttccgttctgtccttttactgttaccgttactgacccataatggtacttacttagttaccgacccgttttcagaaggagtcagttcctcacatccttcaaaggtgacatgcttttccttttttcctgcaatgacttgtttttataaagttctttggacttgtttaagataagtgactctgagtaggtggaacagtgattttaagtcttctatttctctgccatgggactcttgggtgattcattcaattagccattgaaaatcaggtacttcttaagcacatgcttcttaaacaccgacagtgcagcagggggaaagaaagatatgggcctcaccccacagagccaaccggtgggcagggcatttggagaaataaaacagtggcagccatctgcgacatgggttatgtatcaaggtaaaccagccagaggccctcagtctagacccgttgtcatgggggtagaagagttgtcccactgccctctcatgctccagaacttgaacgtggtgggtctgtgttgcacacaagcctgaagattgctcagctcggatcccaccattgaatgctttcctctcaggaacccagaagcccttatggaagggggtttgctatcagggtctcccagcaaggaggggttcattgtgtgcctgcgcatgtgaccgtgttgctcccgctttctgcaggaagactaccacaggctcctcaccaagtacgctgaggccgagaacaccattgaccagctacgcctcggggccaaggtaccaggccgggatggggtggaggcatgggcccaagtccccgaggaggtgacacttttccatagtcctagagaaaggccactgcctcctccatctactgaggccctggagatagtggaacgccagttttcttctaccccaaggtccctctgtgaccttgggcagtgaccttgccttccctgggcttttttttttttttttttttttgagtcagggtcttgctctgtcacctaggctggagtgcagtggcatggtcgtaacttactgcaatctcaacctcctgggctcaagggatcctcttgcttcagcctccctggtagctgggaatgcaggcagtcatcactattccctgctaattttttttttttcaatgttttgtagagacggggtcttactttgttgcccaagctggtcttgaactcctgggctcaagtgatcctcctgcctcagcctcccaaagtgctgctgggattacaggcctgagctaccatgagcccaggaatttcatgagaatctctctccttctagatgggttctggagtaagaccacctgggttcgactcctggctccattgctaaccagctgtgtgaccttaaggacgttacttgggctctgtgagcctcaaaagagtaacacagaatttctgctcagcccctggtgcttgttttttgggcctgaatcttcctggatcacacctttgcctttctccctccccaccacctcaccacagcctctcccctcccctgaacagcagtatggggcaggaggagagcagagggggaacccaccaccccagcccccaccccgtcttcggaggaggctgtgaattctgcaccttcctcttttctgagtgaggcaggaagtgggacctgtgcggcccctcgtggcttcctgcttttgctgtgccctcctcttgcctcatcaggcagcagtagaggaggatgtgggagctgaggtgcagagatgcagatgccccagtgcctccccctgtcatgctccaggaccctgcccctgccacagctgctgctctcaatgtcgagaggcacttccggggcaggtgggcggaggccactgtggtgaggaaatggaagggggcctgttctaggaccaggaccccccccccccccgctgcgtccccacacctgctgcctggcacaggcaggacccttccctcttggcctcatcgggcacatctgtaaaagaggggctaatcagacttcctcctgggagccaagcaggctccttccagctttctgaaccactgagccagatccagggttggaagagacgggggagttgggaaagggagggaaggggctttgttaggtcatcctctctggggaaaccacattcccatggctgcagactccaagtaggtccaaggagaaaggaactggtcatcagacccaaacacttgggcttccccatttggcagattgggaaactggggctcccgttgggataggggcctctgaaggtcatggagtggcgggggctggaggcgtggagcgtctgcaccctccctcctcccttccttcctcctgcactcgtttaagggcatgagtcagtatacagaaagcatttacctggcactaggcaggcactttgtaagagttagggaatattataaaggtgtttactgccaggcctcttgtgtgccagccacagtgacaggcgggggtggacacgggggagcacagctggggtatctcctctcgtgggtgctcccttgacccagtaggactcagggtcccccccatgtgtagtcaccctgccctggccagcacccagacccctggctcatgtgtgtgagggtgtcacaggagaggccagaaatggttctgtgccagctcactcactcccgctttctggaaaaatgattgcttggcccgagggctctgctccctcccccaacccctctctcagcctcaagaagtgtgagcaccattcagggctctaccggaaggaagcaggatgatactatcatctcctgcccaaccccatctcacagctgccctgaaggaacagtacacggcaggcttgcagctcctatgtgcagaagagaacacagagccccggaacagggaggggattcactctgggtccatggggcttgaggggagctgagattccagctggccagtgcctcactccatctggacctctgtgcactctaccccgaaggctggagagaccccaggatggtcttctgctcagaacccacgagttcagaggcagtcctcagaacccaccgagccatttcactctgctcagagcccacgggggagggctggacccacctgggagggagccgcgctggggatgttgcgctggacacccaggctaggcatggtgggtaggtggacagcaatggatggggacccataggaaggagattgacattcactgagcagcaacaggtatcccaccccagcttcagggtcatatttgagcccctccacacacacaccaaggcacagccaggtggaatggtttgctcaacatcccacagctggtgcaacaggcaaagctgggactgaaacctacatctccctgattccagaacaggtgtttctttcctcatgcctgggtaagccctggcactcaggccctggcactgggtgtggagacaggcatagggatgaggtggattgatgactgttatagtaataagaatggtcataggtgatgtttatggaccactctcttaaataatttgcagttggggaagctgaggcacagagaggttaaataacttgaccaagatcattcaacaagtaggtgccagagcaggagttggaactcggcagcctagctctgaagcccacgagtgacaccacactctagcagaactagacttggtagttgcgggatctgcagctggggaggcctggcccaggaacaccgatgggtctggagccttggggttggggcaggaccagggagcccagctgtggggcagggagccaggactggtcaggagtcactggtgggctctgttctctacactggcctctggccagggtttatagtgatctcactgcatttgctgccatgttgccacctcccccccagcccctgttcctccatctcagctgaagagggatctggaagagctgaggtgaccagaaattacccaagaaggaattacggagatgatgtaaaaccacctcttttcagtgtgttctgatggctgcaagttggtctagaagcccctgggtggggatggggggagggggaggcttctgtatgcagatgagttggggaaacattttcctctctctcttcctcctcccctccctccccattcataaagcccattagcattttaaaggctgagagaaatccatctgtgcagagaatattcatttgtttaacccaatgtttcccaaattcactagtcctcccttcacagaatcctgattcacctttcacagaatcccccgagggagtgaatccagccttggggagcacccgggacaccctggctgtgtccagagagaccagccctgggagggcctggccggagcagctgcagctgccacccccacccccaccgccactccccacctcatcgctctgcctgggcatctgctcaggttttgggcttctctgcttcaaactccttatcggtccctgaaacaaaagggcttcctggcttccctggcccatccccattccctgtcactccctaggtggggcctgaggctgagagaggggtctggggagggaaacatgtcagagggctgggcctcccctgggatttgggtcacctcaggagaggggtgctgataggaaaggcccccacaggggagtctgagcagatggctgaggggattattaaaatccagctttgttctcatctggggaggctgggcctgaaagagggggaggcggcggggaccatgccacacttggagttgatttttcggctacagccgggacctatacagcttaagcaagagagcctgcttgcctgggggccagggagccccttccaccaggcccaccctaaactgctcattcctgaccttggtgcagtgggggcagttaagataaccccccaacatcatgatgagcaaatcccactaaggggtgttgcttttccacgggcctgtctccatggtggctgtgcagataatgatggtgatgacgataacggtgatggtgataatggtgatggttacgatgatgacggtgatggttatgatgatgacggtaatggtaaaaatggtgatgatggtggtggtaatagtgatggtgttggtgataatggtgatagtgatggtgatggtaatgatggtgaatgatggtgatggtaatagtgattgttatggtgctgacggtgatgatggtggtggtaatgacagtggtgttgatgatgctgatggtgatgatgctgatggtgatgctaatgatggtagtggtgatgacggtggtggtgaagataatggtgatgaatgtcagggtggtggccactatttattgagcacttattttgtgcgcagagaggttattaaaccaactaggactcagaggtgtgctgtggtagagcctagacaggaacctgggctctagctgcagagcccacatgctaagccagagttggcaaactttctctgtaaagggccagattgtgacaatgtttggctttgtggagcatatagtctctgtcacaactactcaactctgccaccagagtgtgaaagcagccatagacaacacataaacaaacaggcatggctgtgttcaataaaaccttctttacaaaaacagaacatagttctctcaactctgctttaagctgttgaacagcctgtggtttccctctgctttccagcttcaagaggccttccttggtcacctgcctgactccagactgctccctcaccaactgggctggctgccatgttaaatccatcctcaaatgatagagatccgctaccaatggcagattagtttgtttacttgctggttcactcattcattcgaatagctattagttgctattattatcagtataataattattagaaatgcttatatttgttaagaaataattatatgttatatggtatattaattatgatataattataacacacattattaataaaaaattactgttaataggagaaccataggtgttggggtcagatagagcagtgttgtgatcctcatccaaggacttatcagctggggattttgagtaactgacttaataacctctctgtgtctcagttttttcttctatataatgggctgttggggtccccaccctgtcttcctttcaggactgccattaagagtaaatgaaaaggcatgcagttcttcacctgtgtttggcctagccaagggctgcactgaaagatggtatttattactacagggcatgtgtgttgagctcctgaatgaagatgaggcgtttcaggtgggtttgcccctaccctgacttggctgtgctgtgcctccctgcttccacaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcaggtgagtccgggagaagagctgcagctggaggctccttctgcctgggattctgctctgtgggactgacttggttcaccctggggatggcgctggcctcaggccaggggaaggagggaggcaaggccccaccctgggcactttgactcaaaagggtcagagatgtggaaagtgtcctgctttgatccacagcagcctgggggcagccctggccctgccacttggcatcttggtgaccctgggtgagttgaaaacatagagcattgtccctggggagcccatatctcagccaggccctgtgctaagccttgacacatgtgacctcacttaatccccacaataacccgctgaggtgtgcactgttgtcacacccatgacagccaaggggaccaattggagaggtgaggacacgctgaagttcatacagctatggaggggaagtgtctggattggaactcacgtctccctgtgtgagagcccacgctgttgactgggaacccagaggcctagcgtagctctgctccagccaaccatgtggcctggggcagatctggaccttgttctcccttgtaaatgggggacaatgttctacccagcccacttcctggggctgatgtgaagatcgcacatggtgactgagctataacttgatgatggaggtggtggctttgacgttcagcctcagtccttcagctcctggaaggactgttcttggccccagctttcagcagttgtgtattccagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtgagtggactcccagctttgcccccgagagacttaactcacctggagaacacagaacctctgcctgcttgggtgagaggcactctgggagtctcacttgtcattcccctgcctctgcaccgagttaactcagccatccccaaaacatgagcccctccctggttttagaggccacacagctccagcctcctccttgtcaccagtgctaggtctcacccccctttttggcaatgcatctcatccaaatccctccacttgtgcttggaagtgtctctaggctggctcccgggaaactctgagctctttcaggattctggaagggtaacagaatctccactctaccttttcctcttcaggataagttgcctcactttcttagttcattttattaaataaatcaattcctagttacttctcaagggtcttcgtatcttcatcaaacagtccaagtaaccgtgaattgtttgcaggtctgtttataactgtacattggctttattccagaagtggtttaaagcaccttatgaaaatacatacgttttagccacattctgaaaacagaagtgagaaaactggggcagagaggaagtaagggtagaaaaaaataaaatacgtggagtgagtaaataaaatgttctgttggaccctaagcacattagagtcacacatttagctttgagcttcctagttgccaatgccaaaagagaaatgcaatagttacatgcactaccatgctcataaaacaaattctttcagaagcaccaccattttattcttcccttcccttccctcctctcctctcctctcccttcccctctcctcttctcttctctcctcccctcccctcctctcctcttccctcccctcccatctctccttctttcccttgctttactgaaatataattcacataccatgcggttgactcatttaaagtgtttgcttgcttcagcggtttttagtatatttgcagttctgccactatcaccacagtcagttttagaacattttcatcacgcactaagaaacctcatctgtattaggcagtcactccccatcccctctttccccagcctccgtcggctgctcttctgcttcctgtctttataggcttgcctattgtggatgtctcatagcaatagattcacgcaatatttgtcctgtgtctgacatctgtcacttaccatgatgttttcaaagttaatccttgttggagtagcacatacaagtacttcatttcttttcttcttttttttttttttttgagacagagtctcactctgttgcccaggctggagtgcagtggtgcagtcttggctcactgcaacctccgcttcccgggttcaagcaattctcctgcctcaagcctccctagaagctgagattacaggcacgcgccaccatgcctggctaatttttgtatttttagtagagatggggtttcaccatgttggccaggctggtcttgagctcctgacctcaggtgatatgcctgcctcggcctcccaaagtgctgggattacaggcttcgtttccttttgccaccaccattcttggttccgtagccggagacacatttcttcttcgtcctatatgttgtccacaaaataaagcaatgtcaaatcatcacactgagcaggagctggggccttagctgacccctcatgtctagtgctgcacggtccaattcagaagctgctggccacatgtgactgttgagtacttgacatgggctgctctgaattgagacgtgctgtgggtatgaaacacatgccagatttcagagacttagaaatataaagtgtctccctatttttttagtattgattacatgttgaaatgatatttggggctaaataaaatataaaaattaattttacctgtttctttttacattctcaatgtggctatgagaaaattatagatggtgtagctcacattatagttctattttatatattataaaattatgtaatatgattatataatatacatttctatatttcacactgatctagagctttcttaaaaccgaaccttacatcatcccttgcctttttttgtaattaaacttttttgagcaggtaatagatgcccatgataaggacctttgcacagtacagagggcatattgagcaaaaactaaatctttcctccaacccatgcaaaaatgttcaatgcacacacttgcatttatagaaatggctgcataagctactgtaccttgactttttgaagtcttaaatttgaatatttatttttgggtaggcaacgaattcacattgttcagatttcaaaggatgcaaaggacatgtagtagaaaaatctacttctcattcctgtcttccagccacccagttctccttcccagaagcaattcatattttagtttcttgaattcctctagagatagtatatcgtatataagcaatgtatttatcgttttcctttttactctccacatattctatacagatggtagcataccgtaaacattgccctgtaccttgatttgacactgaaaaataggtcttggaggcattaatagctcagaacatacacgtgtgccttcctcttgttgatggctgaatactattccaccgacaggcatttaggcaatttcttgtcccctccctactgttcatgctgcagtaaatatcctgactcattagtcttgatgcacatgagtgacttgctttgttgtcagtaaattcctgcaggtttcacttcaatttttctcaaggctaccatgcctggggctggtggtagaagctgttcccagcacccacctctccatgcttggcagaaaccccacatcctgaggacggacccagctcctcttaccaaggcatagatgtggctgggtgtgggagtctacaggactggattaatggagcatatttccttcccctcccaatgtccaggtggagtcctttgaaagactgatacaggcaggacgtctcatgccccaggaccaagtcaaggtactgcccaattcaggagccacccatggaactgccagacaaccactgtctcccatgactctgtctctgaagccttctttgctgcaagacagaaaagagaatcccagacacagggtctcttttagagcaaacagttcctgagtagcttcccatgataacgatcattatttcacaatagttacccattattaagcaaggatggttgtgtacaggaactgtggtaaaccctagagtatgttattttatttggtcatcatcaaaacccagtgaagcagttacatttatcaccctcatttaaccaggatggaactgaagctcagaggggtgactcaaaggccccacagctagtaggcaggagaacctggagccaggtctgtctctctttcaaatccagggtcataatcactgccctgcactactttccacaaattatcctgcctctcagcaagcagaaaaaggccttttcttttttatcgcctttaaacaaaattacaaaatagttgccaaaagtttggaaaccctgttaaaaaaagtgggggctggaggggagaccctttatagagtcctattggtgtatatcctttggaatttggagttttagataacggtggtcataaatacaatttagattcctgctgcatcagccagggtcccattaagggacaggtggggctctcaagtctgggagtgtaggcgtcaaaggagagaactgtcagcaaaggtgtgggcagcatcaggggacccaacaaagactgaggaatccccgggtagtagcattagccgggagctgtgcccactctcaagtctctctcttcccaccctgtgatctctcataggtccctcccactagacagacccaaccagaagccagcaggtagacagccctgatgctcaaagcacagagcagggtgggagaggagctgagagaaggtctggagaggcaaattcaaaacacctagtttctaaaaaaatgttatggcaggatatttcctgtgtggttacatagatgtcatgtacattttccaatcacaaaatgtgtcatatgtatcatgtaatatcatccagtggatgaccaaggaccttataaactaaaaccattcatttttttgctctctgttctaatccccccatatacagggaagttgagagctgtcagaagattagatgtgaccagggaatgggttttaggttgtgcttggcttctgtctctcctcagagttgagtgggatgtggatggtagtaagacagtgataccaaccccaattcctgcagctttagccatgtattacctgtgatcctcctatgggagcctagcagaattgctaggaccatgagctctggggccagagggcctgggcccacatcctgtctctacaactcactcactccatgaccttcatcaacttaagtgacctccctgtgcctcagtttcatcctttttaaatgaagatgataaatcacccctctcattatgattatattgaagattaaataaatgcaaagtgctttagcccagagcctcaatgctcagtaaacattctcaataatgtgatggtgatgataacattatcggtgtcgatagtctataaggatttggggaaagagtggctaattttctgaagcccacagttttgcaaatcaagaatgaggatccagagtctctcatgtaaagggtccttatggagataatagtgagagtgtatttgacactgtgacagctatgacagtttgtggtacattggggtccttgtaagtctatgcaggaagggctggtgccctctggagctggtgccaagtctctgagttgtgtctctgttgtgccagcctgatggcagagagcttgaccacggcagctctccagggcaggcagcctccagagatctcaacctcagcctgtatcttgcatgaacccaggggcccaggtgcatcccatggcctcccgcaagctgtctcatccactgtgtcttcagggacaggccccgcggggactgagcactcaagtcttcctggcctggtctggtttcagggcttccagcggctgaaggctgcccacgcggccctagaggaggagtacctgaaggcttgtcgggagcaacaccctgcccagccgcttgccggctccaaggggacgcctggaagatttgatcctcgcaggtacctgctggggtggaaggcctggaaggacagatgggatgggcccctggggtccctcagtctccaggagggaggcactttgtccttataatttgtacacggggaatagagagaaatcttatcctaattagtatacatatccaaatggtggcacgatcaaaagctgtgatttgagtccctttggacccacgtgctgagaagatgccttgaaacccttattggatgatggggaaactgaggctagatgggggtgggatttctctaatgtcccacagcctgtggatggcagaggggacttgggctgagacctcctgattcccaatggaaccttctttcatcttgcttattttgagttctcaccatcatctaaaggctgatattaaatggaccctaagggggcatcccctggagtctctgctctgatactctgttcctggacctgcctgatgtagctgccatcttgggctcctggtggtaatgtttctgcattccagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgaggtacctcttggctcaaccatattgggctgttccctcgtgcattcatttcttcgttaattcatttcttcaatacgtattacatatttatgaagtgtgtgccatatgccagtgtgtgccaaatatgtaaatattacatatttatgaagtgtgtgccatgtaccatgacacatggtagggattcagtgggatgggaggtggcagggaaggtggcgtctaccttcacagagttttctgtagagttgaactggttacagtgatttagttataattttggtcagtgcactgaaggagaattatggggttctgtgagagtagcaggagtaacatgactgagtttgaggaggaggtcagagaagctttccctgaagaagtcatgtttaaatgagacctgagactaagtaggaattactagagacagaaagagaaaacccatccagcagggaaaacagcttgtgcaaaggccctgtggctagagtatgggaagagaaaggaaaaatagtctgagatgtggctggagaggcaggcaggggccccatgatgtaggggcttgtgggtcacgtagagagcatggccttaaactctgctggattttctggcaggggatgacataagatgacttgtgggtaggccagtctgaggctggggaggtggcagggcaaatggagaagcatgtgtggacttaagagaggttgggaaggtatgtttgagtggacttggagtggccgtgagagggaggaagggagacacggatggctccaggtttctagcttgtagtactgcatggataatggggtgaaacctagacaagagccctacacaaaaggggctttgtagaaggctgtctggcccacaccacaaccccttgagagacaatcactatctccgttttgcaggcgagcaaattgagtgtagtgcgttcacacagatgacagtagtggggtctctatgcctcccaactcctgttgcctgtgctgcaaagacttgtctgttgaggatgggagcaggaaagagagcctggcatgctgggtagggtgggacactggtaggacatccctgacagctgaggtcatgctggccctatggtttggggaaaatcttgtgctgtgctctggcctagagggtaggaaaactctaccaggtgccactacacgcttgaatggggagaaaacctgagtacaatatcttaagggaccctcatgctcctgcagttgaaggtattgcagggggctggggtggccatgctggaatggatgggggtcaggagagttaactctggcaggaaatctaggtttaaatctcaactctgctccttgtttctgttgactttgggcaaatcatttgagcgtgagttacctgtctataaaatgggttgtaataatcgtaggtactggtgggattgttgtgacatggtatctgtatggtgcctggcacacagcaggtgctcaattcatggcagccagtatcgaagaccacacagcccagtctccatagtttacacatacataaaagggtggtgggcttagtgagtctaatgtgcttcttaccccgcagcccacagctcgagcctggcaggaggtaagtgcttaaaagtggtgtttaactatctgctgaatctctgtctgtccatctttctgaccccagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtgagtgccacctggacctgaccagggtgtctggccagcagctggatcttggctgtcccccactgggcagaggtcatgcccctctgtgtgttcttctgcaggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggagtaagtcactgagcctttcctgcagaatgtttggttccaccctaaaaccacagggatgatcactgtcagagtgaataagacagcgcttcacagtttagacatggcttacctgtcctgcctcttcaagtgtggaatgtataccactgatagcccttgaaatgattttgggtagtgtgggacatgattttcagtaggacacatgcagtattaaagaacattattctcagctgggcacagtggctcatgcctgtaatcccagcattgagggaggccaaggcaggtggatcacttgagtccaggagttcaagactagcctgagcaaaacggcaaagccccatctcaacaagaaatacaaaaattagccaggcatggtggtacacgcctatagccctagctatttgggaggctgaagcaggtgaatctcttgagcccaggaggcggaggttgcagtgagctgagatcgggccactgcactccagcctgggtgatagtgtgagaccctgtctcaaaaaaaaaaaaagaaaaaagaatatcattctctttttctgtctctgaccttctaatgatgccaaggagaaagtctcagttagtgctgtggtgtcttttttatttttctttttttgtactttaagttttagggtacacgtgcacaacgtgcaggtttgttacatatgtatacatgtgccatgttggtgtgctgcacccattaactcgtcatttaacattaggtatatctcctaatgctatccctccccccaccccacaacagcccccggtgtgtgatgttccccttcctgtgtccatttgttttcattgttcaattgccacctatgagtaagaacatgcggtgtttggttttttgtccttgtgatagtttactgagagctgtggtgtctttaatgcctctcttgaacttctgtggaaaaagagagagagagacagtatgagagcacacaaggcctagagcatttagcaggcaagtggatctatctagtatatgataatattcaggtttcttatatttatcctcaaagttagtttctgtttgtcacatgacacactgatcttctgttttgaatagtgatctaaaatctttggagtagatggaagtttatggaaatgactgaaatagggaaggtggtatgcaaactccttaagtctgggaaatgctgctttaacatttcctctttggtgttgggtgggttttgttggcatccatattttatagttgagaaaagtgaggttgagagaggggaagtgccttgccctaggtcacacagctagaaggtggcagaaccaggctgggcagccagggatgtctgactccagagcttgtgccctgggctgcttggctcccaggacaggccaacccctgcgtcagggctgcctggcagaactcaaggatggtcttctcttcccatgccagggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggtaagtctccacatgggggaatgggcccagaacctcagggtcattcctgggtcttctcaactttctgcttctgggtctttccttgtgctattccttcttggaatacttgctgctcctgtccctgccagccacaatcccacctgacatgcaggacttatgctcagtgtcaccccccaaacctgtccctcttccggagctcttgttcctcctctgagagcttgcaacccattgcttatacttctctgagcctgcccatcacagctggagagactagttctatgctctttagagtagacatcactgctgcaaagtcacaggccactatggaaatgtgactgtcatagaataatgcatatatatgcatgcatgtgcacttatgcacaaacacacacacacacacacacttctgtagtcctaacgagcccatggtcaggattctctgcactagacatgaactcagcgagggcaggcacctgtgttgctctgtttgtgttctctgtgccgtgtgttaaacccagcgggtaggacctgtacatatttgatggtctcgtttttccaatgccttgggcctgagcatttccactgtcagataagaccatagtattccaggcctaagccaggagacactggaaataaggctttctccctctccccttgctagtccttgtccatggccttgtctctcccaagggctctggctgccacccctcagggaggcagcacttgctgagggtcctcctggggtgcagagtccctgctggtagccagattcttgtgctgaggcctgagagcctgagagccctcactcctgggcctggctgttgggagctgggccagcaaccctggggtgtgagcctctgggaggtgaggccaggccacgatttgggaagggcttcccagtgtgccttggacacattcctcagacataaagggatactgcctctttcaggagacctggatggcgtccccagagacagacagtggctttgtgggctcagaaacaagcagagtttcacccctcacccagactccagagcaccggctctcccacatcaggtatcccgggatcccgccattgtcccgtcagtgccacattcctgggacagcctgggaatcacagtgcctgtgatggcccagaataagagaggatggtctgtccattcgtaggccctcatttcatcccctaaccgtgatttcttgttcctgtgttatggacagaggaaacagagcttcagagaggggagtaactagtccagcctcacatagctaattagcgacagactgggaaattcatttttgttgagcaaatgaatggatgaatgaataaaaactacagggagggcactgtgaggtgaacagaagacaagggcaaagggcactcagggtggctacatggaacccaaagggaagggagaaggcggaggggacaggggtgaagagtggagggatggagcctccaaagctgggtgcaggcccttcaggaggcccacatggcaacccaagggtgcatgcaaaggaaggattagaaatcctatttctcttttatgtattctacacataaactgagctttattattttgcatattgggttggccagtgaacagtttacaaagaattgggcatctaatgtgtgtgtgtccttggaaatattgtaccacccgagatgcaaagttacaaagggtgggagcttattgggttagcatgtggaggggctcagatgctgccgcctgagtgtctcactctgtgtgacccctgtgtgtcccttcctccacggtcccccagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatgggtgagtgcaggagtctgacttggacagaactgcatgggttgaaaaatcaaatagaaaaacttgcagaaccctttaggatatgacatattagccaggttcattgtactgaaatttgaaattacagataacgtggacaaaagggaacaaaagaaaaaaaaatactctggaaaccatcagtgctgacgttttggtgtagaacctgtgagctgttctctgtgccgatataaatgtgtgtttgtttacacatactgtcatgcactgcatagcaacgttttgttcaacgacagacagcgtgcacggcggtggtcccataagattttcatggagctgaaaattcctttggttgcgatgttgcagtcattgcagagcaacacttcactcacatgtttgtggtgatgctggtggaaacaaacctactgcgctgccggtcacatgaaagtacagtcccagccgggtgcagcggctcgtgcctgtaatcccagcactttgggaggccgaggcgggtggatcacctgaggtcaggagttcgagacgagcctggccaacgtggtgaaaccccgtctctactaaaaatacaaaaaattagccaggcatggtggcaggtgcctgtaatcctagctacttgggaggctgaggcaggagaattgcttgaacccgggaggtggaagttgcagtgagctgcaatcgtgccattgcactccagcctgggtgacagagcaagactctgtatcaaaaaaaaaaaaaaaagtacagtacaggccgggcatggtggctcatgcctgtaatctcagcactttgggaggccaaggtgggaggatcacttaaggccaggatcacctgtggccaacatgacaaaaccccatctctattaaaaatacaaaaattagccaggtgtggtggcttacgactgtaatcccagctactcaggaggctgaggcatgagaattgcttgaacccaggaggcggaggcagaggtttcagtgagccaagatcgcaccactgcacaccagcctgggtgacagagcaagactctgtctcaaaaaaaaaaaaaaaaagtaccgtatagcacctacgattatgtacagtacctaatacttgataactaatgactctgttactggtttatgtatttactatactttttatcattattttagagtgtatttcttctacttattttaaaaatgttaactattttttttttttttttttgagacagagtctcgctctttcacccaggccagactgcagtggcacaatctcggctcactgcaagctctgcctcccaggttcacgccattctcctgcctcagcctcccaagtagctgggactacaggcgcccaccaccatgcctggctaattttttgtatttttagtagagacggggtttcaccgtgttagccaagatggtctcgatctcctgacctcgtgatccgccctcctcagcctcccaaagtgctgggattacaggcgtgagccaccgcgcccagcctaaaaatgttaactattaaatagcctcaggtagtccttcgagaggtattccagaagaaggtgttgttatcacagatgacagtgctattattgccccagaagaacaagatgtggcggtagaagacagggatattgatgaccctgaccctatacaggcctaggctaatgtgtgtgtgtgtctgtgatgtgtgtgtgtttgtcttagtttctaacagaaaagtttttaaagttttttaaaaaaaagttaaaaatagaaaaaagcttataaggatatcaagaaagaaaatattttttactttacaatgtatttttaagttaaatgttattacaaaagagtcaaaaggttaaaaaccatttaaaaagcttataaagtaaaaatgttactgtaagttaaacttgattaattattgaagaaaaaacttttgtataaatgttgtaaatttagcctaagtgtatggtgtttataaagtctacagcagtgtacagtaatgtcctaggccttcacattcactcaccactcactcactgactcacccagagcaacttccagtcctgcgagctccattcatggtaaggaccctttacaggtgtaccatttttaaaatcttttataccatatttttatggtctgttttctatgtttagatacacaaatacttaccattgtgttacagatacctacagtattcagcaggcaatgttgtagaggtttgtagcctacaataatgggctattccatctacctcacatatgtaataggtgtgggtaatctatgatgtttgtgacatggtgaaacagaataacaatgtgtttctgggagcttatacccaatattaagtgatgcgtgactatacttaaaacagaaatgaggctgggcacggtggctcacgcctgtaatcctaacactttgggaggctgaggcgggtggatcacctgaggtcagaagctcaagaccagcctggccaacatggcaaaaccccatctccactaaaaatacaaaaattagccagacgtggtggctggcacctaaaatcccagctactcaggaggctgaggcaggagaatggcttaaacccgggggcggaggttgcagtgagctgagattgcgccacttcacttcagcctgggcgaaagagcaaaactccatctcaaaaaacataaaaaaaaaaaacaaaaaataagatcattttatatgtgaatatttggcgacctccttttttcactaaattgtactataaacactttccatgtctatgaaatctatatgtgattcagtttttgacctttagaaatacacatgaattatttattgaaattaaaaaccaccaaaaagaacttaaattgatgagtttttacaaggtgaacagacaccaagaaactcagtatgatctgaaccccagaacctcactgaagtcccatttagtcactacctgcttcccaaacataaccactgttctgacttctgacacctcagattagctttgcctaaaaggttcatctttttttttttttgagatggagtctcgctctgttgtccaggctggagtgcaatggtgcactctctgctcactgcaacatccacctcccgggttcaagagattctcctgcctcagcctcctgagaagctgggattataggcacgcgccaccacgcctggctaatttttgtatttttagtggatatggggtttcaccatgttggtcaggctggtctcgaactcctgaccttgtgacccgcccgcctcggcctcccaaagtgctgggattaccggcatgagccaccacgcccagctggttcattattttaaaaacgtttttaattaaactttttttttttgagatggagtctcactctgtcccccaggctggtatgtagtggtacgatctcagctcactgcaacctccaccactcaggttcaagtgattctccagcctcagcctcgcgagtagctgggactacaggtatgcaccactgcgtccagctaatttttgtatttttagtagaaatgggtttcaccatgttggccaggctagtctcaaactcctgacctcaagtgatccgcccgcctcagcctcccaaagtgctgggattataggtgtgagccgccacgcccggcctttaattaaactttttatttggagataattgtagattcacatgcagttataagaaataatacacagagatcccatgtgcctttactcagttttccccagtgagactatcttgcaaaactgtagtacaatgtcacagccagatgttgacattgatgcagtcaagatacagaacgttccatcaccacaaggagcctcatgctaccctttcataggcacacccacttccctcctgcccccagcctgtccttaacccctggtaagcactaatctgttctccatttctataattttatcatttcaagaatgttctataaatagaatcatatactatgtaaccttttgggattggcttttcactcagcataattctctggagatttatctagattattctgtgtattaatagttagctcctttatatattgctgagtagtattccaagggtttcattgcttttattttttatttatttctttattgtttttgagacagggtcttgctctgtcacccaggctgcagtgcagtgtcgccattatggctcactgcagccttgtcctccctggcccaagcgatcctcctgcttcagcctcccaagtagctgggaccaaaggggcatacttccacatccagctaatttttttatatatataattttttttttttttgcaaagatggggtctttctatattacctaggctagactcaaacttctgggcgcaagcaatcctcccgtctcagcctcccagagtgctgggattacaggcgtgagccaccatgtctggccagttcattgcttttaatgcaggggccggattagtggtttttaacctttggtcacccatccctttgggagattcgttaaaagttattaatgctctccccagaaacatgcatacgtggaaagaggtgactataatttcagaggaggctctgaagccagccccacaaaaacatggtgagaaggtgatcaagtcttgaggaacccaagtgaagaagtgattaattctttgcaggggaagttcctgaagactcggatggtgtcatggtgggtgggaggaggggttctggttagaaacagcggggcaggcccagctcagcaccccacactcccagcaaaatctagatcttctggtttggaggtcagtgtgggtcattggcctcatcaggaacttcctttgtgaccttgaactaggcaccgtctcttcacttcccccatcattccacctgcacaagtgtgagcttggaagttctctctgcttaaactcactttgggttctctctctgcctccctagcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagagtaagttagacacttggatcctggggattcaagctcatcatacagacgggagcgtgatgcgacgtgttagcaggtggaggtggagacctgcccagctcacacagatggtggtggtaggagcagacggacccaggtgtcctgcctcccagttcccagcgtttctgtgggacctcattgatctagacatcgaggacacacttctccagccagtggaatatgacctaaagattcacctttctggtgctgacacttatgccctctctctccatcatctcttttccgagaaaagcctgtcctttctagggctatcttttctgcaatttgaccattgattgtatggaccaagaagctactgccttctgagtttttcttttctttttttggttcgtgtgcattttttctactaagaaagttccacttccttggttgaacagaaatggtaaaatcgcttggtcagttctctcacacctcctcttagttgcttttggccagtgatcacttacacacccttgctggagtgggtgtctgtcccgggatgcgctggggagactgctcggtggtggcccagccaaggtttctttggctcgaacaggcatgaggctgtcatgttgcctacgtgcaaagttgtgtccagctgctggtgtttggcttccttgtctgagtttagtaagtctacccctgcagcctcccctgacatcagtggaggaattagaggcttgtttgtctagggtatgccaggccttgggaatacaatagtggacaagactctatcctaggcctcttaaagcttaccatcttgtaggatgaacagacaaagaaacaggcagtagtgccctccattgtgataaataccatgatggcagaggactaaaggactgtgggagcacagcgaaggagcatctggtccggttagaggcttcagggagggcttcctggaggaagtggtatctcagcagacatcagaaggaagagagatagaagagtatcttcagtggagggaatggcatgtgcaaagtcctaaaggtgagagagtgcccatcaccttggaggagctaaacggtcagccagatcctctagtgtgagggggtggagtgttgagcagtaaaggaagagaggggtagagaggagagacctatgggagatcctacagggcctgaaggccatgggtaaggggagacattcactgcgtattccatgagtgcacaaaggctgagaggacagggaaggggattttaagcagggacgtagcgtaggcaggtttatgttttagagttctctggccaccggcagggtgagaacggagaccaagagactgctgagaaggctgccacatccaggagagagatgatggggactgggttctcggggagggcccctacagaggggaagaagggattcatttgggaagaggtattttggaagttgggcccatgagacttggtaactaattaacttcagggatgttcagggaaggaggggatctagagtgactcagagttctgtctggctagtcaggtagatgctgctgccatgtgcagagacagggaagtaagtttgcagagaaagatgaatgttaagtgcctgctggcactcagtaagaaactaaagagttacatcagagagactgagatacccaagtggctgactcacgcccccggcctggtaagtctttttttttagtgccttctgactaggaggcggagctctccatttcaggagttaactgggggtggggagatgtcactctccagtagccaccgcccacacttgccctcgtggctttgcctcagaaacaccagcaagcgtctccctggggattaccaagggaacccactgccctcagacacacacactcagcgctggggcacagccaggaagaggcctccactccttctgacacagtcatctgagcgctcatgtctgctggaggcggcaccaggggatactcacccaggagtccaggggccaccaggcaagaacggccccagtgggaattcccaccccagaagccagaccaagtagatgtggagcctgcatccgcctggagggtggctttgctgagcctggctctaacgctgctccgtggttgagggggtcttgtggggaggggtatctgggtaggattgtctgctgcggtgtcagcaatgcccacaaaacaagaccctgaagatgcagggactgattggagagaaacacagacaggatttactccctcagtgctggtggctggaggttggaccatgttgggggtttcaccaggatttactatagtcttgcagacagcttccagcctgctcttagtcagccctcccggttcaggtggtgctaggaagcatcgaggtgtctccctgtccgctctccactcacagcgctttattctgctccgtctcagagcccagatccactgcagtactgtttcctgagcatccacaaggtgcagggcctcaggggttataagacaggaagcccgcttctttcttgtctgctggcggctcactgtctgtgtggggagatggtggacaagcatcttctgccaggtctggagagatgggcttgcacagtggtagggagaggagctgggcctggacagagagtgaaggttggtattttatggcagaactgtagctagggccctctctatgctgcatccttgtctccatctcgagaatttgtcactggtgttcctgaacagccactcagaccccatgtgttaggaagagaaaacttcaaagaaaagttctgttttgttcactgcacagggacatgaactcagaaaggtgtcaagttgtgtagcaagaaaagtgtcgcacaggaaagttctagaatcgtttgacagcagagatagaccctgtgcctgctgtgaagggacaaaggctgccgcatcctggcatactcgggtggctgcagctctgttcctcatgcctctgttctttgtttctgtctccactccaaccccagccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcaggtgggtgacctcaaaactcccacctctgtcctggtggcagctacagaagatagtcttggctggcctctggctctccccagacatatggactcaggcactgccacatccctctctcactcattcattcattcactgttgagcttgttcactgtgcagtatttgatgcacaaaagaatatataaacctctatgttaataataaagaataggccgggcgcagtggctcatgcctgtaatccagcactttgggaggccgaggcgggaagatgacgagttcaggagttcgaaaccagcctgaccaacatggtgaaaccctgtctctactaaaaacacaaaaattagctgggcgtggtggtgtgcgcctgtaatcccagctactcaggaggctgaggcaggagaattgcttgaacccaggaggcggaggttgcagtgagctgagattgtgccactgcactccagcctgggcaacagagagaggctctgtctcaaaataataataataataataaagaataatacaatgaatatccctagacccaccacccaaccaaagagttagaacattgccagcatgccttcactctcacccattaattcggtgtttgttcatttatgacaatgacataaaatcagctggcttcttttgagtctatgggagggcacttgatgaagggttttatgaacattttctcattaatctttttataaccctctgaggtaattgctgttattatccccacttgacagatgaggaaactgaggatcagagaggcgcagagccattttctgtgaaactgacttcagagtctggctttgacttctatactctcttccttccatcgtgttagaagcatttctccaggttgaacttctcacaaataacctttaaaggccacacaaaacctcatccaatgacatcatctctctttccttttgctagtaaatccacagagagattgcctggtgagcctagaggtgaagagcagattgtccctccaggaaggcagcgagccaggtcttcctcagtgcctcgggaggtgctccgactgtccctgagtaagtgaccacctgcaaaggctgatttccagaggccacagtctgagcatgttggctcagtggtcagggaccacagcaacagtattcaaggaaacttggagaagggtttttgtgcatctgttttaggatattatagtgctgtgaagcacagagcacttctaaagtcctgcacacctactgcgtgtagggtgtctgtaagggctttgtagctgctgtcttgcttaacctccactgcaagatggtcatattatccacatttcacagataagggcgctgaagcccaatgagcgcaggggatgtgctaaaggatcagggctctggagtcagtagccgggatcagcgagctcccctccacttgtccttggccgagttgtttacctgctctgagcagttaaagggacagctcaccatgtagttataacagtgtccacatcgtgggattgctgtgaaggtgcccaacacggcacacacagagcgtctagactagcgcttggcacgggggcagggttctggaaatgccagctgttactcctaagggggagactggggattaaaacccaggcatccaccccagagcctaaactcatggcatacccactccttgagaaatgtgacccccaccccttgccccctctgatgccccactttttctaccccaggttcagaatctgagctgccctccctaccactgttctctgagaagagcaagaccaccaaggacagtccacaggcagctcgggatggaaagagaggggtgggcagtgctggatggccagacagggtcaccttccggggccaatacacaggtaggtcaggagggagggccgggatgggtgcagctcctggtgtcagcgggggctcctctgttatgagaagccctttccatatacccagtgggccattcaaatatcattttctatcagttctgtgatatgaaaaccagcagggagcattgcctccatgaatctcggtgcacttgttcattcattcattcattcattcattcagcaaacactttctgatgcttcccctttgccagggcccatgcttggttctgggaagtctgttcagctggtcaatcctaaagaagttctgatcacctgtgcttttccggctcggagcatacagggtggacactgaattggatgtcccatttgcacctggcttccttcaggttctcatttccagagggcccctgtgtctcaggaaacaggacctggcacagagtaaagacttgagatgacacatggtagcatttcaagtgcttataacattaacacaaaaatatgggttgggtgtggtggctcacacctctaatcccagcactttgggaggccgaggtgggagaatcacctgagatcagtagttcaagaccagcctggccaatgtgacaaaaccccgtttctactaaacatgcaaaaaaaattagctgggtgtggtggcgggtgcctgtaatcccagctatttgggaggctgaggcacaagaatctcttgaacccaggaggcagaggttgcagtgagccaagatcatgccattgcactccagcctgggtgacagtgagactccgtctcaaaaatacataaatatatatatatatatatatatatggatatggttctcaccttcatgaatctgactgtagcagagaagatgataaccaataggtaattatagtaaaggcatcatctctcacagacaccttgcagaagagggagggctgctgacctcagattctggggacaaggcaagaggccagaggcacattctgctccatggaccataacgagggagtggacagaggccaaggagttagaaacgacagtagcaggaacacctccaagctcaccggacaatctctctgtggacttactagcaaaaggaaagagatgatatcattggatgaggttttctgtagcctttaaaggtgatcttaacccttaaaagtgagcttaacctggagaaatgcttccaacacaatgagaggaagagagtatagaagtcaaaaccaaagactctgaagtcagtctcacagaaaatggctctgagcctctctgaccctcagattcctcatctgtcgcgtcgggaaaataagagcaattacgttcagctccacatacacaaagccagaacagcacaggagggaaatgagatgatgagaccgctccacagtggcttcaggtgtcacccagaaggccttatttgaaactcaggggtgggtaaggcaggaggtggtggggctgggtgaggaggccacagtccgcccagctttctcataacatcaactgctttccatctgccaggcactgggcggagcacgacacggatacggccccgttcagttctcccaacaagcctgtgaaatgggcgctatgtttatccccatgttacagccgctcagagcatggggagaaaacaccactgaccctgtgcccgagccattcagaaccaaaccagcaagtcggggtgtggggaatagcatcacttgttcatttcttattgttgctttgcttatcatttcttcctggcctgctttcaaatcctgacttagcctgggtgtgttggttgctactggatgtcagctggttctaggatctgagatgaaacagaataggagtctggagaaagcttacaataaacagacacaaagatgttcggtgacgtatatgtgtgtatgtgtgtcatacttaaatatgtacatattttacacatgatgtgtgtatgcacactcaccgtgtgcacacgtgagagagagacagaaactattaaaaccatttggaggaagaggagatcattattccagaatcttcctctattttgcatccatccacagggctgatactgacagttctggtttctttccccaggccacgaataccatgttctgtcccctaaggcggtcccaaaaggcaatggcacagtctcctgtccccactgccggcccattaggacccaggatgcgggtaaggaatggcacctggaaaactggcccaggcagctgtggctgcagcttcttgccctcaggggagtgtgtacttgacaagatctggcctgccctgaacttagcagtgggttatagggacagaccagggaagaggatttttctgggtgtcctgccgtcacatctgttgcttcaggtgctgctgcctgaagccaccctccttgatttaagaagttcctgaagggtcctgataggtggcctccaggcagcaggggacctggcatcagtgattatgtcttattctcccctccatcctcccttcacccctcatactttcccccaagtccacaggagtggcagagagagcagtggcccgataatccaggcaatgggttctagtcccagttctgccactgacttgctgtgtgaccttaggccagttccttgacttctctgtacctcagtcaccacatctataatgaaaggattggaagagatggtctctaggacttttcaagcaatagtgatgataatgactgatgataatgagctgccatttattaagtccctctctgtagagggtgtcatgttaagggttttgcataaattaatcctcacagttctatgaactaagtactgcagtactattacgtccattttatagacaaggacaccaaggctcagagagattaagtaacttgcccaagggcacacagcttacaagtggtagaagcaggatttgaacccaggtctttgtgactccagagtcccaccttttcaccactatgctcttcctgtgctagtgttagagtcctgacaggcctctccgttcatgcctgcatgcattcattcattcattcattcattcatcacttacccctatggggccctgggccccgtccccaaggaacacacaacaaagcagagtggccaaagctggggtaggggagcacgagtggggctggggggtgcctgactctgccggggtgggtgggagggcttcccagagggagtggtggttgagccaaggcctgaaagagaaacagaccagccctggaactcacccaggtgtggcattggggatgtatgtgggaagagaacaatggcacccactctcctcctgttcccttttgcctctactgacccccctggttccccaggggactgttctgggccactcccacatggagaatggctctgtctcactgtggttggggcggggggttgggctgcatttgggagagcccgggcttaggatccaaggaccactgcttcccagctctgagacccttggcaaattacttgacgtcttggacccttaatttccccatctgtaaagtgggggagtgaggacagtggctagcccagtggcttgttggatttgataaaataatgcaggaaggcccttagcagagggcctggctcactaaatgcttgctctcactgtcatggttgttgtcaatgtcatcacccagatggaggcagcttgtcccctccgcagtgggtcccgaggagagctcagtgctgcagaaggcctgcatgggggctcctgatctgatgatttagatgtaatcctcccctgacatctcttcctcctcttctaggtggtgctgtcacaggggacccactgggaccgcctcccgctgatacccttcagtgtcccctgtgtggtcaagttgggtctcccccagaggcagatggtccaggctcagccacctctggtagggacaaatactgtttcttctcttagccagaccctcagctctccttgaccagggttattagacctgggtgagtttaactggagcagctgttgttccagtctgggacagagcaactggggcagaggatttgttccccaaagagagacctccccgacatggagtctcacagggtagggcctgtccagctctcataggggaagggctgggtggaccctccatctttggctggatctgccaagtggtcagactctgtctctctgtgctgttccctccctgataggggcagagaaggccaccacgaggagaaaagcaccttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtaagagccttcattctgaccttcccagcctctttctatagatcactgaatatgttagcattcagacctgggtggggcagctgagatgcagtatactcctcctgtgttttatccctgcgtggataacatgcagtaggagcccaacactcatatagtcactcaacaaagccaacactcatataggcactcaacaaacccatgtaccaaggagagtgctcggccctgggacccagcagtgaaggggactagcaagagggccctgccctctgggagcttataactttgtggagactgagaatcctaaccatcttccattttccttatgggttttctccgcaagtaagtgatgagcactgggttttttttaatagactttattttttaggacagttttagatttatagggaaattgagcagatagtccagagagattcccacaatcctcctcactcctgcacaaacagtttcccctattattaatatcttacaataatgtggcacattggccacgttagtgaagcaatatccatacattattggtaactgaagttcgtagttccttcaggccgttttcctccaaagtcctgtctctgttccaggatcccatccacgatcccatgtggtatgcgattgccatgcctccttacgccccctcggctgtgacagatcctcagaccttccttgtttttgatgacctggacatctctggggagtcctggtcgggaatattgtaggactttttgcacagattctggacgtaacatcagtcaagccaggagaggcagggcagccgagacagaagtggcttgggtttggagttggccagagctaccgtggagtcccatctgccccctagtagcactgtggccttggcaaactaacttcctctcagagcctccacttccccatctgttaaatggaggaagagtctcaaccacgtacttaatcctgtgcgtgaggattaagtgtggcacgtggcaggaaccaaatgagaagtgtgtggagtttgtggtgccatttggtcacgtgctcattgctgagcaaacagtagcttcgccatcacagagaatgttgctattgctcagtgttgtcactagtaggaagaagaaggagtaaaagtgggttcaacatgataggattgtgcagggacaaaagcccagtccccagaagtaggaaacctgtcttcttgtctcagctgtcagcagctacttctctgcctgcttcccctgctgtgaaatgagtcgattgggactggatgtcttcagtggctgtgttgccagaagcctgggtgtgtaggcagtgagggcctgcgtcactgtgagggctggtgcttggtggagcagggacccaaggcgccatccagccctggtcctctattcggggaccaggcctataaatgtgcttttaaaaattttttatgtatatgtgttttctgagacagggtctggctttgtcgcccaggctggagtgcagtggcgccatcttggctcactgcaacccccatctccaagattcaagctattctcatgcctcctcctctcaagtagctgggaatacaatagtgtgccaccacacccggctaatttttttggtatttttggtagagatgggtttcgccatgttggccaggctggtcttgacctcctggcctcaggtgatctgcccgcattggcctcccaaagcactggcattacaaggtgtagccaccgcgcccggtatgtaaatttgctttcttgctgccctctcagctgagtctaagcaagtcgttaaggaatcttccactccagcagagatgagaaccaatgctgcatgctcagacctccagcagacacgggggaaagcgcctgccagtgttccaactcattgatcgggaaaggttttgcccagaatttggtgaccccacggtagccatggagtctttacttctcctgaggccccatttcacattcttccaggctcaggcctgtgggcagaactcaccaggttgctgtttccaactcaggatgggcgggttatacctatgcctcagtttccttctctgcgaaatgggttgtgctgaggattgaatgaattaatgcatggaaagcccatagtacatagaagttgccaataatgatggtgcttctaatgctgctagaatttgcgctggtgacaccctgaaatttctccagctgctggtcagcaggactgaacgggcccagtggttgagaccagtgtagtttggaaagcggagtgggcctgtgctgccccctgctgggcagccgtcccatagcccctgcagccgagactttccagcccagagggactttttcagtgttggccctagggagagttttgggtaactttcaggccaagttggtcatcaaattaacagaaggtgggggtgtatgaaaacccagcccagacagtccctacttttacaatggttcgatttatgatttttcgactttacagcgggtttataggggcataaccccatcgtaatttgaggagcctctgtagttacttacaccagacggtccctagaggagggagtgcaggctgctgttttggggatgcaagaagcccgttcatacagttcagattattttatcagcatctgctgcttgccaattagcacacattagatatgtggggagagtcgggcccaggtgtgaacccatggctgccccttccagctgtctgactctgggtcttaggagctcacgtttatggagcacttaccggagccaggcagtgccagctttttacctgaattttccatcagctctaagctgagaggttgctaactgtggtcgttttaggtgggaaaacagaggccttgcaaagtgacttagcttgtccagagtcccatgagtagcccagcagaatgactgggatttggggcagggctccagggcctgagctgctaaggctggtgcattctactgcctcctgaatcacttagcttctctgagctccgctttgctcatctgtaaaataaagataaaggcaccaactggtacatgggtaccaaagatgaggatgccagccctgggctaggcactgggtttaactgttggaggaactgtcagactgttttccacagtggctccaccatttacattcccaccagcagtgctgaggattccagtttctccacattcttgtcaacacttgttgctatctgtcctttttgatgttagagggtgtgcagtggtttcactttgcatttcctgatggctaaggatatgcatcttttcatgtacgtattgtccatttgaatagctcctttggagaaatgtctgtttggatcatctgtttctacacactgtataacaatgcaagttagacagcaggggctcaggaataaagccagagtttacagtgtgccaagcaagatgccaatgaatgactctgctgcgtcctcctaaacttattcctgatttaggtccatgcttctttatctccctcctccaccacacacaccctttatttaacagtgctgaggccacaccccctcttgcccactgctggtttccttgaaccctaaacttagtggccctgatggatgccattgtcacctcttagggaaatccgtgcttcatctcaatgggcttgtcagcccattcccacagcactttaaaacaacacctcacattcctataggactgggctaggaaggatgctcttctacccacttcccaggacatggggccagaccctcccactcctgcagaatccctattattattattattattactattattaattattaattattgcctttctccagcaccccttgcttggcaaatggaacccccagatattcttccatgagggggttttgctatcaagcctagggtgatcctggccttcccaagatccggctccaagaagattgcaggagtccatgttttcttgtcccactgtaaccccagagcctggcacgctggctggcatgtactagatgggcagtaaatcagatgaacaggtagattgaacttcctgtccttgaacacctgttctgggtcaggcactcatgttgttatcttccttcatctttctaagaaatccctggatgtgtgcccattattcccattttagaggtaaagaaactgagacccagagagtaggagccactggcccagctgggatttagaagggggttgaccccacacacggtgctcctcggcttgtccccagccctccccatgtgtaacgagcccactcacttctctcctcaggtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcatttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatcttaaaaaaagaaaagaagacaaaaaaaatacccaaagccatccgtgtctctgctgtatgtcattaacttttgccttcaatgtcaagtttatggggtggtaggtttgatgcccagccaagccctttcccaggggacctgttgggtgctctgcctgcctccctctggtggcttctgtttctccagttttccccctttgcctatctcagaaccataaatctttcaactgcggagggccttgaggtggggctgcctagccaagtcccttttgactgaggccagagatgtaaatgaggcacacagcaagttgctgtctacaagagtatgcacctggactctccagtgctcctttctttcttttttttttcttttttctttttctttttttttttttttgagactgagttttgctctggttgcccaggctggggtacagtggtggaatctcggctcactgcaacctccgcctcccgggttcaagtgattctcttgcctcagcctcccgagtagctgggattacaggcatgcaccaccacgtctggctaattttgtatttttagtagagacagggtttctccatgttggtcgggctgatcttgcactcccagcctcaggtgatccacccacctcagcctcccaaattgctgggattacaggcgtgagccatggcgcccagccttccagtactttcaatagcaaacagcacctgccatttagggagcacctgctagaccctgattccggtgctaagcactgggcattgtctgcttcacacagtccatgtgctaaccctcaggaccctcactctgccccccttttactgatgaggagagtggggttccaatgggccatctgcccaaactggtttgggagagaacctggatttaaactcacattggtctgacccaaagtccacattctttgttatgtgtgttttttgcttcctctacctccatgattctttttctcttgacctctggtttcttcctcacgtggctttttcttccatgttccccacttctcgtctcccttgcttctccctgctctgcccatcatgactcatttctgtttcatttttcagcggatcctcctgagtatggttgaaaatggtgtctcactgaaagtaacactgaaatggacaaacttcctgtaggttctgagccttcagttccaggacattgtgggaccccagaggctgtcctgtccacttgccttctgaggacatcagctcggtgtccccagcctccgtgctgtgggcacagctgtggtttgggtgctgagcaaaggatgctgtagtcttggccctgtggagcttggctgttgggacaggaggtacaaaggggagtggtgcctgtggacacaggactagaccccaggacatcagggcctcgggctcatggtcctatcaccctggatggtatacgcagctgcacacgtggaattgctcaaacaattcaggcccaacttttctgccacggaaggggtgctgcttccctcacgtaacaagaggctgtcaatcacgagcacccaggttggggtgaggccggccctttgtggcttgtgccactgagtgggctgtgcctcgggcttggctccacctcagggctccacatttgcaggatgtcagctgatttccagggaccagcctcacccttacgtgttatctccttcttctgggtctcccaggtgagcaccctaagaacacgtccatggagacacccagcccctctggcctgggccccaagccctctgcatcaccccagcccttccctgccctgccctgtcctggcccaggcaaccgcctcttgcctagttgcccacagcagccttcactcaggccttcctgcctccagcctggtccccacaacgtgcctcccccgatggccatggtaatactggaataaggtccttgtgataggcaccacatgcctgaactctccccaccccatccaccttgtatttgtctgttctcacattgctataaagaactacctgagactgggtagtttatgaaaaaaagaggtttaattgactcacagttccgcaggcttcagaggaagcatggctgggaggcctcaggaaacttacaatcatggtggaaggcaaagaggaagcaagtcccttcttcacaagacagcaggagagacagagcgaagggggaggtgctacacacttttaaacaatgagaccttgtgagaaacagcacctgggaggtggggctaaaccattagaaaccagccccgtgatacaatcacctcccagcaggacccgcctccaacacatggggctgaaaattccatgtgagattcgggtggggacacagagccaaacaatatcacacctccactcctgtttagggtcttctgcctcaaggttactcaaatgcatcctctcatttccttgcttgcagcagannnnnnnnnnnnnnnnnnnncacgccaagcactttctgtacatgagatctcaggagcctcacacagactgtggctgtcagggcctttctccccgttttacagaggaggaaaatgaggcccagagaggaggctcgggatgctaaatgatgtcagttcagctccatcagctccctgccatgtgccacctctgcggtgatgggggacatagttgaaggtaccacctctccaacatacaggcttctaccattggtttgcaaaggatcttaaagagggcgtgagagagaggcagatctgaagccagcctggagttccaattctagttctaattataagctgtgtgaccttggggaaactatttgaggtctctgttcttatgtttcctcatctaattctctcagtgtcttcttagggattttttctgagcacgtggtaagagctcaaaaatgttagtggttatttctctgtgcccaaagcctccagggctctacatccagcccccaccttatgctggcctgccctgttcccacggtgaaccctcctgcctgagggctggccctcaccgtatctggagacggtcccattctcccgctggacattcaggtaactggagttatagaagcactggttctggctaaagtcaaccagaaggcggaagaaaaacagtaatgttatcgaggagaagtggccaatcgcccatcacagtcccggggcaagagtctggtggagattaaagccaaccctcccggttccacccatgggaaggccaaggccaggaagaaggagggacttgctcaggtcttctggccagaagctgagatgggggtgcattggaatgggggctctcaccgggtctggtactctctgagaaagatcgtgtcctctgtcttgttgggggtaaagtaaaagaaggttgcttggatctcctgaaccgacttattgtactcctcgtttcgaaaggccgatgcgatataaaaccacttgccagtgatctggggagaaggggggagctggtgatgggggcttgatgctgaatctttgactgtcagctgggaggagactcaggcagatctctccctgattttgcagatggggagatgaggcccctggtgggcagtgcgcatgcaggagctcaccctgaggatcagtcattgccccccaggcagcccctccaggcccagcacagaaccgtcctccgtgaaggactctgcagtgaggcttctgtgtttggaggcagggggtgcctccagagtcccctgggctggtgagaatttcaccctggggacccagaagagaaaaaggcagagctgggagtgggggtgcgaccacagccagcagggaaagggaagcccagagaagggaggcagctgcccatgtgctcaggacagggctagcccaggcactcacccggtccagggtggcgttggtgatgggcaccggtactaggttggcacacaatgggatctgggcttccagcagaggtaggaggctcaggactgtaagaacccaggacagcgccatactgagaccaggaggcacgtggagccaggcagtgctggtggctgcagggtgcagtcacctttataataaactatgggcggtcacttggagcccagcaaaagtttactctgtgtctgtgacacaatcctgccagcacttgggaaatgcctcgcacaaaacctcccccaaaggccagctcggagcaccgcctccaaacccaggtctaatttgagttcctcacatggagaggttacaaaagccctagagtatggctgcccaaggccaaggtgggtgcggggctgcagcaacattagtaaacgtgtgagtccacagatttcctagagaggcctcccgcagaggaatctcatgtcttcattcaattcctatccctctgagtgccaagacttacttcagtgggacccagccacaaacctaatgatgaagccacctttgagggtccccaggctggcatgggatgtatgttgtggcggggagagttggggtgaaggatgccgggtgaaggcaaacatggattcagttccactgagtgtggcaacagctgtgtcagagccaaagttcaatggggccccaacccagccctggacgcaggcacatttccaaaaagggacatccaagttgaatgtctatttccagtaaatatactactcgaagcatctcccaacatctcaaacaggaaactgtctccctgtttttccccattccctgccatctgagcaggcagcttgcttctctttcaccaatatgcccccaatcctggagcagtgcccagcacttcaagggcactcggtgtatactgtggaatgagtgattccgtggcccatttgcgttcctaccttatgggtcaagtctttatttgtatgaataaatactttcagaaagtattctttttttttttttttctcggagatggagtttcgccattttgctcttgttgcccaggctggagtgcaatggctcgatcttggctcaccacaacctcccctgctggtttcaagcaattctcttgcctcagcctcccgagtcgctgggattacaggtatgtgctaccacgcctggctaattttgtatttttaggagagatggggtttctccacgttggtcaggctggtctcgaactccctacctcaggtgatccgcccacctcggcctcccacagtgctgggattacaagcatgagccaccgcgcctggccttccagagcgcctttcaacagtgaacagcagctgctgtttagggagcaccagctggaccctgattcttacgctaaacactgggcattgtctacttcacacagtccctgtactagctctcaggaccctcactctgccccctttttactgatgaggagagtgaggttccactgggccatctgcccaaactggtttgggagagagcctgggtttggactcacattagtttgactccaaagtccacattctttgttatgtgtgttttttgcttcctctacctccatgattctttttctcttgacctctggtttcttcctcacgtggcttttccttccatgttccccacttctcgtctcccttgcttctccctgccctgcccatcacgactcatttctgtttcatttttcagcggatcctcctcagtatggttgaaaatggtgtcttactgaaagtaacattgaaatggggaaacttcttttaggttctgagccttcagttccaggccactgtgggaccccagaggctgtcctgtccacttgccttctgaggacatcagctcggtgtccccagcctccgtgctgtgggcacagcagtggtttgggtgctgagcaaaggatgctgtagtcttggccctgtggagcttggctgttgggacaggaggtacaaaggggagtggtgcctgaggacacaggactggaccctggggtgtcagagcctcaggctcatggtcttatcaccctgtatggtgtacgcagctgcacatacggaatagatggaacaactcaggcccaacttttctgccacgggaggagtgctgcttccctcacgtaacaagaggctgtcaatcatgagcccccaggtctgggtgaggccggcccttcgtggcttgtgccactgagtgggctgtgcctcgggcttggctccacctcagggctccacatttgcaagatgtcaactgatttccagggaccagcctcacccttacgtgttgtctccttcttctgggtctcccaggtgagcaccctgaggacacgtccatggagacacccagcccctctggcctgggccccaagccctctgcatcaccccagcccttccctgccctgccctgtcctggcccaggcaaccgcctcttgcctagttgcccacagcagccttcactcaggccttcctgcctccagcctggtccccacaacgtgcctcccccgatggccatggtaatactggaataaggtccttgtgataggcaccacatgcctgaactctccccaccccatccaccttgtatttgtctgttctcacattgctataaagaactacctgagactgggtagtttatgaaaaaaagaggtttaattgactcacagttccgcaggcttcagaggaagcatggctgggaggcctcaggaaacttacaatcatggtggaaggcaaagaggaagcaagtcccttcttcacaagacagcaggagagacagagcgaagggggaggtgctacacacttttaaacaatgagaccttgtgagaaacagcacctgggaggtggggctaaaccattagaaaccagccccgtgatacaatcacctcccagcaggacccgcctccaacacatggggctgaaaattccatgtgagattcgggtggggacacagagccaaacaatatcacacctccactcctgtttagggtcttctgcctcaaggttactcaaatgcatcctctcatttccttgcttgcagcagaaacagaaaaggatttttttttatgactagttgaagttttattacaatcttgctattaggagaaaggccttacagtagtctcagtttagaaattcacatttgtttgcttgtattgttttaaatggacacataatgtacatatttatggggaactgtgtgataatgttcccaacacaaagaaatggtaaatgtttgaggtggtggaaatgaccccgatttgatcatcacacattgtacacagaacagcaggttgtattatgctcctcatctttctagattggttcagatgccccttctaggaagccttcccagattttcgccctgcagaagaaaatgtcttcccacagtgctgggctcccacagcactcggtgcctgtcatcctccatcctggcacgtgtggggctcttcccaccagggacagcgtcttatccagtgcccagccagggttgaactcagggcaggcttcagaatgaatgaatgaacaaatgactaacagcttagctgttccaaacacagaagctttattgatgcaagtgagggaaaaagctgaggtacacatgtcgggttggaggggcaggatggcccccaagtctctgtcctgatccaaggctgtgtcctgctaggattccccctcctcctgtttcctctccttctcgtgctgcttctccagtggctcacacttatcctagaaggcagcggggaattggggtgagggagaagcagaggcatggggacagggtgggaggtcttccagggagagggcagaatgagctctggcctgtggaaccagctcaaccagggctccaaccctggcactgtcacttcccagctgggtgatcttgggcaagtcattttctgtctctgaacctcagcttacttgcctctacaatgggagctcagactcttaagaatcactggcatttactgtgcacttaggacctgccgagcccttatgctgcagctcctgaattcctcacaaccaccactactatgcagatgatgtaactgaggagcagggtggccttgggacccattcgaggctccctagccagacagtgggggtgccaggctgtggatcaggtgagctgactacagtggttgtgttcataagccctgtcccaggatcctgggactgcggatgggggcaggaggtagttcacacccctggtggtcatctcagatggcaaatggaaggaattgtttttctttgaatagtcatggaagtactgcatgtatatattttaaaaattggaaccagctcatcggtgctgtgatttcacaggtattagggcacagggccacaccaacacaagtcttccaaacacaggtttaaagaaaagtgttaaggagctcattatacagtaattttcatttgtagcaaaaatcgggatggtgactgtggccgtgctgcagtgtgggtgacattgaaaaccacagtatcaattccccactgcacgggtattaaaaatgagtggggagtggaggtggggtgaaagcctggggtttgggacgcgtctgtaggtggtaactccccgcattacgtcccctccaattgccaatcccccaaccccgtggctcacgctgttccctcctgttagctttcaggtcctccctggtttcacagggacttctccctcctgggctctcatccaccacccctgggcctctgtagagctcagctgtccctacagtgaggcaggtgcctaaaagcagaagatctgcctagctgtgcagccttgcctggcagctctcctgctctgggcctctggggctgcccaagttgggccatggacaaggtgggcactgtccaatcccttgcgtttacctttttccaatcggtgtacacgacatctgacttgggaatgcgcaagcagtcgagagcttcgtagaactctcccagttgctccttggtcgtctctggcttgtcagctgcagggggagcaaggagactgactggggacatggtggggcccggcgggaggccagggagggctggggttctaggggccagcccaggggtgggtgaatggggggtgaggcctgagaggggcatgagtttggggctgctaagcatgcctaccatagacagacagcccccagttcttctcatcgttcacgtcaaaagcaagcatgtaggtcttggtgtccctgaggatcagcaagtgagcgaaatgctcttggcctcccactggaagagaaaaggagcctctgggtgagaacatgggatggcacaatggtgtctgtcttacaggtgaggaggcctaggtgtgtcagtggccacacagcccatcagtgaaggcccagggctcctttgggccaccgtgtgcccagcccctgctgcgtgcccagctccacgccaagcactttctgtacatgagatctcaggagcctcacacagaccgtggctgtcagggcctttctccgttttacagatgaggaaaatgaggcccagagaggaggctcgggatgctaaatggtgtcagttcagctccatcagctccctgccatgtgccacctctgcggtgatgggggacatagttgaaggtaccacctctccaacatacaggcttctaccattggtttgcaaaggatcttaaagagggcatgagagagaggcagatctgaagccagcctggagttccaattctagttctaattataagctgtgtgaccttggggaaactatttgaggtctctgttcttctttttcctcctctaattctctcagtgtcctcttagagttgtttcatgagcacatcgttagagctcaaaaatgttagtggttatttctctgtgcccaaagcctccagggctctacatccagcccccaccttatgatggcctgccctgttcccacagtgaaccctcctgcctgagggatggccctcaccgtatgctggagatggtcccattttcccgctggacattcaggtaggtggtgttatagatgcactggtgcctgttctaaagccaaacagaaggcggaaggacaacaggaagattatnnnnnnnnnnnnnnnnnnnntcagttcactgcagcctccgcctcccgagttccagcaattctcctatcc

SEQ ID NO: 1775 - DNA, 4104 bp, Homo sapiens
atggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcgggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcaccttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcatttatcagtggccagctacctgccaggcccgggctggggcacggtctgcggccatgaggccaggccgcctcccgcacccctaccccgtggcagcagcatacctctgcatttctggaatgtgtgtgcatcaatgatgtt

SEQ ID NO: 1776 - protein, 1093 aa, Homo sapiens
MEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMEREATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKAPSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 1777 - DNA, 26666 bp, Mus musculus
  misc_feature (1)...(26666): n = A,T,C or G
cattaggtactttgcacaatgtcaaccttctctcagaatttatcaagtagatgttcctgtaccacaaatagacaaccttagcttcaaaatgagcaagcaacatatgccaaaataaataatcagattttaactatcttgacacaggtaatttgttttacccatctttttgtgtttgctggctagcaaggataaggtgttgaataacctgatttttaaataaacacttggattaagagataaatgtcagtaatttagctagaaaaaaaaaagaagagagacctggaattccaaaccagactgtgatctgagaggctgtacccaccactctgttggcctcctctgggaagtgtgcagggctcctttccaaatgaggctccaatgcagggagtgcatatcaagggttgcaaagcatcttgctcagaaaggtgcatctactcttctgtttcaccagtggtttcacgaatctaggagaaatagccactgatttttctctctcagaactttaggtgtgacacataaagccatgtatttttgtttaatggtatgctttctatttgcacatcttcttgtgcctattaaaacaccgcaaatctctgcctgctgtttgcttatgctaaggcttcggccatcagatatgctacttcagcatgctatgtggcatgaagatccaagtttattcacaatataacaaagtagagtttgttttttcgtacagactgaagtttgtttcgttcaagaatgtgagttggtagttatggcttcacacccatgcagggtcagtaccattaaatgatcacattttctgtttatgttgacttctaattatttctcccattaaaaaaaaaatggaaaggttctgttagccaagccagagcacataatgattcccactgttggatgaacactgttggacctgtctcctgaaaaaaaaaaaaaacgctgttatttaccacccacaaactcatcaacagtcctggctctctgcaggatctggattctcagccctctccaacccctcttgtcctctgttcacctccattgggaacatggccacttggagaaagggaaccttcccctcccttagaaacagctgggaatgctgactcagtaccatacattttaacccagagcagagcgtgctcactttgtagtagagtttctatttgtggttaaggaaaagtcccttcacttttgatccttcagatgcctttgatacagtttcagcatcatactaaaccagcagatcagactggctgggcacaaggcaattaatatgattattcctactaatcacatagactttgaaatccacccatggattattaatcttttaatgaataaaataacatatggtggagattcttatgtaagtcttattagaattgaaagccacagtgttagtggcctgaattactagtcatttcaatttgcattactaatgggacgatttagaaaatgcaagaaaggactatatgtaagacttttattaagtttttattctttaatgacctcttgtatgtttcacaactttccttttctctttctctatcacaagccccagatatactccactaaaagaggaatgaatatttaaaagccccaagcaaattaaaattactgctggtgggagatagaagggaacagaggggaaatggaatgttcttatatttaaaaaaaaaaaaaaaaggagacatatacacaggctcttaaagggttggaatttaaatgcaaatccccaagtttgtgcctagttacatttcctctaatataaaaattaataaaagaacatattttcttgtccagatccataagattaagaaaatgaaagagatggcactatcagaccaaatgtttacaaatgtttacgaagtacagtctacatgcatttgatctgtgacatcagtcatttaaggcaggtctttggggtctgagcccaccctcttctgacacaccacctgtcagtcacagtgctggagcctcctaggttcctttcacgctgttccttgtagccagttcctactcactgctgtcatctctgcacttggtagacacttcctcggttgttcaaggatggtttccagggtttctccttaccatccaggcttcaaacaaagaataacttcaaaatgtctgatctcatcaccatgtttacagtagcacctctaagtgattctatgtgtattcacctgagaccaggacaatgtgtatttatctaactctctattatataactaccagcaggttaacatagtgacacaaagagctaaagaacctttacccatgtatcctctgtatcatacaacacaaggagttcttacttttctttaactaaaacattaatttatagcctttttgctgcatcgatgtataatgtttccattcatctccaagcttacttctaactagcaagtatttctatcttgatcctgctatcatggtgtaggggtgtaaaacagtgttgaggctggaaagataaattggtagttaagagaggccattcaaacatgacaaccagacttcagattccagagtcaatgaagatgctgagtggatgttgtatctgcctgcaattagaagaccagttctcaacaagtaggtggtgaccgtctgagggcactgaaggactctttcataggggtcacctaagaccatcagaaaacacaaatatttacattaggattcattaacagtagcaaaatcacagttatgaagtaacaaggaaaataattttatgcttgagcagtgggggtggaccacaacatgaggaactgtattaaagactagcagcattgggaaggttaagaaccactaccccggtgcccttgactgcagagacagaagatccctaatgacagctggccagtgaaaccaaatctgggaactccaaatttgattgagggatcctatctcattgaataaggtgaaagcaactaacatgagattccccataccaactgcaggtctccatatgtacacccccccccccaacacacacacacaaactcacaccacatacataaagaggaaaaatagcattgttatatttcattaaattactgtacatattaaaataagcttttgtgcctactttgacacctatgcttaattcctccaaattgtttaaaaggctgtaaagtttcaaccatggtcagatttaagctttgactaatgaatgagaatttaaaaattctcaatattttcttttgtgttcaccaaaaaatgtgtaagagactatccagtaattctattttttaacacttgatcttcaaggaactgtgaatcaatcatccctaaattttcagttaccataatgtcactgtataataacacaaggagacctgctgccacagtcttttggggacttgattgtgtagaaatacatttccttacttagtcaagattaaacaaaaaacttctagataaagagactactaaaagacatctagaaaaaccttttttgtttagctttctgttaaatatcagtttaacacttgcattaaaaaacacaattacacagcctttttatattatgggtgtcattcattcttcaatcatactgattattaaaaatcaatgcaataaatggtcactctgtatagatgccagaaattatcaaagagactaccaagaaattatcagaccaaataaactccttaaattgaggaacattaagtgtgaacaagtgcaaaaagggagagaaatctgaagtgaatatgaagtcttttctccttctcctttctctaaggcccctgccagggttagggctatgtttttgtttgcttgtttctttatttttttggctaaagtgatatttaccaaatttgtgaattcattacatattaattatataaattgtaaaattacaaaattgctcatatataatgagcacttacattgaatccaatcaagtctgttttatgaactcacaagtaaatgaggagagtagataattgacaaaacacaataggttactttcacatagtttaagtagatgagagttagacttccagttgaacattagaaatggaataaaggcagatccctgaagcttgctgtgaattttcacacaagagttcttcatactcagttgatttgatgcataataaacaccgcgagtcacaggctgaactttctcagctagatagtcagaaaacttggtcagatatcactcaagaacacttggcatcagacactggagacagtttttaaatgatgcattaatctactatttccacacagttttcataagattaccatcttataggataataggagggcttacagaggaaagggaagggagaaattttataattatattataatctcaaaaaattttaagttcaaaacaaaacaaaataaaataaaaaacgttttaaaatagttattacaatgtatctctttcttatttataacttaagtagtactaattttgcatgaatgtcaaaagatcccaatttgaattcctgtaaattgtttccattttctcactctcatctagccccctttatattagcatttacctccagagagagttagcaggaacaaagatatatatttcaatccctgatctcagctattctttgctccctaattttcagttttcttcacacctagcttagaaattaaaaaatgaatgatcatgataacatgtacttgtagaggaattttccactaattaattggttggctaataaagacaacaagaagccaatcgctgggtgaataggagaggtgggccttctgggtcagagagaggaagaaatggccattttttacagtgaggtaggaatgagaccaggaactgtttgacctggtggcgacctctgccaccggaagatttccaacatagaatagttgagtttaggataatagattccgtgcccagtggttgtgtcatctgttgattttaaattaagattgtttggtgttttccattcacgggtgactcgggtgggccagagggaaagagcatagcaggggcataattccgccaggctttggaacaggaagattcggctaaggactgaaaacgagcggagaggtaaccaaagcagagtgcaggctggtgacagcgttcccacagctgaccacagggttttggcctggcaagagagccatctcagagctctggagaggcagagccagcatttgtgggggaggaattggttaggagaaacatacagtcttggtctcaggctacgcactgggctaggaacagacagagaaacaatatttccaccaatgttggaaagccagatttagcgtggagtcattttgtaaaactacatgctatatatacttccataggttgctgaacagttgccatggtgaattctattattttatgagaaaatgtgaagtgtctcagaatgcttctccctttctacaccttaactagctaccaccagagaatcaatcccatgtacaccaacaaacactccaaagtaaactctgtttctggttatgtcatactgtaccacattttgataagcagactcccttttcctctcaaccttgttctaatccttcaccttcaagctctctccccctaagtagtaacttcttattctctcttcccactatcaagaactcaaactcccagccgggcagtggtggtacacgcctttaatcccagcacttgggaggcagaggcaggtgaatttctgagttcaaggccagcctggtctacagagtgagtcccaggacagccagggctacacagagaaaccctgtctcaaaaaaaaaacaaaaaacaaaacaaacaacaaacaaaaacaaaacaaaaaacaaacaaacaaaagaactcaaaatcccaacttcccaaatccctttcttgtccaagttattctgctggttaccatattcatttgattacagcaccttggtactgtgggaacatgcatccaacccttaccataccattcttagcttaatttgaagttactatgagcaccttacctagaatatcccatcaactatctcatgatcttcaggtctgctaaggtgttagggaaaaaccatttcaatagactgcaatacccggggatccatcccataatcagcctccaaatgctgacaccattgcatgcaccagcaagattttgctgaaaggaccctgatatagctgtctcttgtgaagctatgtcagggcctggcaaacacagaagtggatgctcacagtcagctattggatggaacacagggcccccaatggaggagctagagaaagtacctaaggaactaaaggggtctacaaccctataggtggaacaacaatatgaactaaccagtacccccagagctcgtgtctctagctgcatatgtagcagaagatggcctagttagttggccatcattgggaagagaggccccttggtctttcaaactttatatgcctcagtacaggggaacgccagggccaagaagtgggagtgggtgggtagaggagtggggggagggtctgggggacttttgggatagcactggaaatgtaaatgaagaaaatatacctaaaaaaagaaaagaaaagaaatcacaacatgtcatttaccatatagaaacctgtcttgtctacagaaatcttggcgtgtcatggtccacaaaaggtttcatactgtaaatgcaccttatgcctccagtcttcttgatagtctgatttgttcctgaaacatacacaaccttgtatcaagctcattccagtctacttgttaactggagcaattgtggtgttacctcttcctcctctagcctgacatcgtcatgtatgtgctgataaagtccaactacttctaaaacaaagtggaaagtcttctacgacacatccctttcctctttagtgtcacagtctacaatgtccatatacaatggcagtagaaagatattatttgacaaatataatatataagggaaaataaacttaatagaatggggcaaaagggcaggagcatgacaaactaaaattctatttttttttccttgtcttagactcacagggtttcatggctggaagagttcttacaggcaatctagaccaaagttttctgtggtttccatataaaaagtaaaaggccttaagatgaagtttgggaaatttgtatctagttgtgtaatactgactataatttcagtgatccttatacagcattcatgaaaccattcactacagtattgacccttaaaaacaggatgccagaatctgcacttcagaattgtaatgtctggcatttcccatggctatggccattgaatctttcccaaagaaacatatttgtgctcaaacattgctgcccatatcgtaaattctctgattacaaaccagtaaatctccaccaaaaagctgggacaactgaaccttccttgctcctccgaaaacttcgtgcataatgaaaatatgcaggaagacttgttattatcacaacttgacttgcatcagttcactggggaaaggcttagagtctcggggatttgagcaaggtcttagcatatcctaccatgtcacaggaagttgttgccaatcattagacaaactcagacctgactcagaagtttctgaacatccaaatccaatgctttaaatgaaacatcttaaggaatttgaggctctaaatgtgtaaaacacattaatattaataactaatctatttaaagtagcttcataattcataaaggcttgaggtatataaactttcaaaatcacattttccttaaaacacttaagtggtaaggacatatcagtttggacccttttcattgaacctggaatcactgcttgactgacttggaagccattagtttctcaagtatgatctatttttccatagatgggttttgtgaaaatctttcacaggtttcacttggacttcgagattctgacttcaattctgatggattctgaacacttgcggttctcctataccttttcttttgagggtatttccctgcttaaaataggttctcatttttcccaagcactcccccacccctagtcccctgtcataaaaaatgaccttccttggaaaggagtttctggtacaaatccctcaggtcccataatggcaaaccctcctcacccactttataggactgccccaccctacagaagaacatgcacaggaaaagcagccctcccttcccccacacatttcctcagtttatttatgaaacatcttggaatgagagcgagctgcttgtggttcctgtggcttattcagggatggtttcctgcaggccagggaagcgggtcaactgaatgacctctatggagctaactcctataccccaacaggaaggatctttgttatgggtatcatttcagactgtgcctggagggctttgttgttccaatgaagagcttaataaccaattatcactgtgattacagactaatattatacttgaaatatgaaataattcttcccggctcatgttttgaatacttgatccctagctagtaggtgataatatctgggggagagatggagcccttaggtgtggccttgctggaggagaaaaattattaatatgggacttttgaagtttatttcccagaccatggttctcctcctgttctctgcttcttggtgtggcatcgtaagactgcagggctttgtttctgcaataaagagcttaattatcagacatcattgcaaatacagattaatagtgtccatgtctactgatgtttatacctttctctgtcaataaaagatgtcagaaatatgccaagatacctttagatacctgtgtgtcaatgttggcttctcaacggaagatggttgacttcctagaaagtcctatacaggattagcttatattttaatacagaatccattgggaaagacgatacctttaaacacaggctacatgcagcatgctccttacttggttcagtcaggtaacacataatcaattcccataaccaagttaactgagaggagttccagtaaatgatgcctctagtctttgtttgcgtgtgttcagacttgtcccggagcactcttacatcatgcatttatgacttcggaagccaggagtgtgaggacagtgactcttccccatttacttgaatgagttaaattaatggggctgggggcacaaaaactctagggcttctctcccaaaaagccaaagtagtaaacacaaattcatataaacttactggtaagacttagatgcaaagttttacactgtatcaaatttaatggtgagaagaaatatttcagaaaagcactgggcagtggcagtatgctaatgtagtttccgaattagtttgatttggattaaagagtaaagtattctcttaggtcaaagttgaaatagatgttccagacccaaggtctttgttcaacatcttcactcaagtgcatgttattacacttgctgctgaagtcacagacatgcttatcgtctgtgacacacacaaaatcaagccaattttaccagtttcattgcaataaaaaaattaaaattaaaaaaataaaaaataataaaataaaacaggggttgagagatggctcagaggttaagaacactgtctgctcttccagagttcctgcgttcaattcacagcaactatgtagtgtgttaatccatctatactgcgatctaatgccctcttctgcattcaggtggctgctagagcattaatatacataaaataaataaacataccttaaaaaaccccacaaaattttcaaaccctattttcctgcatgctgattcagtaattctattttactgagatttttaaatgaatcatttgaatgaaatatattttgaatgttcaaaggtgcaaagatatgagatttcaaattaaatattacatatggttaaggaaaattctggacttaaaaaaaaagtaggaaaaataatcttatctcatttgcccactatcatcaagtcgaaaggtaattaaagtaaaatacacacagagagggaaatgtcattgaatcttatgtccacagtctaacctctctttttgtctctctgctttgcctctgcagtgcatcctaatgtcagtcaaggctgccaaggaggctgtgcaacgtgttcagattacaatggctgtttgtcatgtaagcccagactgttttttgttctggaaaggattggcatgaagcagataggagtgtgtctctcttcgtgtccaagtggatattacggaactcgatatccagatataaataaatgtacaagtaagtagccacacccctctatagttctcattttcacctcatcccgagagatgtctcctgatgaaaaaagctcctaagaaacctaaaatactcaaaaaaaaagtactagttacataatattaggaaaagacacacatagacttagccctcaggacaggaacattttcactactaacttagaaacatcactcaagttttgtttttgtttgtttgtttgtgttgggttaaacaacctaaatccaggaacaggattattcctaactggccctacagaaaatgactacaggtatcagaaccaatcgagttcccattacatataaatatccaagcattcagtaaccggaagaattatttcagctattttggcctctataagtttccagtatagcaatgaaaatatttgcaggttggaaatcaagtttatgaggactgtcatcctggcctcaaaattccagcctcagcaatggaaaccaagtggcatttgaaagattcaaatgaggaaatatcccttctctccaaatatcatgtgtccttccaccagtggctccttccctgcttccctgctgcctacctcagagtgtcccaggtcagaatctgtctggacaattttgttcctcactggctcttctggaacttctgaagctgcttgctctcccattcaagattctaaaggcatccctttctcagtgaggtagtgtaaggtccactcctccaaaagaactggcctcggccatttgtcagtcatctgtccgttctgtttttcctacatttatctgtgctattgtgattcttgtttcccagaacacttacaagtccaaagccaactgtcctttagctttcctgtgtgactgattgattcactgctagatttgagcctcagttacagcacttgtgaataagagtcattatagtgaccactgcattggtttaagctaacattttggtaacaatgttgcaaaatacccataacaatcatggttcatggtaattactacataggagtcagttgctgaaattgtttactctgtctcctactagaaggtgagctttgtgaacactgggcatcaaccccatgaatggggtcaactacagtttttgacatctagtagacagttaaatattgagtgaacaaataatccttgagaagagtataaatgaattatttcagtgtatgttattcaaataacacagcattactatcacttaatgcaaaatgctacttggacaaatggacaggttgagagcttcttatatgaaacaccaggaaacaggggtgattcagggggttttggatttgagaatggttgtgtagacattactggctaaatatccctaacctgaacacccaaaatctataacattttttttaacatgatgtcagtcaccaaagtgtctcagattttagaaactctgtatttaaatgctggcaatcaaggggccccagcatatgttacaaaggtatttgcgtgctacaatactataatttttaaaggatgcatatcaatgagatggctttgggggagccctcaattcagtctagcaaaataacactgaacactgaagttgatgccaaagttgcatgtacagtaggaagatgatccagcagtagtttggagaacatgacagagtgacaattatttttctgtatttttcctttcagaatgcaaagttgactgtgatacctgtttcaacaaaaatttctgcacaaagtgtaaaagtggattttacttacaccttggaaagtgccttgacagttgcccagaagggttagaagccaacaatcatactatggaatgtgtcagtattggtaaggaaggactctaagatttataatgggtgagaaacacatcagatgacaatggcaatcttccacaagatcctgagaggctatatctaataggccctatccatctttgtttataagatactattccaaacctatgttcacatagctatatcctgcatgtattgtgggtagtttaagagtgttctgctacttgttaaggatggctcataattgtttcgaactactctgatcatcaaatatttcagagaaacaaaggaaaagaggagggagagaaggaaggaaatgtgtgagtgggacaaacttagctgatttctactttaaaacaagacttaaaaaaaaaaaaaccctaaatttgataacaacccataatgaaattattttccatatggtggtattttttttaatattgcccaccaatgttgctgtgtctaagtattaaacacagagaagagagaaaattttggactccttcaaactgacagaatgagacagtccaaactttgattaattataggcctgttttctggagaggaggttcctcagacaagttgtctgtctaaacgacaaatcatggttgggctatgttttccctcttttaagtgttacacagctactagagctatgggtttgatgcagttgtggaacagaggctaacccaaatgggaaaacagaaaaagagaactccaagtcccttgggcagtggctgcagaaacctttgatgctgtcctatgctggtgtgtgtacacagagcctcctgattcaatacaagatagtttccaggagtgccccaggctcccacagtgtgcttctgttataatttaaggtgttggacaaataatttaagttggtggctccaccatttcaggataaatgcaacttttatgtctatacattcttttttggcagaaggaaaaccataggtgatatttaaaagttagccgcagaaatgctgggaaccagtaatctcaaatttatcttgactctttttgtttcaaacttccctaatcatgaaaaacacagaaaaacaacttaggaaaggggtaaagttgtccatgaaagttcttctggtctaatcatccaaagggctgatgattcgagataataagttccaaacagtggacaaaatgggaaacactccactgaaatattaaagtgcagataccagaaacttgtaggatttctttactgaggagaaaggacagatatttaagttttgttagttgttaaaggtgtaacattcggtctttaaaagctaaatgctctttaatagtttcttatcacagagtgtttaacatttggcactgtgggataagtcttcaaagaaaattgggttttatatccccaaagttaccaattctatttcttaccataaattttaaatgatgattaaacaattaaaatatcactagctgcccaatggccatttattgaacaaatgacctaggacacagttgtattgtagatgggcaatttcatcaggactggctcctttagcctgttccctaagggaagtacctatcttggtagtcagtccttatgcatagcatgtgctggcttgccccagactatcagggaaaataatggcacgcttcactacacaaaggacaatcaaagtatggaggttcaggacccagaaagctgagatgtggagcgcaaaacacacgataaattccagtgcttagcttaggaccttatttagagctcttcactgcttaccagtagtgtatctttcccctgcccagggctgttagttaagttttgtttctacttagaagataaactgagtaaatagatttcaaacaaaaaactattgcccatgtatagaggtggcatgaaagatcattgtaacaatgtatccagtcctcatggtttgcaaatcaatttagcctacatttctacctttataagacggcatattgtttccactctggatttgagatatttgcttccccctgcagtgtagttctgtgttcctcattgttcctcttggaagtcacagagggggtcaatatatcactgtaaacacagagactgggagctcataacctagctatatctcctattggacatgcctccagtggctgaacccaagttcacccattcccacctctcacccccccacacacacacacccacacttttactgtgaatttcactacatctcagatgacaatgaatcacagactgactctttctagggtctagggctcattaatttttctcaaatacttagttcattgggcagaagaaggaaggaaggaaggaaggaaggaaggaaggaaggaaggaaggaaggaaggaaggaaggaaggaaggaagacagcatctgaggttaagatccttcttaagcatttttaacaaagttatatcccagttttaaattgttcatgtaattgaaacttaaattgaacttaaaccactcttttagttatatctatcatttttctaacctttccattttatgaaagtattatatttgctacattatcagccttttaaggtatttctgaaggaaaaaatatcttcctttaatatgggttttaactatctaatctcattagttatatttttttccttcaatagaattatctaagattaaatcagaatttcatcttaataaccaatcattttctgatttttagatcagtaactacctatgtttcaatttttcaattctggtttcataaagtgaaagtatgtatttgattttatcacctttgttgtgaaagaccaacaatattttggcttccaaattaaataatgctttcttttctaatttgtcctcttaattgtagtgataaatacagacacaaagttaacatacagactaatatttctctttctatttgccttcttggaggctttttcatctatattactatttgatgattaacttggagaaagggtgttaggaggtaaggttcataaaaggcaaaatgttatactattaaatagtgtacttgctttatttgctgaccgaatcacaatggtatagctaaaggtggagtttattttgaagatgattcaatagagctcatttaagtttactgaaacaaattcatttttatatgactctgtgctgcacttgggtgcctgcaagtgataaaaatgcctataaaaatgaaggacattttaatcctctagatttaaaataaaaatattaattaaaaattactttcttatatctagaggtttaattttaagtctctagatcacttaggttattgttcttaaggttgtcatcagaggtagccttcttgtacaataacaccccactaagttagaagacactgcaagaggttaccagaaacatgtttctgtggagacaagctgtactatctgaaaggtttacaattggaagccatttctattgttgtaagttatggtgtttcatggtcataaaaacaggaacagcattttaaaaaccagccaggagagcacagccctgtactactagaaatcaggagacatagacatgaggatcatgagtttgactctaggctggactgcataaagacacattgttggaaggagggaaggaaggaaggaaggaaagaaggaaggaagggagggagggagggagggannnnnnnnnnnnnnnnnnnnnnnnnnnnnnnnnnnnnnnnnnnnnnnnnnnnnnnaaaaatagcacttttggaatgtcattaaaagtacaaacatctgctacaaaaacccaggaaaagtattaatgaaaagcagagaaactaaactcacacagaggaaacaaatcttcacaacagcttcagaagggcacaccctgccctttaagcaccacgcaaggacatccagaccaaacgcaagttattagctgtcactgaccagaagttcactaaagttagagatgctgctgtgaattaactgagtaataaataacgtttaggtattccgcagcatgggaaacagaaagggcactgactctaggacaaggacctggatagtcctttctgcctgccatcctctagcacagatgctctcaaaccaaatgatgttaccaagtctgcacataacatctctgcattaaggcggcacatctgctccaagctagaaatgtcatcagaaggctagggtggggtccagaatcctgtgctttatcaggcccttcaattaattctgagatctgcaaacatttaattatctagtcaacaatccctcgagctctagtaagaatcactcacttcttacagcagtgttaggaaatttccaaaacgttcattaggtgtgcctgagttaaccaggttcaccgcagaattccaatccagtgagaagaaactgtcccaacagcatatgcactaaaaagcgttctatgtctgccccttatttatgttatcttgcccaactatgataagcagaagctattctagaaacatagatgtgttgaagggatatgttgtggttgtttgtttgtttgcttgtttcactgataatcctgcctgtgctttggttgcagtacactgtgaggccagtgaatggagtccatggagtccatgtatgaagaaaggaaaaacatgtggcttcaaaagggggactgaaacacgggtccgagatatactacagcatccttcagccaagggtaacctgtgccccccaaccagcgagacaagaacttgtatagtacaaagaaagaagtgttcaaagggagagcgaggtacagactcactaacacaacatgcttctttgaatcctcccaatctgatccatatttcactttatatcttatggaatagttggccatatttctaatgccagaagctctaaaatgggtaggaaaagaacactatggacctaagttacagtttatagatctgatatgggttttttctttttagtaaggaacctgacctcagctctttagtgtgatagtgtgataaatgaagcccaaatcaagagactactataagtttttaggcttgattttattttatttttttttgtctgtgatctgccttgttaatgcccaggaacttttgggaagtttcataaacacaaggtgaacatcatctgttgtgagaccataacaaagggacatacccctaccacaggagacattctctacacaattgcttacaaattaaaatggtgcaaatgtttctaagtttcacggtttgaagtaaagggtcaagaccactggggacattatgtctccatgttgctgttctaggcttttgtaacaggttgcataaactattagagcaatattatttatttcaacatttgttaaaatcctgtaagcaccaaggagaaacttaccactgaagatagtgcatgaggtgaaataaatttcatgtagaactacagttgctgatttttaaatgatcatccccatatttcttaatcatgtcctcagtaccactgcctacaaatatgttgtatatctttaactaattatagataattttctagtgagcctatgaatggccgtctccacaagctaattgtcatttgacaggagttgaatacatctgcagatgaacttccttcgcttatgtcagttagtctttcactaattcattcattcaacctacttttattaaactcttacttctgtggccacatatcatgtgaattcctaaagattcatagctaagtagaatcctctctgagagtactatgaagttaaacccagagtccaaagggaagctgagatgtttgaacagatgttcataaacaataccacgtagtaaagtagtttcttagaatcacagaagaggacacgctaaacatgaacattgtttatagaaaaagtaattttgatcacctgagtttttacaaaatattttttatcatatcaatagaattaattgcccaccatgagactgtatggaatcttccattaccactgaaactcagaactagggtactaaaatttttggaaatatgagttatattaaagagaatatctaacttttgtaaatctgtaagaagttttggttaaaacttcgtttcagaaatgcaagttggctagtgaaaacggtctttttagcatttgttatcaattaatttaaaagtcttagattttgaaagttggcattggaagtcaactgcttgagtactctattggtatgctcccatagccacagagttatttctgtttactaaagatcttgaaatttaatgagctacatctggccttcaccatgtttgtttctataaaatctacagcattaacttgtattaagtatattttccttcaagaatataaatgaaatgaagcttattccataaactaaattatattatattttctcttttatttgagaatatgcccttataatatacttctcactgcacttgccataaaattgatgtcataaatgccacttcttaggactagcagctagaagagaagttatgccataaagttgtttgagtatcaacctgtatctggaagtgtgaactgaaatttttgtttctgatctttgttcctcccttccaaggataccacatcattttacattcacaaaattagatttgtggaaatataacagtataaatgttttataatttctcaaatttgataatacatgtactagcaggaattgttgatttcctggaataacattccttgccccactccacttttccttactcttcatttttctgtcaatgagcctgtttcattttttaaggtaggttggaaatataaggaagaaatagaatcatgctcctaattcatcactccttaagacttttcataaattcttttaatgtctacttattgaatatattaccttaacaggggttgggggagggactgtgtgagagagggaccaggataggggacagcaattggaatataaagtggataaataagttaagttaaacagtaagaagtcaaagaaacatatagctatgacctgtgtctgtgctttccataaactatacagggcatgggaacattacccaacttttcacttagccttagatacacagctataaaatacgtgtggtataccataaagtactttgaaatgtaaatgctaagaagaatcaacacacttagaaaggctaccaacaggctaagttgactagaagacataggagttagtatatctagattagctagtcattttttatctcagaatcataaacataagaaaccttcaggcagtttaagagataagaactataaaatgataagcacaagatctatccaccagcatatctatttactgcctaattgctctgatgtcagggcttagagatgtgtaaaacaggaagagtcccttaattgtataccttcaccactgaaagatgggtgaagcaaatggcctagtgatttttaaatgcatcttcaaatcttgatttgaaactacgtctgtgattttcctgggaggatcacagtggacagaagtaggacactcgtgtttggaacaggtgcaggacttgctttcaggatttttttcctgctgagttctaactgccaaaggcggaagctccagggaagaacgatagtccctgacgttcccctacatcgagccttgggctgattggttagaacgtcttggcagtgagcttctggaaactgcttgtctctcccactcaaaccaggatactaaaactcatgctgttgttccatactattacaggggtgctagagatatgaatccgggattggtagttatgtggcagacttcatcagctggtacatctctttactgccttcttaaatgtgtttaaaatagcacccactgctatgttatgtgagggagtgctaactgtactacaaatattcctcagcccctaatcaatgatcttgcccttgtttagatactatgagagatgtttctataaatttacactgcataacaagtaacttcaaaaccgagggtaaaacaacagccatccgtttaaggatctgtgactgggtagtttatacagagatccattcagcaagtctgatcttagctgggctccttcatgtgtctcacccatgttccttcaggatggctgagaactgaggctaatgggctgtgttcaaagtcaagaaggtacatcaagtccaagagagaaaggcaaagtaggtttacctgaggagatacttagaactggcaagcttatccacacccttcttttatcttgtactagtcacaaggtcatttctgactctgaaggtgagaaataagttgtacccattgcctcaggcaaccatgttactttctatggtgccacccaagcacagtcagaaggggaggaaggtgagtgttattgccatgcagagatctttttattgtttgccgtttgatgaatatggtcacttagtctttaccaatctctccttgtggtgctgtctcttcctctataaagcacagtacagtgtggcaagtagttttgtctactttgctttgtgctcccggtgagttgcagacacatacctgcccaagagctagctcagccacagatcacacacacacatacattcactcatttttaaactgccttattggctctgtggctgggctttcctaagccttctgcggctagcatgcccttacctttttcctagctcaacatctttaactctgctctcaacttaacggcccagttatcttctatgaagtccattggccttgctgcccaagacaccatgcccttccatgggtctttttccatttccacctacattttggaagatctaccctacagttctgagtctgttcctactctctctctctctcaagtatctcatctcctcttcctgcccattcctgctggaacctggaagtcctgcctcttgctttccaccattggccactggcgtctttattgatagatcaaaaaccatttgggggcaaggaccttcagtgtcagtaaacactgattcccaattaaatggaagcatcagaaccactcctctttagtagagatatggagtatgtaacttctattgcaccttccatgtataaaatgaagtgtattatgttcccattgcttccaaaactggcaaaactacttaaagaacttttgctgacagtttgatatcaaaactctggcagagagagagaaaggcaaagtaggtttacagagagagagagagagagagagagagagagagagagttgaatactcatctctctctctcctttttatttagtctaagaccgtaccccatagaatggtcttgctctcacttagcctgcctcttcttacatcaactaatctaatatagaaactttctcatagatatgcctagaggtttgtgtcaatggtgtgattctaaattacaccaagttgaaagtaagagttattcatcacaaggagactacaacaaaagattaaaagccaagccaaggagcttgggagatagctcagccattaaaagcacttactgcttttgcatatgacacagttttgatccctagcacccacaggctgacttacaaccatccataactgcagccctcattgatttgacaccctcttctgacctctacaggcaccacacacacatgtggtacacatacatacatggatgcaaacaacccattagtgtacaatcatgaagtaagtaatatttgtttgtaaaaagctagaccaagataaactcatgtattacaactggatggaacacagggccccaaaggaggagctagagaaagtaccgaaggagctgaaggcatctgctaccctataggaaggacaacaatatgaactaacaagtagccccagagctcctgtctctagttgcatatgtagcagaagatggcctaatcagccatcattgggaagagaagccccttggtcttgcaaactttatatgccctagtacaggggaacgccagggccaagaagtgggagtgagtgggtaggagagcagggaggggggaaggtatagggaactttcgggatagcatttgaaatgtaaatgaaggaaacacctaataaagaattggaaaaaatatttacttaaatatctctttgtaataggtgttctaatgtttgagaaattaaaaaaaaagatgccccctttaccagttttttcatattcttggcattaatgtcatacttaatgttcctgaaaattgtgatcaccctcttcagctttcttgtagcaaaaacctatgttgagggttttcattttcataataagaacactagtagctgcagttttcattaaagtttactaacttacttacaaaagcatctactttttctggcaaaatataaaatagaactgcctatattttgttctagcttcaaggcaaatatatggtatttttcctgtgaccaccatatcaatacactgatacatattcttcaaatggctgagtagggttaaaggtacagcttgtggctgtggaacagagtttgaattaatagagcctttggagaaatgacctcaagacctttggcttcactcatagcctgctctggccaactacgattcctgccaactagtagggttccctagagagagactccaagagcatcagcataaatctaaattctgaacccccaaatatagtttccaaaaaggtctttcttgttctttgctaattacaaaataaacaattctcagcaaaaagacacttccttctttcatggtactgtctagctccctgcacccctaccactctttaaaactgctgctgttgctgaggccctttggcacaggagacaaacccatgtttgcagacacaaaaaggatttttaagtctccctctttaccccagcaacttcatagaagccttacagagaaactctgtgtatgcctgtgtctgacagaatggatgacacaccttcttaagcctcccaagaggtgggagggggcagatctaactagaaacagttgatctctgtagcatcattaaagaaaaatactctcaatcttggttatatcatgcatctgtatgagccggttaccagattgaaaaattttacaccagtattcattgggacataggcgctaaaaataacagatctaggggctaaagagatggttcagtggttaagggcattgtctgctcttcaagacagaattagacccttcctgagtttatttccaagccactatatggtgtctcacaaccatctataccgggatctcatgtgctcttctggcatgcaggtatacatgcagatagagtactcttacataaaataaatgaatctttttattttatacaaaaaaaaaaaatgacagttctaaaattatcttaaggggaaaaaaaagctttcagcataggattttttaaattgcattctttcttcattgtttcaattcatcttctgtctcttttcctatttactggtttgttttccattgctgtgaatctttctaaaatttagaagaaatttggctctaaacagattcagtccagggtccatatgtaaatgtcccaatttaccctaatttccctgtccacgtggcttatttcatggaggaatttagttgatcggtttgaatcacatgtccattccttgaagtaatcactccagcaggtatttacaatattttgatttttctacctttcattggtcacattcctacaattaaaactgaatgccattgtgaattgtttgacttacaaataaggatgtacgtgtaattgatccagctcaatacatgcatacacaaatatcaagtgctcaaaaattattcaatgtaaaaacatattctttcaccagatactttccagccaatatgtataaaagcaatttaaataatgaagcctaagagcctaagcaagttttttttttttttgtaattttgacccgatgtgcatgtctagcataatgctaataatatcttcatttaaccaatttttccagtttctgggtttttaggaacatttttatgggattaaactgactttaactgaatccactactccttgaatggtttctgggacagatttgcatataccatgcaaggacagtcattcccatttctagctgcttaaggttctgtgtggaacacaccagtgtgggtgatgacattctgcttaattactcaccatgccactggaactttaagatgaactcaaacttaattactgaactcctgtgtttatgctatacatataccactgagccataactttagcctctatgaggccaggctgctaaatctggaaaatatgtcttatggggagttgttttgtttgtttgttgtttctgttagaggagtctcttttcccccctgcatttagaaagaattggataatcagaagagttgctcaacaaagagtaattatagtccatgagtaaggacagatatgtacatgaacacatgaggggtggttttacttttgcaacaagagcaattggatatttgcaagcacatttatttcttactgtggcataatatctgaattcaggagagacgataatacactaaattcatacttgagccatatgtgtgtgtgtgtgtgtgtgtgtgtgtgtgtgagagagagagagagagagagagagatagagagagagagagagagagcatgcacacatgtgtgcacatacaattgttcatttcaaaagtaaagcaggatataggaagtgtgcctttagtgacatggttagtgggtaaagggtcttgccaggaaggctaatgatatgagctggatacctggggacccacacagtagagggacagaaccaagctatatannnnnnnnnnnnnnnnnnnnnnnnnnnnnnnnnnnnnnnnnnnnnnnnnntgattaaagatatcacacacaattaaaacacaaaagcattaccctaattaacataaacaatcacctagttttccataatataatcattataattaatagataactatttttatgaaatgcccacatatacagagaaatatccctcagggtaatgaatatactttgtaagtgtcagatacattgtctagttgttctctgatttatatcacatactgaggacttatgcttcaatttctttccctcgaaattacaacttagtttactaaagtagttcaatagcagagccctagtagatgaaacatttgtccagcttctcaagtcctattctgaaatgtgtaagaaaaggaagtttatatctatctaaaatattttagtgtgcgtgtgtgtgtgtgagggggttgtggtgtgatgtgtgtatgtgactatcggtgtgactctcagaggtccacgttcagcagtcagttctccatttcctctaagttccagggattgactgaggttgacaggctcaccaggcaagcacttgaacctaagtcttctcaccagctaaagagtcttccttctacttacctgttctacccttttccagctaaagagtcttcattctacttacctgttctacccttttccagctacttccaaccctggggtaacctttttatgttgctcctcttgtcttattttcctacccatgcgtatttacctagttaactaatagacacatatatgaacctaattaattaattatctaattaattaattaatatatacatatatcctgagacaggaccttcccacattcatgtgtaaatgacaaaggtcaatgccagcatgaccctgaattcacagtctgttttttctcttcttccaaaggctgggttacaaatatgcatcactacatccagctgttgcaattttttccttttattaaacatggctttttttcatacataatatatcctaattagtttcccctccctctactcttcacaattcaccacccaccctccttcccatgcagatctactcactttctgtctctcattaacaaacaagtaggcttctaaataatttaataaatacaatactataatatataacaatattaaagtaacacattggaatagggcaagataaacaaacagaaagaaaagagcacaatacaaggtacagaaaacagatacagaagtgaagaccaactcatttgcaaactcagggatcccataaaaacactacactgtaagtcacaatgtatacacagggagtctgtagagtaaaaatagagaaaaacataaatatgttaaaatataagataataaaaaaaactctggcatataaggaatctttttttttaatattttatttatttattaatttattaatttatttgtttatttattaaatgtaaatacactgtggctgtcttcagaaactccagaagagagcatcagattttgtcacggatggttgtgtgcagggggctggtgagatggctcagcggttaagagcgccgactgctcttccaaaggtactgagttcaagtcccagtcaaccacatggtggcatataaggaatcttaaaggactccactgagtttgttttctgtggtcattttctggtaggcatgttacctacttctaaaagtagtttgtttcttccttggagaagactaaattttcatttactagtggttatcaatgggagattgcttcttggttaggcgtggggtcatgtgtccgcttctcctttcagctctagcacttcacagttacttgagccctaggggagggatttaatggaggtatcctacttagggctcagtattccatattgtctggctgtgggtctttgtatttgttcctaactgttgcaggaggaaacttctctgataatggctgaggaaagcactgacctatgagtgtagtaaagtgtaattaggattcattttactgctatgtgctttagtagcatagtcatatttggttttaccct

SEQ ID NO: 1778 - DNA, 538 bp, Mus musculus
gtgcatcctaatgtcagtcaaggctgccaaggaggctgtgcaacgtgttcagattacaatggctgtttgtcatgtaagcccagactgttttttgttctggaaaggattggcatgaagcagataggagtgtgtctctcttcgtgtccaagtggatattacggaactcgatatccagatataaataaatgtacaaaatgcaaagttgactgtgatacctgtttcaacaaaaatttctgcacaaagtgtaaaagtggattttacttacaccttggaaagtgccttgacagttgcccagaagggttagaagccaacaatcatactatggaatgtgtcagtattgtacactgtgaggccagtgaatggagtccatggagtccatgtatgaagaaaggaaaaacatgtggcttcaaaagggggactgaaacacgggtccgagatatactacagcatccttcagccaagggtaacctgtgccccccaaccagcgagacaagaacttgtatagtacaaagaaagaagtgttcaaagggagagcgag

SEQ ID NO: 1779 - protein, 180 aa, Mus musculus
  VARIANT (1)...(180): Xaa = Any Amino Acid
VHPNVSQGCQGGCATCSDYNGCLSCKPRLFFVLERIGMKQIGVCLSSCPSGYYGTRYPDINKCTKCKVDCDTCFNKNFCTKCKSGFYLHLGKCLDSCPEGLEANNHTMECVSIVHCEASEWSPWSPCMKKGKTCGFKRGTETRVRDILQHPSAKGNLCPPTSETRTCIVQRKKCSKGERX

SEQ ID NO: 1780 - DNA, 99588 bp, Homo sapiens
  misc_feature (1)...(99588): n = A,T,C or G
gtttctctcaaagaggcatttagaagatggtcatgcagagaaaatactttcatacagtcctcactaacaggtatgcgtataggagcaattttgaaaacagttaatttttcaaagaaaatgagtaaaaagaaactatatgcattttgccccacatccttgcattccataatatatactcacccactttccatctttggggcatgttctgggtaatttttcttccttcctatctcatgtcaaatatcaggtgaatttatgtcattgttttgagaacaatttatgtataatattttatgcaatctcctcctatgtttaggaggttgccataatgtgtcaaatgtagatttttcttaatacttcataaaactatctctagaaaactaagtgcatccttttactaagttcatccctagcacactcacacagctccttttgctgctgctttttcttgcagcttctgcttctgcactcacttttccacctcccttagttactcggtgtccttatcagacacaggtctccctcatactcacacttcataatgcccctgaacaggtcagaccctctctccttgtcaaatttcagagatgtgttcagaaggaaacaatctaactaaaataattcacccattcttaactttcttgggaatatttgcatttaaaataaatttctaattgtgatgatttcaagtagtatacataacgatgtgaataattttaacaatgctaaaaaataagtagaggaaaaatacaaatgtacatgaacagagggaaagcaagctacacatacaaacataattatttgaagaagaaatcctcaaggcattagttgtctattagaaaccaggctgtccttgaatatctagtataccagttcttttgggctgccacaacaaaatactttagattgagtaatttataaaacaacataaatgtatttgttacagttctggaggctgggaagtccaagatcaaggtgtcagcagagtcattgtctgctgagagcttgctctctgcttcaaagatggcacctccttgctatgtcttcacatggaacaatgggcaaagggagcttcctggagccacttttataagggcatgaatccaatttataagagtggagccttcattacttaatcacctccccaaaggccctacctctaaaaaatacaatcacattagagattaagtttcaatatataaatttggcagagagcacattcgaaccatagtacagtgtatttttttaaaaacacaaaagacaccatattgtatataacttacaatgttactttaaaaaagtattgattcttatgatcataatggtgaaaattcaccaaaaactcatgaaaacccaatatatcattcctaactaaatcagagaatcaagtcacaatgaggaaataaatccattagttaaattgcctcctttcctaaacacttaaggtaaatctatgttgtagggcaaaatgattgtacctcatgtcattaaatctcagaattatggaatttaatgagatagtgcttcatgtttctatgcactaaaatgataagttctgctgccatttttagtagacaaaaggaaggcctcctggtaaggaggcattttcacaggattcttttcaatgagaagatgtctatattatattcacaaaccttaagtaatactatcctagctcttaagacaagagaaaagggaaggaaataacaggctgaagaaaaacacttgtgacttcccccaaaatgagaacattgaaaagatttttctctgagttccaaaccataattgcttcttatttatgtacccaaagctgaaaatttgtcccaccaatggcctggacctttgtactgctttgattttgtgaggcttcaagtatagaattaaaactcaattcagagaaagaactgatctagaaccagacactctgtataggtggtcagatagggtatatggtaaacctcagttttgctttcttgcttcaattaggtatcaactttctgactggccaaagagctccacatttggctttatacagaggttaataacctgcccattagctctggggtggatttaaaatagcctacaattctttgcagttcctcctatcaaaagataaagtctattgggtaaattctggaatctaggctggtcttttgacttgctttggtcaaaaaactgcagtagaagtgacgcttgtagggcttccaaggggccttgcaacttcctctctcacacttctggaacccagagagctccacgctcttgagatgtaatactacctgggaagagaggcctgctatctctgctgtgtcagctgacctgacagctggatgtagcatatgagagagcccaggagagaccagcaggagagtcagtcaacacacaaaattgtgagaagccataaatagttgatagtttaagccactaagtttagaagtggttcattatacagcaatacgtaactgatacaagctccatggaaagaaagtcctttgttctcctctatcttcttgcagaatacttctcagtgaggcaatcttatctacaaatatagaataccacctgccaaattggaaaaatatcatgaccaccaggcacctggagctttttcataatggcttgaaaccgcctacacctgtgacataccccacaggccaaagtgaaatcaaaatatgtttctgggaagaaaagattatatggggtgaagagaaggagagaagggcagagctaaaccagccctttatcactagtgagtaagcaaggattagatttcagaatagggaacttttagggtggggagagctggaaagcagaagggatgagcctcagcaggggatttttgataaggatgggtgcacaaaacactgtctggggagagcatgttacaaaggaataccagaatgtatagagagtgcttgggcatggagttggggcaagagaatgggaacagccagacacttacgaagaccaaccctgatttctttggtagttactctaaacattttcaaacacttgtaggaacaggggaaatgaaatgtcatctttctcacatgagaggaatctgtccacattctcactacagtaaaccagtcaaatcattaacccacacaaacccccacacaggtatcagccgtgaaccacactcccacaggatcaccactgagccacaggaattgctggaagaggaggaggcctgatgccgctcttcgagtctggctacctccctagcaaacatgtagccaaccatgaccactgacctcctcaaagcaaggcagaaaaggggcttgcccccctacctctgaatcagggccagcctaagcaaaagaaggaatccttccttatccccattaagattcaccattcgttctttaaaagctgtattatcttagacacagaatttatctctttcctcaccactatcactgccccccaagtattgttcctcttcccttccccacaacacaccacagagcccttatgacacagcagttaccacatggcttatgtgcctgcttccctcactgagggtattcaccttgagggcaggggcctagtgtccctagttttgtatctcttgggcctagcatggtgcttgccacatgttcagtgagtgctgaaataaaagtagccagacagccaaaagtagctacccaaagtggcaccagcagtaacaaatataaaccataactgatagtacatatataggtggagagaggttttcattctgttttgtttatgaatatggcagctttgaagaggtacttcctaaagcttgttgctgggtgtgtccagttcatttctgtcataaaccatagcattgcttttcatctgagcaccaatagaacccctaatataattccttcactgttcttgccttaaaggccatgcacaaaactctgcttcagtgtgtagcctggagttacccatagtaggcaccatcaacaaatattcatgggatgaatggatggcacattgacgttagctgccatctttcagtatgctttccaataaactacccttactcactgtggattgtgcaaggctcgttttggacctaacaggaaaaaataagtaaaaagtgacttagtcaaaccatgctttaagatcaatgtcagcttttgctgctgctgtttcttgactcccttgttctttcttttcctgtgacttcttgtttctgattgcctggctataattttaaacatgaactttgctttgctctttgccattctgattctagttattcatggcgatttagcccatgaccttgctctgatgtttgttgtgtgcccacttccttactttataagccttcctggcttgtaacataccctggccctctcccttcatgcaacttagttttaatcagagtgcattcctctggaaaggcaggatgacatagtaggaagggcactggcattaaatcagacaacttggtcacaagtccaagcactgacacttttgtgtcacttagggacccagcaagaatttttgaaagacatttttataaaatggccattttctatagtgcagacagggttgaagaaatcaagaggagatgttgaggcaccaaggaactaaaaagagggggaagccatttctatccctaagcccgaggagtcaaggagggtaaatggtgattctgaaacctacttgagtgctagagccacagaaaaaggactgcatgacagggctgtagtctcctgaaggatgtggcaaatgatgccaaagcagggaaggagtggcatcacttttccttcccatgatctgatcacccacaggtacccctggctaggcctgaactcaactggaaagcagaggaaaggagctctggttatttagtttatggaagtcaacttcttgggggacagagaggacagagaaaatagactttggggtaatacaaaacagccagaatcttataagcttaagcaagtgactttatctttctggattcggttgtctcatctatgagacaatgttttgagataatacatgtaaaagaagctgcaaaaattactcattggtattatccctcatctagcactctacatcttatacttttttttttttttttgagaaagagtctcgctctgttgcccaggctggagtgcagtggcgcaatcttgggtcactgcaacctccacctcccgggttcaagcgattctcctgcctcagcttcccaagtagctgggactacaggcacgtgccaccacacccggctaattttttgtatttttagtagggatggggtttcactgtgttagccaggatggtctcaatctcctaacctcgtgatctgcccaccgcagcctcccaaagtgctggaattacaggcgtgagctaccgtgcccagcctacaacttatactttcatgtctttgatagtaacccttcaacctaaatctgtgaccacaaccactcaaccttcactgttgaacttcagaagaggttcctgggatgaagggtacatggatataaatcctcatccaaagataagaataggaaaaataaaatgtgacttttatttccaactttttattccaaaaaagaaagtaataacataaagataaaaagaatggctcttagtgagatccacattcctccctcatctgtgattcctacaaacaggtctaaatgagtgctctctttatgagatgcagaagtcctttttcctgctctctgtaggactctgcctagaatctcgagtttataatttgttctttcttgttgtcccaaagtctgcagacatctagacagattgaacttgtcctggatttatctttgctgggccagagtcatctaggattcttgtaatgggttaggcatttccagaaaatcaacaagtttgaaagcagatttctaaatctggacctattcaattaaacacaattctgtaagtaaaagctgtgatgtcacacaactagaaatagctctgacatttgcaattacaagtctgtctttctttcttagaaatagttacattattgtcagagctgaaaggaactttggaaatggtttagttcaatttcctcatttttcagatgaagaaacctgacacacaacaatataagtagaaaacaaggactcaccttgatccccagattcacaatttagtgccctcttactacaacatacagcctctttgtactaaagctccatgatcatgcaaaattttctgagctgttaaattctttatattgagtactattggatattcacattttaagtgagcccagcaatcaattgatttgtgaaataagttttaaacttaggcatataccagatggtgcttgccacaattacataaatgtcccataacttcatctgggaggaagaacattctttcttgttgacagaaagtaatccatcatgggtcttgattttctcattttcttaatgctatataaccatataatcactttttaaattgctacaataattctgtctcctttctttctctctctaaaaatagttttccatcatctactaatttcaatggtgtttaaatgctgctacccactctgtatttcagggatgacttctagctgcatcagttacacacatcccaccagcagtaccctgtttgacttactgactcagatgcatccagatctgagtaactggagagctgtgcattttcagaatctgcatattcgctctgtggtataatgactgatgtcagccccaactttgccaaacatctctcatcactactagttatatccctttccaaactattgggcttgctctctctttctggagcacaccccctttcacatatttgcagtatggattcaacaatatgacaatcattttctttccttagagtgccactgctgcaatggataaaaataacttgttactgttgtcactgcctggttggaataagtggaaggagagatgagaagttgcagtatctagtcgggatatgcttagcctcctatctttgttcaaagctattctattctcctggcccaagtctcccagtctcctggttatccaaaactccctggaactaatgtgttttggagaaaaataagcaaatgttgacctctatgctgagcctatggtttttaactttctttaggcttgagctctgaaatccactggcagccacaggctactgtgagtgttgttttcttgtttgaagaaaaaaaaaaaggtactatgttttagaaaatatgccatggcatgcttttcataagcttctaagacagttgagggaacgtaaaactcagccaggcaagtaaacacacatttaatatgacggtaatatggatcaggaaaaagttattctaaagcacagcatcaagagagaaagaatactctcctcgtttatttaatgttttccttatgtttcctctgagcagagcttattccttgacaagcttttccttcccactgcatctagcacttcttttctgggatggctcaagaactgtagcttctcatttggtttgtttatttacttacactgccattcctgttctcatccaaactaacatgtgtctgcacaatgcacagtgaaaagtaaatgtctttcttcatgtttatttccctgaagttgttcatcaaatagctttttcacatcccttttgcaatctcatcccatccggctcaagtatcccagattagaaaggctgtctctggagtccttttcaaagggagcctcccatagtctttaaatcccccatgttttatggtgcagatattcaggatttgaggtattagcaagaaggaaagcaaagcagatggggacaggcacagtaaaatagagtggcttcttttttggataatcattattggaattgtcttgttatctgtaacttcgctggttcaaagtgataaactcagtcatttataagtagacattttgcaacagataaaggatggaaagtctgtgtgtgggggtgtgcacacacatgtgcatacaatgtacagaaaaagttctaccactgaaagagggatgttgtaaatgggagctcttaaaaagaaggcaaaaatcataatcctgttgaggtgtcatcttcctcataatatcaaacctaaaggagactatgcctactttcgaaattccaacacgagcatgcaaaataataaatgatatttaattaaagaattaacatcaaaaggccatctctcagattctaatttttagcatcttgaaaataatgcatatttcaagttcccttccttttgcatccaggccactttatcgcctctatcctacttttgggatgtataacaaatataccactaaaggactccagagacatacaattcacagcattgcaaacttacaaaatgctctaattcatgtaaatttacctaatttacataaattgaaggcaatccagtaatagggattacaaatggaggaaggagatagaagtgcaagtgtcacttgctactctgcaaggctttagcaattgacttacactgaattatttgagcacaaaaattagcaaagcacctatgaatcagggactctttcaaagtgacctcccagaagtttgctgctgtgttaacctgtagtgctagtgtagtccttcagatattctgttaaatataatacatagggcaggcttatgttaaaatcacttgaggcttgtgactttcgactaaatacttcttcagtaattactgaaaagttcatcggctggtgctaccggagaaaagacgtggaaagctcaccatttactaacgacagccagggtgtgccccactcaggggtgccggccctctgttctcccatccctgggtgggccagagcatcttactctctgctgccttgggcctccacttgggctgggaagataagaaagtagtggaccttccccttccttccccaagactgggaaaatctttccaaatcttattcccagtcttccagatgcgagattagaatgtacaacagatcctctcaagaacactgggagaccgagggtgggagagaaaactccaaggggggcgagctgactatagagggaattgcctgagcgggaaaggaatcttccaaagccacagaaaagccttggtttggaagaaagccgtagcacagctgcatttccaacgggaaggtcctgagcgcacacacttctgggtcctccccgctcggagcaggtaaacctcagagtagctgaccggcagcacccacagagtttcctccccaccacccgcctggcgaccaactgcagccgaaaagaaagaaagaaaggaaagaaagaaagaaagaagaaggaaggaaggaaggaaggaaggaaggaaggaaggaaggaaagaaagaaagaaagacaaagaaagaggaaggaagaaagaaagaaaagaaagaaagagaaagaaagaaagaaagaaagaaagaaagaaagaaagaaagaaagaaagaaagaaagaaagaaagaaagaaagagaaaaaagaaaaagggagaaaggcaacagaggagaaggtcaggaaagccgggaacaagtcagcagccagaaactctccagcgatctgccaagggggagagggtagttgcgcgccggcgctggggatggggtgggggcgcgggggcacaagggcgcaggggcgcacggccaccgacagccgggtgcgcctagcttgaggccgcggagaggagccgaactgggatgggtggggggtcttcggcctcaacactgcctgccagccccagtgcgcccaagtctccccgccagagctgcccttctggaggggctcttcgcacgcactgctttccccattcttctggctggaattctccggccgtcactgcagtgtccagagatgctgcgctgtagacccgggaccccttaggcgcctcttcccgtccctctgccaaagcgcaacgcctgtacttttccagctccctctttccctcttgaaattgaaagttattgaggtcgctcagggttgttgctccagcagtttccttccccgcccccgagctcccccccgccccccacagccatcccccctcctctccccctccctgccctcctctccctcccccctccctgccctcctcctcctcctcccctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaagtaagtgcagggttttttacgcgtttgctccctcccgccgcgttcacctgtcgggtcgctttgcctgtccggagccggctcccaactgcagcggtcctcccgccctgcgcctcgcagaggagatgcaggttcgggctttgggggtatggacggcgtctttcacccttgcctctcggcgcccctgccttccgcagcatcctagccggtgcgaggggcgggcggacgcggcgctaaggtggctcccgccccatggtaacttcaggttcgcgggaaagttcggtcctgggttagactcgcacccgggatttgtgctttccttttgaggatcggacaggggcacccagccgaaggcacttgggactcccagacgcaggatgcctctgaccgctgagtaaatgacaagggaggcgcggccgcggtacccgctcacctagcgcaaccgcctcgcgcggggagacctcggctgggcccttaggctggactccggtagccgaacgcccgctacccggccaggaagccagggagcgagcgcctgcgcggccgcatccccgacacgcaccagcggagccaaagggcgcgcgaggcgatggggttcgcgtgtctgcgcgtttgcagagctgccggacgtcccccgcccgagggttgaagacagcaaaaccccagctgtggggagccggaggtgcggagtttccaggttctctcttgtcacatgtgagcgtctgtaccatctctggccctttcaagtgtgtcccctgggacacacacgtacagagagtggggtctccctaaagattcgcctcctcgctgcccttaatgctgttatttggagggttggattgtgatggcttcttaagacggtgtcctagctggaattaagcggacaccaccacggcagcctcaacctgggttggtctgtctgaaaggtagaatcttcccaagatgaagggacagatgcgaaggtgtcacctctcctcgctccagggtagcctggcgccctcgctgctctagtgtctgtgttcccatggggagtcctttcgcagatctcagagcaggggcgaccctggctctatggttgggggcgctggtggagagagggaggaggaaacttctcctggagctcgcgaggggcaggaagcgatgctgctgctctgggctctcgcacctccgcggcgtgcagcccaggcccagcggccccacctggtttcccaaggggatccctctcccagcgtcccgcccgggaagcctttcggggcagacgtcggggcagcgcggaggacacaacaccggcttgtgtgagatggaaatttagtaatcgcttctcggccgctgtttgtccctgccctgcccctgggcatgagggtcccctgaaagctccctttgtattgctggcctcggccagacaaggtttgattcacctgaaaattgccttttaaaaaggtggcagtgccagagcgacaggggccctggccgggcctcaccgcctttaggatcacctagcagggggcaggagagcccaaactaaatatgtcagggcatccgatttattattcttggcctccgaatggtgtgtactctggtaactccccacccactctttcattccggcccggacgcggaaggggaggcctggggttcagcggtgtccacgcgcctggcggtccccgcctcctctcctcccagggtctggcctggggaattgagtctcagggtcagtgggcatagggagcccgggctggagcgcaacccactctgctttccatccgctcttccagcccgtgcccattgggcgtcccagagcacgctctctcctttacccccaccgaggacccccgggctgggagccacacacttgtcaaggagggacagggtactgagtgtcagaggcgtctcgctttgcagttttggggcccctgattctgaaggaagacacaggaaagaaagcttgtagtccttttgtgcccacctcccccagcgaggaccacggcgcaggaagctttccccgggcgctgcctcagggagctgtgggatgatgcacctctaggttgggccgagaggagtcaaaaggcaaactgcttttcgacctgccttaatcatctcaaggccaagtcaaaggagacctctgtttgtgttgaggggatgaaagaaggaatagtggaactgggttgcaattccaatttttctgtgggagtgggactgggagacagcacccacagcgatgctcttgctccttcgcacttgagtctgcgtttgcggcttggtttgctggtgcaatcctggtagaggggcgaccccttgcgtcctcggaggagacagactagactcttggcaggtgcagtatgacttaaggaggaaggagtggagggtagagaggtcctctttaaatgcccagaaactcaaggtcaaactgcatgtgcacaaactcagatataccgtttgttttgaaatctctgggggaaaaaaacgaacaaaaagattcaattcacagttcctgtttctcaagtaaggactaggaaaagtttttaaaatgaaaacatgtggtcaaacgtgttttcaaaagaggctggctatcctaattgtttcttcaagagacaattaagtgaatatttaaggagtcttctggcctgtagttatatagtttcaatttcctaagcttaaaatcatcaataaagatatgacaggtagaaaattaggtgttaaaaacttctacaaaaaatttaatggtctctcttgatttagtaggaaacttttttgtaaacaagaacattcatttgaagtgttaaatattgtcatgtccaaagaatcatgcattatcctcagaaatagcaaataaagccatatcagtattctcctgtttccctaaaacaactgtaattccatttgtctctactttgatataaactagtgatcctagttattacaaactagtgtttcttctcataaaagaaacaatgttttaagacaagacccttgtactttaaaatgtctatttagttatgggtgaataaatacacaataaatttttatctatttgaattggtatacagctcttaaaaatgactcaacctttgaattccagattgtgtgctaataacattaagaagcactttttttttgccataatgatagccacagaatcttagtggggcctcacattttcacgtggattagttgcttgggccctgaaatagccactgaagtgaagaagcaggtacttatcttcccatcttagaaagaaaaggcctgagaactagaggctcagtaacctacataatgccatatatctagcaagtggaacttgtctcctgccatgaatctcacagttatgtacacctttattctatattctggtcatagagaagatatcaggtttattaagtaataaattagatggtctcaaggccatcatttattcaataggtttagagaataaactgttctccttgactggaaatttttgaactcattattttatataatggtgatcaatgtcaaagaattaaatacctaatagtaaagttttctaaacggaatatatcatttgattatctaggagatactatgggattattctgtgccagaaggttattgttagaaacatcagatggcatttagcatcctttttatttgatgccatctagtagctcggttttaattgttcagactctagataaatgcaagttttgaaaagccattatatgcataataatttaaaagcactcattgcacaatctataaaacttcgcaagtctttcataaagacgtctgaagaaagagagaaagaataaaaaggaaataattttcatggtaataaaataaaaacagactattggaatgtactggtcattgctcatgacattgtttcagatgttgagccagtctttgaaattatgacacaccctttgtgattatgttgtgaatcctggaaaataacaagttaactgataaaatagaaaaatctttaattctactatacattttgtaatattaatttcaaatgaaagtttggtttggatattgactacaatgtatttttcacacttgtctacgtttctcaccagtctgccttatttttgagagtaacagtgttttaaagatacagacacgaatagaatttgctgaagaaagtgtattctttgatacgtcgtgtaacagctgtataaatcaagacaaatgcaaattcatatgcggtagtggcaacatctaaatgcaaggaaaaacatctttgtgaactcaaatttaatcatcattacattatcagggttgtttctcaaaatatcccatggtgacactattttaattccgtttattactttaatagaaggattttaacaagaacgttagaaatggtaattttaaaataccttctttttagccccaagttactcaagtaatgagaatgtaagaatgagtatgaaactgatttaatgttgttatttcaatattcctttaaacatgaaatatgaagagtatttgaacttgcaaatagataagctttactaagtcatttctccattaaataattccctggcatttaatattgtacaaattaggtccccagaaagcaatgaatggaaattacaacgtgtagtaaaattttattttccagttattatggggaaacccttgctgcattgctccaaaatgaatttattagacatctgattattttagattatttgaatctggacagagatctccagattgctactaaatgtctaaaatattttctagttcaatggttaatctttttttagttgtaataattcttttgaatcctatgcaatgttggcagagtactatgtagagttttcagagccctatgtagagttaagaccaaaatacacctctgcaattataagaatgagctatgaaaaaataaaactattctagatatactgatttgccaaattgtcttttcccctttgtctccatcccaatgtttcattttggacatatcttgatctctctcttcctacttcttcactattcactcacatatcccatccccaccccaaaaaaattattttccaagtagtgaattcttgaaatgccatcagagtggatattgtgtttcatgaaatgtaagaaaaaactttggttaccattaggaaaacatcattcagttttaagagcacagtaaggatcatgcaagacagtgtgttgaaattatgtttgacttggttaggactatttcttctaacagtgcattatgtgctggcattttttttttgaaaataataatttgaaaaaatgttgcatcataaattgcacagttttttttttgcttggcctttgattttaagggcaaatgtagattgctttcttaattagagatttttctcagggtttcacatgattgaatatcttaaaatttaatatctgacaacctagtaaatttgaaatgctttgcaaccataactaaacacatgaagtacagcatatacatatgtaaaagatgctagccatcttttctgtttcttcaattctgcccatcagatctttccattcaggaatattactggcattctgattaaagtagtcatccagcaatactgaaaagaatggggtgttccattctcaaagactgtgggggtgctgagaatgctaaatatctaaatgtcattgattgctaagaatcccattttctgctctaaagtttcaataacatggatcttttaagcaaaatacctgaattcttttcacatttgaactgtttgaataatttttaaattttatttttaaaaaacagggttgcaggtgcctcttatctgataagagcatttctgctttatttgtcacttggcaagggacctaggtgctatctgctgtagctaaaatttttcttgaatttttttagagaaaattcattggtactaaagaatatgattgtccaattaaataaatatttaatggcttttaactgtccttatgttttatgcaaacatctaatctactcttcaaaacaccgccttattaatgtttcatctgacctttagaatttaattaattgcaagtatcataagtttgtggtagaatctgagacctgagaaagaaggctccttagtgtatgttgggagaaggtagactcagaagttaaagacctgggttccagatccagcattgctgctaatgcctgaataacccaagaaagtccttttactataccaagctaaagtttttcatctgcaaaatgaggaggttgatcaaaaacttagatctagtgatccctacggtttcctcaacatttaatcttttggtatgagaatataagtcacaactagggagttaaataataacttgtcttattcaactaaatttaacagataaagattgagtacaaacaaacataaacattcattgattataagtaaatttatcacataaaggttaacgagtaagtgatcaatgtggataatgaattaattatgatatacctcataattcacattttttattgtctgaaaaccatagtcacagcaacaatcagcatactcagtctaccccatcttgtccttaggctcagggttagggagctggatcagaatactgactcaagggtcacttcagagcttccctagcatggcaggctttcagaggtggcctgtaattatgaggaagagatgatttacaatagtccaggtttaagaaaataaggccctaggctacaacagtgaatgactgcacaaaagagtatatacagcagataatttcttttaatcaaatcagtagttcttggcaattaattgcatatgaaagggaaagagatggaggcccatatttggcaataaactttggagtataaggactcaggtctgggtgaatggaaaaatgatgacgatcaacaaaaagaaaaataggagaagcaggtcttgttggaaatctgtttctcttttgaggagccagtaggacgtttaggaactcaaaactcaaaacacctgggattagagtattagggctgaacacaagtacttcagagtcactcacataaaaatgatgtttattattatcaaaagtgtgtgctctcctactgatacgggggtgtaaaaaatgtgtgctgtgatgacattgagactcactcttcttggtaatgtcaaaataacattaattacattaaggtaccttgtctattttaagtagtttaatatatcattttcaactgtggttttttatggtttttataatactctctgtgttacataagaggatggtcactggtatcataagctgtagttgttgttgccaaatcttgcagctgaaaattgcacttagaagtcttcttacctgtggaactttgccacagatcataaggagacctgaaaaactatgataatgaaaggcaagtttacataaggtataaaaataaaattttgaaccattgaattgggtgcagtatctgttcatcactgtagcgttctacttttaagtagatttctctacaaagtatgctctcttaatataagagaatctctggaagggataaaacttgaaagaatccagtccatctacacagtgtgggatcacttctacaacatccccactgagtaactgtctagcctcagtaacagtcagccccctaagctctccccctttttcctcctatttttagggcttctgtatccaaagcagtttattctcctagtcctcttctttgcacttggcatgggcatggtattagatctagttaccttaaaacacctttctaaaatgaacacacagtaacgcaatgtgctacattcactcccaaaaattgtccttagaaaactagctggtaagcatatttataattataccccaatacaaagcacattcctgagagtaagtggtaaagcagcccccattttataaccacataatacaaaccactaccacacaatataaaataacagaatttgtgagctgcttattttagaacactgttttcttaacatatgctcgataagttggtaagaaaaacagcagtcctttctcattgttttttgttcccctgttctacaaagagacttcaaaggtaagaacactgtcatctcaacaaaggctgtcatatatgcaaagcaaatatcaatcacattttgccaacaagaaataatatgccaaagtatgtgtaagtgctacatggcaaacaacagctttttagctctcagagccactgttatatttatgtacatcttatctaaatatgcatgtatacttactaaagtgagtattatgataatagttattactcaatagctcccatgttataatcaccagtaagtgccagaccctttgcttgatgcttttgcaaaaattatctcatttgatcttcatacccacctgtaaggaatgtgccaatagtcccactttcattgatcactcaaggaattgaggtggacctcagattccagtctaggctagactccaaagccaaggtccttctttgattcttcactccaccttaacattagggttggtacttgaggcaatcatggtgcattttctaaattccacccactctttctttctcttactctctcttctttcctccttctttctttatcctcatttaacaaaccataagccttttttcaaacatttactataaaggttgcttctggtattcaagtaccctcctctacatcgctttcttttccttaccctttgtcctctctttccttaaacctgtcttattgatgagttttaaacataaaagtttgctgattttttcattaaaagcaataggattgcacagtttatatgaaagactctgtgattgttatttccatctatggtgcgcgtaaccaagaaaagattaatgtaggcatgagaatgttggaaaagtctgtaattttgcagttaaaaatcagaatccttctatgtaatttacaaccacaatagatattttactggctattgttatccagaaaaagttatctttatggcacttcataaagtctgttatttatattacttttaccatgagcattaacagtaacctccactctgaattcttgctttatgggtcttggtacaatgattttccgccctgaggtcacattagaatttcctggggatctttaaaaagatactaatgcccagactccacccttgaacaaataaaactatcttctccacccttgaacaaataacacaatctttggggatggtacctgaatatctacattgtttaaagtagttctggtgattctaatgtgcagccaagactgagaaatattgtaagagccttaattcaataatgactattgcagctaagcaaccactgaaaaccatgccagttttgggaaggctagacagacaaaatagacgtatgtggagtgtgattacaaatgagatagatgtcatttgaacaaatagtagtgtaaaatataaagtattctgatactgttgatcaatactctattgatctgtattgttgaacaagagtattattaaacttgtagcactgattggtacagacaagactgtctgatagagaattatctcagtcaaaagaacagagcaaaatgcacacaataggacacactagtgaatgtaacagatgctggcttcatagaataagaacacagctactaggagaggtacaaaccatgggggagtgtctttgctgctgagctatattgtgtggagggagtataaataggacagttttagaagatgggtatcagccatactcaaactttttttcaaagctacttaataataaacaactgtttttatgtcttaccagatgactggtaatgtgccctagagtcctccttgtttttagggaaaacttaatggttaggaaatacctaacgagaaataaatgtccttttcttttatagtttctacagttcctgactcactttagattgactactggtgatcactaaaacgactataaatagcacagttttaactctaccttaatgggttctgttttgcagtaggtcatttattcatgaacttatcatttctacttcactcctaatgtgctcttctttgggtagttatctccattaaatcgtgtttatgagtcttttttagtccatgaaggattttcaaatcttgccataaactggggaaagttccatgtaaaagtggggtggaagtctgggcttcctgacagacttaatcctgctagttaagggggctctttgggataatatgggttccaatgagtcactaggccaaatcccaataaccgcagttgccaaaagtaattagactgaagaaagccaggctccttgggaggaaggtcatcacagcgagctttagccattgctccaacgtcagacctagttaattgtccctaaggatggagagcaatcatgagttccagagagtaggaaatataccagaaaacaatgctttttcactaatttttttcccaataggttatttaccataagcgtgcaagagatggaaatacgtcatcagtatgtgcagtttatgtcactatcctcataaaccaccttgtttgcctgtgtgaatgtacgtgcccacatagagaactcccaattcatcactacaagttctcctcctcccttcctgagtagataaagaactcaaagaatctagtctaagttcataaaagaaggtgtctgactagcatggaaatggaagggaaggaattcttgtaaacatccttaggtcaacttaaatatcatattattgaagtaacatttggcaacaagaaaatggtagtacattatatcagacaagcaattctaaaatatctggagctagaacaaacttatgatttcttgtactgaaaataattcactttagaaacatggtgttgtaagtatctaagtagaaattatcaacaagtaagtggtgctataattttaagctttcaatatttgagaaattaaaagattgttaaacctttccctaggaaaatactcaagtagcacaaaagtattcttgctcaatacccaaagtaaaaatttgcctttgaaaccattggcttggatacccagaaaagatactccatcactttatgtaacggatctttaattgaacaaagacactgtccttacagtggtaagtttcaaattcctttatggttcagaatgacttcagtatatttcagcactcttttgagcttagactaccagttctcagtttaaatatgtggatgagtgatattgcttattttaaatctacaaacaggaagtcaaactctttttctggccagctttttctggcaactggaaatctccaggtatcatctggcagacaaataaaccctgtccttgtgcactgcacacatctaatagttatcatgacctgattgtcactatggccaatattgtggaacaatgtatttaattttctttcatcttaaattgacaataagataaccaaagaatagaagaatcctaattttggaaaaacttagcaaaattttttgctgtgtttacttgtaccactggtcatgtagtttctgccataaaatacaaacggtatggacaaatgctgcttggccacaaactgaggacatactgagaagctacatatttgtttcttatagaatttagttttgtttttcaatttatgatgagtttttttttatatggagtccaaaaggaccctcgttgcttgtttggtaacaaggaacaaggtccaaacatggtatccttagcccctctgactttaattcacacactctcatttcatgccatcctcaagatggtaactctcagtcccctccacaaagactgaatataattttaaaaggacagtctttctttcatatagcacatttctaagacatccagccaactttccagttctatccagagcttaatgtagatccaagcttttaacacagatcagtgggatttccttggaggccagttaggcttgcagtatcacatagatgcatacttggccctagtacaatcaataacatttgctatcatatccagcctgtgtttttaaacctgtgggcattatgtgaccataccccaaagtttagtttctaacagaataagggagagttgcaggaagagaacctccaaacaatttcatgctataactaccatcttcagtatccatgtggacatcccattgacattccaggaattcattttaaactgtttgcctctgaactgagtatgtgctctaaggagagcctacgatccaagaaaccttcatgtaacagtttttacccaaactatttaattcacaagctgttgggctgaagtgctctaggtcatcagataagaacacattcaaatgaaaattgccaagattttccagtgcaggatattttcgtcacccttcctagctcaaactcacttcctcatccactccacaaattctaaaccactactaagatgagttgaacagtcttaattttataatcttccaaagaaaaaataaagacacagacagccgagttaatttataaaacagtgctgcatttatcttggcagatgtcagttttccccccactagctctttcatgctgactacttagcaactcatggaggatcaagtcattcctatgtatcaagcaccttgagaaccattgcactgaataagtttggtgtgtctcttcacacacttcttgtacaaatttctttcctcatagacaatttatttactgggtctctgaaacctaaataatccctttactttaaacctgaagcaaatggagagtcatttttacaagagcaataaactaaagtggctgttcaaacactttacttgaattgctctgggcactgaaatacctttttgttaatacaaacccttcatattctagcaggaaaacccctgaaattctagggttgcttaaaattgtgtaaccaggaatctcccctctcccccaacaccagccccctgatcctgggagtatgccagtaattttgcaggattcattctgacaaactgttctggtgtaaatgtttatagaaatcttttccactagagattaaacaaagtttaagtaactgtgcctaaatgatagatcttagtagtgtttgcaacagcaggtctgatgctatctgatgcaaagattctgatactgtatactagagaaaaggctaaaggaaaaagaatcaagagaggagttagtatgaactgtatgtaatttgaactgcaaaatattattctaagttatctctatacagattagtttttttaatgtgcacaggatataagggaaatgagttcatttaaattgaaaaatagtaaaaactgactactcgtgctttaatggcttaaaaaaaggtgggggcaattacaaatcttatcacatgccagttcaaatgcaattcttggctagttctccaaattctcaccaaaatgaagtaacatatctgagatctgatctgatgtaagctctggtatccatattattatgattcaaaaactactaaaagggataactgctgagctctaagccttatattgaatattatttattaaaacagggtagtaccctaggcctcaagaggtgaaagcaaaccagtgttccctttctgtgctttcctgtttgcacagcattttcaagtgtttattatatactaagggattacacagctaagcaattaaaaacctcagaaacttcattgactgaatttcaaattaatgctacagcattaatgattcctgtgatactagactaggaaaggcatatgtcatttagactagttaatgtttcctctttcccttgatgatttaaggcctaccttaaaatttaagaacccatgaatcttaatttcatttctttgttggtaagtcacaatatgagatttcttcttaatatctggagattacttcctcattacagacataggatttttttaattttaagatttttttgtgaaaaaccattttagaaaaagttcaatgtaaataatgttaaaacatatgcaatggaactttactcctttttgttttgcttcaaacgtaatggcagtcattcactgctaagtttccagttgaatcctatttaaatactgtatttgctataaatgagcaaggaaaataatcaaaagggatccatggaatatgaaatagagactttataaacttaattggaagataatcctgtctttctaattaccttcttagaatctagattttcttgatttgactgtagtgagaaaaatcccaccttaggaggcagggacattgattttaatttatatattgctatataatttagacaaatcatttagtctgtgatttgattgtatccactatacaaatgaattcataatctttcatttatctgaaagcagaaaactgatcttaaagtccactcctccaacagtaagatcaatgagctttcccttttcatttttgtagcatgctctaaccttagatagttgcccgtccaaatgtctagaatgctgagttatggctagaattcaaaagtttaagtttctttttgcacattcatggaagttttagaccatatttttaaaaagctaacaaggcaaaaaaggaatcttgttaggggaaaaatatggaaaaatcaaaattgaactcagcactaactacaatatcatacattcatttatttatttaatagctctttattaaacaattactatgtgccaaaattacgaaaatgagcaaaacacacctggaacttgcccttgtagtatttcacagtggttaaggaaagaaaatattaattcagattttaaaaaacaatatttggctaaagataaattagagcactttagatatcatttctaagccgaatagtacctcttttttgatttgtttaaatagcgttggaaattaattagtttacaatgaacctaatagctacccagatttttctctgggaaacagagacaaagctgaacaagaccacatatggggatgaagcaggaaggtggaaggaagattaactgaaaacatgggaatttattaggccttctggtattttcttgtcttaaaatttatgagcaatgaataggactcattacttagcatgccgtttgtgacaatcataggaagtatgctattgtccactttaaatgtagttagcatttttaagtaagccttgtaatggtgtggcatagcttggctgagtgaatttccatttttggcacattgactaatttctatagctgaactttcacaatagttcattaactggaattacttttcccaaacactaacatattgtatgttttaaaatagtgcattttttgtccatctctctgaagcattttcaaaccttttatggtaaccccatgaccaccacataaaacatacaagtcaatctacttaaagcaccagtttggcaaatatatgtcaacaagttatttggattcttatgtaactttgttgatgacctttcctaacctcagttgatagctttaaagatatcagttgccaaaattcagagtcttgaaaataacttgattcaattcttttcggtatgtgatcactgacttgtaaaggtctttaagtaaagaaaggctactaccagctacttccacatgtttatctcatggaaccttcacaacaatttcatgagatattattccattttataaataaagaaattgaggctgaaaacaactaaggaacagatcaaaatgacatagtcagagatggtaaacctaaactgtacatctagatcttctgacctaatgaatagctttcccaatacaccctgcttttcattaagcctgtaaaagagaatgccagaggaggtttaaatgagaaatagttatctttgcaactgagatggaactactaatacctcattagacaaaacgtgagggtgtgagaaaataaaccagactacttgacagaatggttacttaggaagtgccaggccaagttttttaactgtttttaaatcagaggcccaataagattgcaactattggccaggtgcggtggctcacgcctgtaatcccagcactttgggaggccaaggcgggcagattacgaggtcaagagatcgagaccatcatagccaacatggtgaaaccccgtctctactaaaaatataaaaaattagccgggtgtggtggcacatgcctgtagtcccagctacttgggaggctgaggcaggagaattgcttgaacccaggaggcagaggttgcagtgagccgaaatcgtgccactgcactccagcctggcaacagagtgagaatccataaaaaaaaaaaaaaaaaaaaaaaaatttacaactattgttcttaaaagatccctctgattggtaatggtagcagtagtagtagtaggaaatgggaagatgtgaactctattaataagggaggtagaatctgtaagaaaggtgattggagaagaggataaggagggctcctagatttctgattgtagcatcttcatggcgccatttgctgcaacagaaaagcacatgtcgattagatgtagtggctctcacaggtaatcccagcattttgggaggccaaggagggcaaatctcctgagtccaggagttcaagaccagcctgggcaacatggctaaaccctatctgtacaaaaaataccaaaattagccgggcatgatggctcaaacctgtagtctcagctactgtgggggctgaagtgagagtatcacttgaaccctggagtttgaggctggagtaagcagtaatcatgcctctgcactccagcctaagcaacaaactgagaccctgcctcaaaaaaaaaaaaaaaaaggcacatgtcaattaagtgtacaatagttttaatagctaggaagatttgtgtgaattatatatgcagcataaaccactcatgttactgaagaagataaagagagaccagagaagtaagtgacttaattgaagtcactttgcagtggagccaagagtagaaataactcctgtagccattctgtaataccaaatgctacacagcagatggttccaagggttgaccttccagagaagggctctatggatcctctgccaatctgatttcttatgtgtttaataatggccttcttggagagaattatctgttcattgactgaggagttgcttcacagtctctttatttccttactccaagatatgccaaactttaaaaagttacaataacctgttgccctaaagtaagatggctcatgacaaggcacaattttaaaaaacaaaccaattacacatgccgtactctcatcaaacacagttatccatttcctcatcaaacatattctattcctgggaatgaggaaggttcaaatctgatcctgagctggaaaagtatcattttgcccattatcagcaataacttatattaatatgattttgtacagcatatagacactttctcatcgtcttatttgatttttttctcaacacccttttggaatgggcagaacaggtgttatcatactcatttcacaattaaagctcaaagatggtaagtgatttgtatggtatcacaaggttggtaagttgcaaaacttagcctcaaaggtcttgtagggggatagttgttttgtttttctacagttctatgacttttcccacactaccacagttctcatatatctaccctgaagttcctactattagtataattcctttggatttgacaagaaaggcatgtatattagaggaaatctttattatagatgagagtcttactagctgacaatgtgaactggcagatctttaacgtcctgtcccatttgaatacccatgaatgagcttattgtggggagaaggagataccgaagcaagagcatcaagcattgtttggcaaactgtcttcaggaaaaagcagaaaacttgctgggtattctctatggtagtagaactttctgagagaaatggttgagttttgatataatgggatgtttattaataaatgtcattatgggctgggcacggtgactcatgcctgtaatccagcactttgggaggctgaggcaggtggatcacttgaggtcaggagttaaagaccagactggccaaatggtgaaaccacgtctttcctaaaaatataaaaattagtcagccatgttggtgtgaacctgtagtcccagctacttgggaggctgaggcaggcgaatctcttgaacccgggaggcagaggttgcagtgagcggagttggtgccactacactccaacctgggtgacagagagagactccatctcaataaataaataaataaatatcattataagataattgtatgggctttccccaagtatcatgatatttgttttactagacataatcaagtagactgttacaggaaagcagtttgaactagatacctctaaagttcccaaagtttatgattctattggctggaagctgactatatggatctcaatattctcatctgcaaatttaagggagaaggaagagcttcaagagccctttaaattccataggtaaattcaccatcctttcagatattatgtatgtattcctacataaagcattttgttcataacattttccctccttccccctttccatttgtctcagtttttcttttccttcaagttccataatcattcctatctgttctctgtagtctttagatatctcaattatcaataattgctcctgccttttaatttgcggcaaaaagtttctaatctatacatttatgggttttagaatattaaagtattatcttattaattgtattgtaggcttcttgagtcagagactatcttttgtctctcagtatgatcagtacctagaagactgcttccagtaatcattgaataaacaattatttgtgaagataataataatgtaatactgaaagtgtggtatttatatcaccttcgtcagattcacctgggatgcttcttatcaatgcagttacctaaatccactggattcacttccaaatcaaaatatttgggagtggcatcttacctcatcattgtaaacaagtaatccaggccatttttacacacagtaaagttttagaatctttagacctttggtttctctgtaccatatagacctttggtttctcggtaccatattgatatcatttctatgccatatcttacctttttcagtctgtttaagtaggtgtgtatcttcagtgagcagctagtgcctcagaggtcttcttgacccggatgtctgtgactcctattaaagtctgtgtctatggtacttaaaaagtagccactctatgactcttagtgagtttctggttccccaagcttctcacacctcctgtattagaagcctcagtatgtatcctcttttctaagagttattattggataaagctgccagctgcttcaaatatggatgatgataacacaggatgagtttagtgcctcttgagttaaacaaagtgtcttatacctatgattttgatgattgcctaagagagtcctaggcactttacacagcatctcacttaatcctctcaaatacatatcaagcagatattctggtgttacagatgaggaaacctaggctcaaaaaagttaaacaacttttgtctaaatatataatcagactggaaattcatttacacagataattggttatattcatctttgtatgctcacctactagaacactgtgtggatgttgaataatttaattttttaaatgaataactggataaaaaataaatattggtaactcagctagaaaacatgacaactagggttcaaaaccagactctaaatgagtgcagatccagtacctcttcaccctgtccctgtgctcttctgggaagtgtgcaggacccatttctgaatgaggtcacaatgcagggagccatgcacataagtataaagatgcatcatacttacaaaggtgcatgtatattcttcttcaattccgttagcaattggagccatgcacataagtataaagatgcatcatacttacaaaggtgcatgtatattcttcttcaattctgttagcaattttgtgaatctaggaaaaaaatcacttattttccttgctcagaattttatatgtgatacataaagctggagtttttaaaaatggtatactcactattggtacatcttctagtgcttgttgaaataccacaagtctctcacttgctgtttacttatgctaagacctcagccatcagatatgctactttagcatgctatgtagcacaaatatccaagtttattcacaatataacaaagtggagtttgtttttagcacaaactgaagtttgtttcattcaagaatgtgaagttagtagttatggagcactcatgcggattcattaccattaaactgtcacattttctgtttatgttgatttctaattatttctaaccttaaaaaaaatatatctttttttttaaggttagaaaaaaaatatttctaaccttaaaaaaaaatttctaattatttctaaccttaaaaaaaaatggaatgcttctctcagccagaccacagcacataatgattcccactgttggatgaacactgttggatctgtcttatgaaaaacgctgttattacctactaactcatcaataggtcctggctctacagaatctgggtctcatcaccctcatccaccccctcttgtcctctattcacctccacttgggaacatggccacttggagaaggggaagctttccctctcttagcaacagctggggatgttgattcagtaccttacattttacactcgtagcagagtgcattcactttacaaaggatttttctacttgcgattaggaaaaaaaaacacctctttatttttggttctgtgagtagtttgtaacagtttcaatagcagcatcaactgtagctagtcggttggtcacaggaaagttcatagggtttttactacttttgaagtatccaatttgaaattagtccatagatttttaattcatttaaggaattaaagaacataatattaagatactaaaagaaatattaaattagaagtaaaaagcacagtgttgttactctaagttatttagactgtttcaatatgcattgctaatggtaacaatttagaaaaatacaagaaaagattatatgcaagactgtaatttttttgctttttattctttctttgttcttatgacctttcatgtatttgataacttttttacttctccccacttattcccacacacacacttacacagaatgaaaattaaaatcccaaagcaaactaaaattactgctagagaaagatggggaggaacagaggagaaacgagatagtcccaagagcaaaacacatgtagattgatgcacagcctcttcaaagattggaatctggatgtaaatccccaagtttgttgctagttagaacattttcatctaatatacaagttaaaaagagaacatatcttcatggaatacaagatgctggttctgttccaagatccataaaattaacacaaattaaagtaactatatcagacaaaatgtgttgtttcctttccttctaatatttacttagaaatgcagaggctacatgtacttaggctttttactctggccctcaagggatgggaggatctggctccaaccaccctttgtaactcattttatagcactcaacgcattgcagcctcattggtacctgtcatgttgctccttgtgcccagcttctcccatggctttatactgtttgcattgctggtgctctacctgaaatactcttcctgggtttacataatgactcctccttattctgcaggcctcggctaaggagtagacttaaaggttcttccctgacatgtatttaaggaagtttcccagagttattctctgccttattcatctgtttgttgccttaacaacactcattacaatctttaatcatttgattccttgtttacttacttattaactgatgaacatcatgtcttcaggaactggatgtcttattcattcctgcctttcctgcatcacatgaaatgttgagcacactgtgggtgaaatttttgttgaaaaccttaatcatagtttccacagtgtatccatatacagtgaagcctacttgcatctatctttcatttctagtcctgattttggactagctgtggttaggcaaagcatagccttcagttaccaggttggctttgagctcccaaatattcatcatatcttagatttcatgaattctacagctaacatcatttgctagccattttcttaatattttgggctgacttgattttagtggaaagcctagctatttgctgcttaatgttaggtttgttttattgctgtggctttattttaaagtatttatagaatataaatattagactcccttcaggaaattattattcagtaagagaaaaagaaagattttccaagttctcaaagaaaccatttccattaaaaacagtatgtttccccacataataataatggtggcgcaccaactgggctgtattcagcagctggtgaagacattcctctctgagactcttaggaattctgtcaacctctggtgtaggcacagactttcagattagatgttgatttagtaggataaaagatacagtagactctattatcctagctgttaaagttcaattaatgtatgtacttttgagtttgacgaaagaccaatagaatttgtatgtaggtgtgtgtgtgcatgcatgggcatgcatgcgtgcatatatatatgtatatacacacatatatgtgtgtgtgtatccatatacacatgcgcagacatacaaacacatatgtgcacatatttaaatatgtatatttaaatagcataggtgaattttaatttacttaatggttaaaacattggtatattaaaaccctaaaaccatcagatgataaacagtatttcaaaaatggcagggtctgtatatatttggacatataaacatgtggttctttcaataagttatcaataaaaaataataatgaataaacctgtattcacccaaatatcatagtttgataatccaaaaggagtgttgtatccaaataagtaattatatttattcagaaaatcttgtgttcatattttgctatctatacctaactttctcaagttgcctaaatggttgtggagacctagccattgtcggctctacttgcaagctttaacacatgaacaaatgagaaacactgactctgaatattttcttgggttgactgggcagaattttagagagacagccaaataattcaaatttttaacattagacttttcttaaagtgatcgttgccaccagaggaatcgggaaacatctcttaattttcaataaatgtaatattactccaaacttaaatgtgacttcatactaatcaagtcccaagatatggtagaaatgtgttgtcctaatttaggcaagaaaaatcgccacattttctctaagggaatgaattactgaagtaaatgacacataagaaaaccattattacttcactttgaatgattgatttcataattaagcattcaaagtttatgtaatttgcaacatgatttctttgccagatattcataggcatagcccacttaaattgttatagatactttctgttaaacatttactactttaacatttttattattctttctttctggttgttttttttgtttgtttgtttgtttgtttttgtttttgtttttttttagacaaggtatctctctgtcatccaggctggagtgcaatggtacagtcttggctcactggagcctgggccttctgtgctcaaggatcctcccacctcagcctcctgagtagctgagaccacaggcatgtgtcaccgtgcccagctaattttttttttttttttggtagaaacagggttttgctgtgttgcccaggctagtctcaaactccttggctcaaggaaagtgctgggattacagttgtgagccactgtacctaacaacatatttatcattttttaaaaaaatagcttttttatatgtattgtgttcattccttcaataatcaaaaacactttattgagaacctattcaataaatagcttccttgaatagaaggtgggaattatctcaaattcctgaatctatagaggaaaaaagaagaagaaattatcaaaccatgagacctcttccctcaggaagcgtacagtcaatgtgagcacacttctaaaaagagaaggcatggaagaaaggacagatgtaaaaaaaactttgattatagaattcagttggtctcttctctctaccctgtctcttaaggccactgcatacagaaaaacaggcagtgaatgttgtgcagacaagtatgctttggagagattttatatatgatgtttttattgttgttaaaaataacttagatcaaatttgtgaatttattaatttttaattagattataaaatcattattacttttatgtatctggcacttcttttcaactcagtcaaacctgttttattagtctaaagtctactaaaatttacatttctggaaattagctacaaataaatgatcatcagcagtaattggcagcatgcaataatggatttttttcacataacaacttacaatagatgttagtacatttgtaactgagctttagaagtgaattaacgtaaagcaaatgcttgaagcttgcatttaaattgtcacagaaacagaatttagttcccaatactgtattagttgatacatcataaacattgaaaacaagtagccaaaggttgtatattgaccaagtgttctggttccatttaaaattctgtattctggatattttatcaaagttgaattaactcttatgataatagcaagtctcttaggaatggttgcatcagttatgtatcacaagttaaaggttatcaaatagtaggaagccttcttaacagatagtgaaattgaagttttttactcagggaatgttgacagttcagacactgaaagtaggtttaagttatgtatcagtgtacaccctttttgtacaactaaccataataaacaagttaagaaataatagttccctctttcttaattctaaagatagacatattaatttcactgtgtatgtgacacatttttagtagaaagtcccaatttaaagtttccatgaattctgcccattttcccactcatatctacccccattacacatctaaagtttacttatatataaagatatagttaccagatatcaaagatctctattttcacctctgatctaaactcactatttttccagcaggctattcctttgagttcaagtttgaagtttcaaaataaatgattatgatagcttctacttacttgtatcataaggcaattaccacagttaatttagcttttgaatatgctctgaaagcaacagtgagtgacctagaaattcaaagtattgtttaaagctgcttataatacattttgttctcttaccaaatgtcccctattttgcatgatgtcttctttttctgtaatttttcagtagcttccccttgttttttttttttttttttttttttttttcagacagagtctcactctgtcacccaggctggagtggaatggtgcaatctgcgctcactttaacctccaactcccaggctcaagcagttacggtagctgggattacagacgtgcaccaccacactgggctaatttttgtattgttagtagagacggagtttcaccatgttagccaggctggtctcaaactcctggcctcatgtgatcagcccaccttggcctcccaaaatgctgggattagaggcgtgagccaccgtgccaggcccagtagctcccatggcttttctaattaagtagccaccatcagagactcatgtgtgcatctccaacagccactccaaagtaagctccatctattaagcatcactctctggatatttcataaaatctgcaaaattaatgattccaagccaggtttatctttttaaacgtcagtattctatgcaccatgccctactctccaactgcaggcttttactcccctggtagcccctcccctctctattcactggctggacctagaaacccaccttttcaaatcctctttcttgttcagcctacatgccattggccactatatttggttggtaccacctcctaaatatccttgaaacatgcatcccttcctcactacattatattgcctctgccgtactttaagttatcatcagcctcttaccttgactactacattattcttctcctagtttgcatgcctgccacactgccagggaaatttcctttccaattcaaatcttaaatttcaatcactggtgtgattgaaacaccctatgtttacagaagaatttcattggcctatctcacaaaagtttctgtaatctagatctattttatacttccaatcttcttgttattccttatatcttcattccccactacttatgcaccagttgcatcaaactcatgccagtctccttcccagcttgggtcactgtagtgtttccttctctagccaaacatggccacttacatactcataaactccaactcattttctaagattaagttcaaacactgagattctgtgaaactttccctacctctccaccaacaacttcaaataatagtaggaaaatattgtttgaaaaaggtgatttagaaattcaaaatgaagttaatattgaatggggaataaaaagaaagacacatgagaaagtaaaattctattttctgtctcagaatcacaagattttatggctgaaagtgttgttacagtcaatatagaccaaagttttttgtggtttccatataaaaagtaaaatctcttgccttaaaatgaagtttgggaaatttgtacttagttgtgtaatactgactgtgtaatttgtatgatccttatacggcattcaagaaagctgtcactacactacataaccataaaaaaaatctagactcattgaatctgagcttcatagtcttcatttctctctcttcccacagccagcatttaaaccttcctgaagaaataaggtttgccatcatttgatattcaaaattcattgccatattcaaaattcactgattaaaacataaaattttattgcaagttgggacaactaggtctttcttgctttttcaaaaatcaaatttttaaaaacccttgcctaggaagtcattatatgaaaaaaaaaaggtaaaaagaattattgtagcacaatgttgactgtgctccatttcatcagtaaaagttttagagacagagggaatcaagcaaggtattttggcacatctcataatttcagtggatacagttacaatcatgagacttattcaaagctctctcctgaagaacattccaaacattcaaaacctagtttttaaaataaaatttatcttaaggaatgtcagtttttgaagctctgaatatgtaaatcatgtttatattaataattgatatatttaaaattatatcataattggcaaaagtttcagaatacataaaattagaattttgtgttttctttcagcagccacatttcagagatagggatggattggcatggaccaatatggtccatctttcttaaacccagagtctcttagtgccctgagtttgaagcacttttctttcaagttgaggtccactcttctatagacaattctatgaaaaggtcttacaagtttttatctacacctctcgcttcttgaaatggataatgatagattccaaacacatggaaatctcttgccccttttactttttaggatctttgcaagcttacaatatgtacacgttttctgtaagtcaccaatgctgagttactggcatgaaaaatgaccctgttacttggaaagtagtttcacttacaagtcccccaggccctgtaatgtctaaacctcctgtgccactttatgtgactaccccgcccccacagaggagcatgcacaggaaaagcagacttcccttcccccacacatttccttagtttatttacaaaacgtcttggaatgagaatgagctgcttgtggttcctgtggctgattcagggatggtttcctacaggcagaggatgctggtcaaccgaatgacctctctgtaactaacccgtgcacccctgtggtaaggctgtttggtcttataggtacctcttctaactaagcttggagggatttgtttttgtggtaaagaacttagtaataaccaaacgtcactgtaaagacagatttaataatgttaaggtccatcagagcctactccttctactaccaacaagagaagccagaaatacactgggatgcctttagattcctgtgcatcaatctttctttctctaaggattatggtttttttttcttctggcatcttcaaaggacaataaagctattagcaatatatttgagtggagaacacattaggaaaagaaatcatcctaaacaccagctatatgagaaacatccgttagtcagtagtttttaccagctcatgcagaggtgatgatgactatttaatagtcaaaagaagatttaaagttgtgatgatcttaagcaaacatgagtctcccaaatattcatttctgtttgttcagacttgctaatgaacactcttaactcacacactggtaactcttggaaaccctggaatatgtgtaacagtgattcttaaggtagactggtccattctcaccaaatatacatttcactcgagtaagtagaagataagggcacagaaactgtaagactccagttccaaaagagaaaatattgaacataaattaccataagtagtcatatatgatccacatggaaacactggtgagataagcatcacattttcaccattatatctatttgaactggcaattattaagctcgtgtgagaagaaatatttaatgaaggaattctggggagctcaacagctaacatagcttcagcatcagtttgcattggatcaaaaagtaaaattgtgttctctaatacaccatagttcaaaacagatataaaacttagtgtccttactcaagttaagccctaatgtacattattttacttactgaagaaattagaaacatatgcttatcctccattacataaatgaaaagcaaagcaaatgtgtattaatttcactgtgtaaatgagcacaaaattaccagtccccaatctcccagggtgctagttcagtgaggatattatatatatgaagagaatatatataattagttatacataatttaaaaatatatattatatgataaagagactatgtatacacacacatatataagtcctttgaggcagtatattctttatttttcaaatgctcaattttaagaactttgaaattaaaaacaatacatgtgctaaagggaaataaaagatcataaaaaaagataggaaaaaaaatcccacctcattcacccattaccaacaaattgaaagctaatgaaagagaacatatatcctgcccagaaaatgtcatttttttatctgtgatttaacctttgtaatgtctttctacatttgtctccacagtgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaagtaagtgcccacacgaaattgtatttttatctcatctttggtgacttttccagattgaagtggtctgtggggatatttgtgatattcagtgttaagtaaatgataatgtttatctgataattaggctaaaccatacttggacttaaccctgagaaccagaaaatttttatcactaacttacaaaaaagcactcatgttttggttttctttttaattatgaaagcaaaggctgggaatatgattattggtgattgaacctatagaaaagtactgcaagcctcaattccatctgagtttccattatcaacacaaaatccaagtattgactaacttgccaaatcatttcagctattttgacttcaagagagattccagagcaactgaaacatttatttatcaattggaaataaatattgggagtactgtcatctggaacctgaaaacctgtttttcacactgcagacccagggacctttctcaaaaatgtaaattaggaaataccactctattcaaataccatatgtagttcctccaaactcatctcctacaactccccctcacccattttgcaccagcctcacttcccttctcataagatcttcccacctcaagcctttgcaattgtgttctacactggctgttctagcagttggaaagctttttgtccacatctttgcatagctggctgtcttatatcattgatgattttgctcatatgtcaccttctcagagagacattccatgatcatcctatccaaaataatcagcctgttccccttgtcaaccaccctccatctctttttcccaccatttgctgttgtttttttgttttgttttccagagcacttatcactctggaactagactgcctggtttcaaaaagcagtctgatctgttgtcctgggttagttttataacttttgtgagcctcagtttccttatatgtaaaatgaaattataccaatgactacctcattggattgttgtaaactttaaataacttaataatattgtaaagcattatagcaatcctggcttacagtaatcaccacataagggtgaactattgttattgtttactgtatctcctctcctagggatgtaaactttctgaagcctgactcttacccctcttgtgcattgctgtcaaccaatataaaaaacaatgcctggcacatagtaggcaatcaaatatttgttgtaagaatcaatagccctcaagaacaacacaaagataatatcctttgtatgttttcttaaggttctgatgaaacattttcactatcacttaatataaacagatacttcatcttataaatattcttggagatatatatatatatatatatatacacacacacaaagttttttcatagggcaatcagtacaatgattttaaaatcaataaccaatgtacctcaactaaatcactgtggaggaatcgtgaattcagtctggcaaaataattttggacttcaggtgtttatttgatactaaagttgtgtgtggctgtgtctgacacatgtagaactggaccaatagttaagagaacataatgcaagcatatttctttcttttttctctttcagaatgcaaagctgactgtgatacctgtttcaacaaaaatttctgcacaaaatgtaaaagtggattttacttacaccttggaaagtgccttgacaattgcccagaagggttggaagccaacaaccatactatggagtgtgtcagtattggtaaggagaacctgtaataatttgagtaagtgataatgtcagtctccatggaggtgcttttcaaagtcctttgccaaaagaacttgaaggttcttgggctgagatctcttaaaggctgtctccatccttctttacaaagatactctcttaaaggtgtttttcataaccttatctagtatgtattatggtacaatttaatacagtaggtgcttccttatttcttagggactattgataatcgtttcaaccattctgtttatgatagatttatttttattatttagtgaatttttatttaattatttaatgaattttatttaagtaaacattcagccaagacacacatatgtatatctgacagtgatctgttatgtgacatacatatatgtcttgaacttaatttttaccttagagcaacagtttcataaaacacctaggtctaatctcaactaatgaccaaagttattttccaaggtgggaacatatattctcttgacacagcccattaatgctcagtaaatggatcaaagacctagagaactggaattgatttagttaaaatctcactctttttctctcatactgctatgctgaagtattctgcttgcacaggtattgatacataataaaaaggattgtggacttactcaaactgacagattgagacagtccctggggctgattaattgcaggccaaatttcctgaaggggaggtccctcagacaagttgtttgtctaagtaacagatcactgtcaggctgtattttcaatcttttaaacgttgtgcagctactacagctacaactttgatgaacacttgggaagcagatgctgaaccaaatggtaaaatagcctaggaaatctcaaaatcccctgggcaagaactacaggaacctttgatgctgcggtgatgttggcatatccacacaactgccctcctgattcagtacaagatagtctccaggactcccctggagtccccatcttaggggtcccttagaatctaaagggctggagtaataactctaaagtgatggtttaaccatttcaagtgtaccgtagcacttttatttctaaacaatgttcttgatagaataaaataaatagatattttaaagataattttagaagcatctggaaaacaacagtcttgaaacagttcgtggctcattttggttaagtttttcttctctagttgtaaaaacacatggaaaaaaaagcaacttaggaatagggtaaaaagtacaaaagaaagcacttcaagttctttttcttataggtcctgagggctgatgattagaggtaataagttccaaacactggaaaaaatagaaaacacgtctgtggaatattcaagagcagaaattcaggatgagttgcagaatgtttgtgacatttctctacccagaaaaaaggcacatatttagattttttcagttgttgaaggtgtaacattcagtcctggaaaggctatttaccttaaatgtattaatgcttttctgtcagggagatcatttcacacttggcactattggatttgcctttaaagcttactggtaatttatgctgctagtaagactaagactatttatttcttaacacaactacatttaagtttatatattttggaaaagaggttagcagtccaaaggccaattactgagtttggttcatttaacagatgcaaatgacctaggacactgtagtaacacaaatcaccaactttcattcagggctggctccggttgtttgctcaataagagatgtctcccatcatatggcgcctagcctgcaggtactacacctgccatgcctttaggccagtccagaatttcagggaagatgatgacctgcttctatatcacaaaggaatattaaagcctgttcctttaacaaatatgaaaactaggatccggagagccaaaatggtgatcccaaagaaacattttaagttattttcagtgctgtaattagtagcctgactttagcttcccactactcatccaatagaaagaatgtgtctttctcattgctaaaatccacaccgtatttctacttttctatcgagattttaaattgagaggaaaggtcataaacagaggaaatgctaccctgatatagagctgggatgaaagaggtatgtcacagtgtatctgctttccatggtttgcaggtgaaatgaaacagaaacatccactgaaccaaattttataagagaacatattcttttcactttgtgctccagatatttgcttcctttctgcactgtcattttgtcaccctcactgcttctcttagttggatttgttcaagaaacacagagagaatatatctcacttcaaggactgagtagcaagggacattcccttgctatgttctctatggaaccatgcaactagtcaacaagaattagagcaaaatgaccagtaaagtcactactaataggacatcctattcaactttcttgccaattcgggaatcccttttacagcatcttgcactgatgatcaaccacagcacaatcattcccagggaccggagctcattacctttatgagacatgtgcttcatttgcttcattagtgaatagctaaagatttccagttttaagattgttcttaatacagaagctaggaggaacacagaaggtgaatattctgtttttccttaactatctcttaaccaaggagtgcctcaattctacattgttcattaaatgatctgaatagaacctaaatcacctttgtgttgtctttagcacttttttttttcagttttcattttttttagtggaaatattatttggatgctaacattataggtttattctacagtgtttctctaagataaattcacctcatttcatggtgttttaactctctggtctcattagaactttttactacctaaactcattagttttgaatattttccctcctccaatgaaactatctaaggttgtccttagaatttaatttataaaacctttcatcttctgactataaactaataattacctaagctgtaattttttaaatacgtttttctaatgtccaagtgtacatttgcttagaccacttttgctattatgaaagagcaccgaagttctggtcacttgcacatcagatcattttttctaattcagtcctcttaattctggaattaaatgaatactggacaaagtgacagctcacaaacatagactttcctcttctcatttgcttttttggaggtgcctttttttgtaatcctaaggatacactactttttaatgattaatatcagaatgggatgctggaagataatatccataaccagcaagagattataatattattaattgacttagttactctattcttgaatgaaaattgtagtggtataactgagcatgaagactattttaaaatggttcaataaagttcatttcatttcacagaaacataaagtcatgtatttaatcaattccatttaattccgtgttgcactcagggacctgaaagtgtctgaaaagtcctgtgaaaaatgtataataaatggatttaaatttctaaaacatttaagttatctttcagcctctgctgttatgagatagcattctgctctaaagtaaggaatcattaaatcagaaggcaataagggaggttactggaaacttctttttgtggaaagatagtcttaaatcatctgaaagagttactgttgctagctgttgctatacattagaaagttttagggacataaatataatagcaccttgagatgtttcttttctttagaagttcaaaaatctgttacaacctgagaaagccgttattgaaaaaaagaaactaatacagaaaaaggaaacaaatctccaaaagaagcttcagaaaaagtacatcaggtcatcttaggaatcacttggtcaggttaattttagaagcaggttatcagctgaaattgacccagaattcacatataatagatgccgctatgcctgaaccatactcagtaacagatatcaatatttaagcgtacaacagcacatgtcgtaagcaaaggcagtaaatagtaggccaaagacctggattcattttctgctcaagcattctctaacacagaggttctcaaaaggagttcccagtacctgcaaatcagcattacctgtattgttaggcaaattcacagccctgccccagataactgaatcagaaactctggtgggggctaatggagaaaggtccagaattttttgttttagcaagccctccaagtgattctgatgcatgctaaagtttgagaatcaattctctagcacatagtataacaactgttcttcaaattctggtcaggatcaatcaacaattgcagcagtgctctggaaattataaagaattgatcaattttagtgattatattaatgttagtgcctgtgttaatcaatctagagaaaaaggaaatccaatgcaaaaatgagtttacctgataatgagtactaaactgaaaacattcaatttctgcctttcccattctcctgttttatatttaagtcatcttgcccgactttgatctgcaagattcttctcaaatgtgggcaagttctgatggaagcaaatctttttttaactcaacaatagtgaaagtggttgtaagccagctgagtctgtttcttctgttctgtttcagtgcactgtgaggtcagtgaatggaatccttggagtccatgcacgaagaagggaaaaacatgtggcttcaaaagagggactgaaacacgggtccgagaaataatacagcatccttcagcaaagggtaacctatgtcccccaacaaatgagacaagaaagtgtacagtgcaaaggaagaagtgtcagaagggagaacgaggtacaatcataataacaaaatgtgcttgtttgaatcctcataatctgttgcatttttcattttatttcttatgaaacacttggcattatctttcatgcctaatatcctaaaatgtgtaccaagcaagaatatgttgcttgtaaattacagaatatagatgtggtaattccaaaatatggagcctgatgtcagaactttactatagaagtgtgctaattgaattatgatgaactaggctgtattgtaagcattcagggcattatctgtactataatctgctttgctagtacttagaaaacttttgggaagtctcataattacaaagtctaatgatatttacaagaacaagacaaagaaacaccgccatcaaacattcctttcctcactgcctgcaaaccaaagtagtgaaatgtagtggtaagcttttgtagctaagtgtatatatatatatatacacacacacacacatatatataaaattaaagacagaatatcattctgtcatccaggctgtattgtagtggtgccatcgcagttcactgcaacctcaaactcccaggctcaagcaatcatcccacctcagcctcccaaaatgctgggattacaagcgtgagccgccatacctggccagtatagttaatactgactttattttgaaatgaccaagaccacattttatgaatatagcaaaatcattaacgacatttgtctccagatttcttttcatattgcatatttcttttcatatttcttttcatatctgtctccagatatcttttcatattgatttcttttcatattctggtctttatagaccagattacagaacctattccatcaatattaactattagaatttgctgtgaaatcaacaaggagaaatatagcatttaataatatgatcctttagggtgaataaacttccagccagaagaccctcagttgccgatctttaaaatatcatttttctatctttctcactaatgtattcagcaccacttcctacaaatatgttgtgtagttttatgtaactattggtagttatctggtgagtctataaatgatcttctcaattaattccaaaggagtttgattgcctctgtagttgacctttcttatttctccatagttgacctttattaggttatttcattcatttactagcttatttcattcatttattcattcaacatagttttattatattcttactttatggctatgcactgtactagggcctaaggattcacaactgaatggggtactgtctctctattgtgaaggtacaccagagtccagtgaaaggttgagatgtttaaacagataatcacaacatcgtagaataagggagattatagatgtgtgaactagtttaaagggaacacagaagaggacactgcaaacttgaacattgcttatacaaaagagaatttgggtcacctgtactttgcaaagaaacatccattatgccaaaagaattggccatcactaaaagctataaaacctgtttctgccattctaatcaagtagttaatgtgaaaaaattcttgaagacatgggttatttaaagagaacttcaaacttttgtaaatttgtaggaggttttgattaaaacttagtttaaggaatgaaagctggctagtgaaaaaggccttttggcatttgttaccaattaatttaaaacatcttagattttaaaagttggatttggaagtcaaatatttcatcactctacttgttggtatgctcctgttgccgtacatttacttatgtttactaaatttccttaaaatttaatgacttacaggtggtctttgctcatatcattcttttcacaaagattgtacgttattaatcagtattcagtacacattccttttaaaatataaatgaagaaaagttatccaatagcagaattaaatcacgattctaattacattttatttcttttacttgagaatgtgatctttcaatagattatattttggtagcacttgacttaaacattaacattgaaaatgtcaactgttaaaactggcatttatctcatctagaaagagataaaataaacaacatcacaagaagtttgaaatagtaacctgtgacataagatttagcttaaaagtgtctttctgatttgttttcttcccctctgaggatacagtgacattttacatttacaaagagaagtttatacaactagaaaatgtaggtgttttattttttcaaatttcataaaatgtagactaacaagtggcaaatatgaatcacatttacaattaatttccagatttagtcctacttttattttttttcatttatttttcaaggtgtttgtcaaaaacttttcttaagtagcctataaactacaggtaggaagaaaatcatttctctctttgttatttctctaatcctccagttttcttaacttctcttaaggtttagttagcaagtatcctatttgaacacaaaccaaatagaaaagtaatagtgacctctggacatcccaccgtatcctctctatcaagcatcatatcaaaataataacatccagagtcttcatttaggctctactgtatatttatataatatgtataatatataataaaaatatcttgaaaattactcattgtcttgaatttataacctaaatgataagaaccccacatacacatatagagaagcatatcaacagagcaaatttagtagaggactttatctttatatttttctataaaagttgggcatttcttattttaagtagggtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcacacttaggatagctattatttgagttgctcccagatgtttatggattaataaaataagaagattcctttaggttcacagcttgagcatttcaagatgagtgtactaaaagataaggcttttcttatgaatttaaagttaggtctatgatccctgcctaagaggttaacaatagacagaggtagataactcatatttggaaaaggtagggagcatgtgttcaggattttttctgctctgttgaaattgccaaaggcaagatctccagggaagaatgataagatccagaaatgacttttcaaaatgtacacaaagaagaagttgaatagaagaaaatagtttgtaggaacagagtggattcatctagttgggagatgctttttaatatgtatatgttacaaaatcttacacacacacatttttctttactaccattttctcatggttagaataagttaacccaaggagataaatttaattgttgtatccttacatttaaattatctcatgtatttgtttacagtatttcagattattcccctttacttgacatgctaccttttaatcagcctgaacttctccatcaattactaactttagtaagaggtcattaccaatacaattctttctagcttgaacttaattgaattatatatttgaaatatcaaaaatatagattttaagagattatacagactaatatataaactattatcacatgtgtattgaaacatcatatttaagtagaagtaaacaaggagaaaatgcatttccagtggttgccaggttttatttattgacttttttgacatacagtgtataaccatctcagataaggaaaactgaaacagctcaggaagatgtgtgtgcacctgcatttgatgcaaaagggtatatttgtgtatgtggtggtggaagcagagtcaacaaacacatttttcattcatttgtaccttcctctaattaactaaagagaatttcctatagatggtttttaaggcaactcaccaagaataaaagaaattttgttctttggttagttttacaaaaaagattcttattaatcacagatagtgtatgatcttgggatagaaaggagagagaagagcagagcatgttgctggaagaagtgaggtggaggtctatcttcctggtataaagacaagctagcattcattccaccagagaaatataaaaggaaccctttaaaatagaaagaaataaaatgtttagggacactccagggaagaaacaaatgtgggaatcattgtattactgtactatttgagtatactgtaggttgccttatgtactttctcaaaattaagtatagtaaaagtctaccaggcattatataaaggcattacatacattctccttttttttttttttttttttttgagatggggtctcactctgtcgcccaggctggagtgcagtggcgcgatctcggctcactgcaacctctgcctcctgagttcaagcgattctcctgtctcagtctcctgagtagctgggattacaggcacacgctgccacacctggctaattttttgtattttagtagacacggggtttcactgtgttggccaggctggtctcgaactcctgagctcaggcaatccaactgcctcagcctcccgaagtgctgggattacaggcatgagccaccatgcctggctgaatgtattctctcttaaaggctaagccacgttttcaatttaatgtcctcagtggacaggccttccagttgctgaatcactatttagctttccctccactaaaattaattatatggctataatcatttctttttcataatactctcctatctattcagttgaactgtttgcaaccgccttttttgtaggtcgtaaatggtcaaatgtaagcagtttcatatggttcaacctgatactttaaaatttcatctctctaaactgatcaagttttagaaccagacctacagtatgtttcttatggattgacagtttacaatttgtatatactacaatctgttttaaatattaagcttttaataatagtaaactgtacagctgtccttgaaagaatgtaggcactaccaatgcagtgaagaggaccctgaaaagtggggcttaggctgggagggttcttggcttagcccagaaaagaattcaagggtaagccagtggtgttcaacagcaacttttattgaagcagcagtgtacagcagcagcagaggtactgctccttatggagcagggataccccataggcattgtgccctgagtaccatctcagaggaagttctgcagtcacatttatacccacttttaattagatgcaaattaaggggcacattatgcagaaatttctaggagaagggtggtaacttctacgtcattgggttgttgctatggaaaggggtggtaacttctgggtgttgccatggcaatggcaaactgacatggcacattggtgggtgtgtcttttagaaaggtgcttccactccatgcctgttttaattagtcctcaatttggtctggtgtctgaaccctgcctccagagtcaagtctcactttgtgagtcaagccctacctcctacctcactactcatctttaaagtctctcataaaaacatgtttggtcttcagatgctctttaatcatggtcacatatgacttattctctgtttttatttgatatttttttctccttagctatattactcaacccttattccttttttttttctttcccaccacctccaatttaatcactgaaacatcaaatcaccttgtaaattcagtggacaagtatcagaatttattatccatgtaggtgaaaacatttaatgcctcagtgataggccccacctcttattgtttcctctggcattgacattataatagcaggatctatgtgaggattctttgttgcctaggtttttgggttgaagacatgcacaattgactcccctgtgtcataatgaagcagcagaattacagccagcaccttgatagatatagaaaaaaaaatgaaatgacagtttttaagtttcttgcctctaacacattttacatcctattgtatgttcttaaacttctcaatattaaagaaaaagctctgcagaaaataagaagactttatttcatgccttgcattccttgatattatatcattttttagaactcagccagcagttactacctcttacaattcagaccaagtttgctccataccatttttgtaggctctctgagattttggggattttattaacggtggtcgaaaatcatggtggacattattcacagtgggaaatacttaattgttattatcatccatgcaatcccttcattcctatgatagtataagaattatttgtaggcttttctgctaattggtgtgtacctcagcattcctattctaaaataaactttgtaataaatgacccttgaaaatgcctatattctctgagatttcacttagtgatatttataaatatttagtgctttgtgacccattggtgagtgtgacataatacacagtgatcaggttattgaatagagtggtagcattcttcagctcctaagcaaacaatgatcttgccattgtttaggtctggtgcacgaggattgtttcagttagcttttgctgcataacaaataacctcaaaacataaaggcttaaaacaacaaccacttacttaacaatttgtggctgggcaattaaggctgagacctactgggcaattttgatcttggctgggctctgtcacattgttggatggctggagaatgaggaaattgccatgtttctattatcatcaagatggcaagaggtcctacagccttccaaagtagaaaaggtgaagtcattcctcttgaggctaggctcagaacctggcatagtttctacttccaccacattctgtcagcctatactagtcataagcctagtcctgattcaagagttgaagaaacagattttatctcttggcaggagaaggtgcaaacttactttgcaaggtggcatgcatatacagggtgggagaggagaattatagccatttttgcattctaccctagaggtctttctcttgtttgtagttagattagtgtgattcctcattcacttaacaatctcttattgtctgaaatacagtaagagatttgtatttcctttgtaaatttccttccttcctttgtaaaaacagtcaactattgatacaggagatgttgtgttggatattatttctattgtactttctaatttgtaaagggcagaacaggaagaataaataaaatctgaggccaagataccttcatacgctcaacaaatatttattaaacttccaccatgtgctgggcactcttaggtgctgaggataaagcagtacaccaaaaagacaaaattcttttcatcatagatcttatattccgaatggtttatatcagtccacaaggtaatgaccatagagtatcagcccttttgtaagcatacacctttgttaacagttttcacctttgtgatttgtaccaccagtagctgctgtcttcattagagtttcctaacacattacaaagacatttgttaatgctggcaaaaatgaaacttctctgcttacatttcattttggtctcaatgtgaatacatgtattttttctgtgaccaccatgttgatgtgctaatatgtttttgtaagacggctaagtagggttaaaggtacagcttgtggttgtggaacaatgctgagttaaccggccctttggagaaatgaccccaagaccttggcttcctttacagcctgttctagccaactgagatccctgccaattaggagggttccctagagagagactccgagagcatcagcataaatttaaattctggacccccaaatgtagtttccaaaagaagcttcttgtcctttgctaattgcaaagtaaatatttctccagcaaaaagacactccctcctttcatgctcctgttctccttcccatctccctaatacagtcactccttaaaactgctagtgttgccgaaacctctttgacataggggacaccccacatttgaaggcacaaagaattattctttccatagataattatcttgctttttatatcctccagcagcttcttcatagaagcattacagactaactttgtagatgtcatagtctgcagaaaggagttgatgccttatccttgggcctctcaagaggtgtgagtaagtaggctattattagcatgacaaaatgtatagaaatgaaaattcttcaaaacctcttaatccactttgttctcactctcttctacatgcccttctctttctatttaatttcctactcagttccttacctttcatttaaaacatcccatttctcaggtcccaaattagaaatactttcctaaaatttttctgtttttcagtttctctaaaaaattatttacgacatacttattactttaatagcaaaataatatattagcatgttatctctcaatgatagtcctttttcaccaagctcactgttctgccctctgtattctgcaggacattgtagttgaaaatgacagatctcaaattatcttaggcaagaagaaaattattggcttaaacgcagactgcactaagtcctcaaacaatatcactttatcacaatatcactgcatcgccttctgctctctccctttctcaccatttcagctcacactgccttcattcctcattgtttgtcggccttattctcctctgctgcagagtctttctccatttaggaggaaagctggctctgggcagctccaagtctatatatccacattgctccaaataaaaaaggatagtgctctcgctctctctttcagtatccctgcatccaatctcacgaaaggattccaatggaccctactttgaatcactgtggcagaggaattggggtcctgagattggtctgtgtaagtaaaatgcctgcagttgaagccagggtcaagtgagccattttgattgctggctctgtttagaaaacaagggtactgacaaaaacacaacagatgtaaatcatctcccatctctccccaccaaacaagaaacaaaacttaccaaatctagaaacgtatgtttttctacaagataatcccttttcaatactggttttgaaaataattttaagtgaggaagagtaaccaaagttttttctgtctatttcagactaaacacacgttcaggataatgctaagaatattttaactatttttttctagtttctctgcatttgctagaaactttttttttgggagtaaactggctttaaatgaatagaaaaaataatctactatgcatatgaatggtttctggaattgaattgtgcaggcttaagtaaagacatgtccatgtccatttctagctgctgagggttctgtgtgaaatgcaccagtgtgggcaatgaccttttgcttgattatgcacaaggccactgaaacgttaaaattaactctaacctaattactgaactgcggtgtttatattgtgtatacaccaccaggtcataactctagcctctgtgagccccagctgccataattgagaaatatgccttgcaaatggttgttttgtttacttgttttttctgctggaagagcttgcttttcctatttttgcaaagaaacagatgtagggaagagtttctgaataaagtttaattacattttatatctcaatgcaaaacatgtacatctgtaagtgagatattccttttacttttgcgttacataaaatgtaatatctgaaagcacaatgccacttactattcacttttttgagtaatagcacattttaggtaaggaaatatcaatatactaaattcacatgcagaaaatatgaatagttgctaattccaaaaataaaagatatagaaaatatgtgcatacttaggatcaagagttaatatctaattaattataactcatgaacaaaaattattgtcttcacagaaataagaacctaggttttcataatgtaattagtagaatacaatttagatggctaattatttcttatggaatatgtacatatgatagtaaaatatttctcagaataataagtacaattgtaaacatctgctatgctgcttatctgttttccagccaacagcaaaatcatgaagggattttgttttatttcaaatttggtttgtctcaacagctaagatacagttactaaagtatttcattggcaaacctgtagtggcttcacatttgtctagtttgtcaaggtcttgaaatgtataagacaagggagtttttaaatttaacttctctccatcagtcccttggctttctaccatgttttataccttttatgcccttcctcctaccttgtcaccctttccttccatctcagcagatttcttcaattttgaattaaaattatctgctcatagaataactgtttcttctcatgttcatcatcttcaaaaactaatatttaatatttgcagtgtcagcctagtgaactaagaaagtattgaaatagtttaaaaaccagaaccatctcagttaagctacagatttgttatttgttttattcatttctttgtttggcttacacaaaagctgtatttttaatatcaataatgatgtgcatgctcttgtaaaaacacaaaagcctaaaagatacataaataaaaaattaataatctcactctccctcagtccagtccttcctctgagaaaagcaatgtgaaagtgggttgtatattcttccacattaatcttctgcttatagaaatagacatataaaaaatttccatagagaatgaatatattattttctttataaaaagcatttgacttttctttctgtgtctacagaaaaagaataaattgtgcaccttagtagctcaatagtgtgtgcatgtttacttgtgtcattttaaaatttgcatatcatggacgtctttctaattcatctttttaatagctgcaaaatgttacatgctatgaatatcacataatgtattcaaccattctgctattgatggattgtaaaattgtttcccatttttttgctcttcttactgtaacaaaaatctctatcatgttaatgaattgatacattgactttctatcagaggaaaaggaggtgatgcatcttagaatttagagcacaggctttggaaccatgtggtttcaaatttcagttgtgctttttaactatcgctatgactttaagcaaattctttagcctttacatatcccatttttcctcatctgtacaatggggatgataacactaactacattacaaagttgtagtgaggagttatgagtatgtataaaactttcagacttgtgcctggcacagagtaagcactcaataattgtgagatctaatattaaatgtagtctcaaacatttgatggataaaccaaagatgtgaatattttaaatattaatatattctgccagattatttttcaaaaaggtgtttcagttcacacgtggaatatatcaaaattacgtgtttcctcatatcctgactctaactgcatgttattagtcctttaaactcttgccaatctgattgacaaatggtattctattgttttattgacattttcctattaataaggctaatctcatgtttagagcctatttgaatttccacaggatgcctatttatatgttttatccaattttctaatttttctattaagtaaaacaccacttaataggaattatttgtatattagagattaaccttttgtcatgtgcatagcaaatatttttcttattctagtattaacttgactataatgtgttttgcttttctttttttatattactgatatacttgaattagtttatttttttccctcaacttttattttaagttccggggtacatgtgcaggatgtgcaggtttgttacataggtaaacatgtgccatggtggtttgctgcacagatcgtcccatcacctattaagcccagcatccattaattattcttcctgatgctctcccttcccctggccccaacaggtaccagtgtgtgttgttttccctcgtgtgtccatgcgttctcatcgttcagctcccatttgtgagaacatgcagtgttttgttttctggtcctgtgttagtttgctgaggataacagcttccacatccattcatatccctgtaaaggacatgatccgattcccttttatggctgcataatattccatggtgtatatgtgccacattttcttaatccagtctatcattgatcaccatttgggttgattccatgtctatgctattgtgactagtgctgcagtgaacatatgaatgcatgtagctttataatagaatgattttttttattattatactttaagttctagggtacatgtgcacaacatgcaggtttgttacatatgtatacatgtgccatgttggtgtgctgcacccattaactcgtcatttacattaggtttatctcctaatgctatccctcccccatccccccatcccacaacaggccccggtgtgtgatgttccccttccagtgtccaagtgttctcattgttcaattcccacctatgagtgagaacatgcggtgtttggttttttgtcctcatgatagtttgctgagaatgatggtttccagcttcatccatgtccctacaaaggacatgaactcatccttttttatggctgcatagtattccatggtgtatatgtgccacattttcttaatccagtctgtcattattgggttggttccaagtctttgcaattgtgaatagtgctgcaataaacatacatgtgaatatgtctttatagcagcatgatgtataatcctttgggtatatacccagtaatgggatggctgggtcaaatggtatttctagttctagatccttgaggaatcgccacactgtcttccagaatggttgaactagtttacagtcccaccaacagtgtaaaagtgttcctatttctccacatcctctccagcacctgttgtttcctgacttattaatgatcaccattctaactggtgtgagatggtttctcattgtggttttgatttgcatttctctgatggccagtgatgatgagcattttttcatgtgtctgttggcgcataaatgtcttcttttttgcccactttttgatggggttgtttgactttttcttgtaaatttatttatgttctttgtacattctggatattagccctttttcaaatgggtagattgcaaaaattttctcccattctgtaggttattcactctgatggtagtttcttttgctgtgcagaagctctttagtttaattagatcccatttgtcaattttgggttttgttgccattgcttttggtgttttagacatgaagtccttgcctatgcctatgtcctgaatggtattgcctaggttttcttctagggtttttatggttttaggtctgacatttaagtctttaatccatcttgaattaatttttgtataaggtgtaagaaagggatccagtttcagctttctacatatggctagccagttttcccagcaccatttattaaatagggaatcctttccccatttcttgtttttgtcaggtttttcaaagatcagatggttatagatgtgtggtattatttctgagggctctgttctgttccattggtctatatctctgttttggtacgaggaccatgctgttttggttactgtagccttgtagtatagtttgaagtcaggtagcatgatgtatattcctttgtgtatttacccagtaatgggattgctgggtcaaatggtatttctgcctttagatctttgaggaatcgccacacttacttccacaatggttgaactaatttaccctcccaccaaccatgtagaagtgtttctttttctccacaacctcaccagcatctgggttttttttttctgtttggttttttgttttattttgctttgtttttgtaattacaacttctccttctcagatgctgattttaataaaaattgttagatactgcaatcttacatgtgtgggtattcattcacaaacattataggtgacagttgtgtgccagacatagtgctaggcacactagggtaaatatatttgcatgtacatatgatcataggtatgtataagctatcttgtcctatatccctcctaaactcttctgcctgtgctgatgtaattaagaagacttatgttagaactaattctagatttcttcctcttatgtaggaataacaaaacataaaacatcagaataagtcaaaaagtaccttggagatgcatacttcaccattcttttttgcaataaacaacacgaaagagttaaagtgactttgcagaagtgacattatcacaaagctggtaatgacagaaaagaaatgtgaatcccagtgcattatagtttccactgtatcataaggctttatggacacaatattttgtgaagtattgtttaccatgaactgtgttgacggtgttaattcaatttgtggagctatccacatatttaataatatatcaccatactaactgtgcttacttgcttcttttgttttttttaatcacttcttagggtcttatttttaagcagcaaggggagccacctacttgagccactctcccctgctgcaatggaaaacagtctcccttcaataaaatggctattctagcactttgttctcactgtctgatgtggcttggggccaggtattctgtaaagcagatttgagcattagactaagagagttatcctcagaaaggtgttctgagaaggtctgccaaaaaagttgaggcttaaaaaaaaatgtaagtaggagtaggaagaggagacttttagtgggcatttgactgggtcttgctttcctcctggtaatagattgcttggctatctacagatgcttacaagatgagaaaattggagtagaaaaaaattgttttaaaatggattttagcaacagaaccctctgctctgttgaaattgcatgtagagcccaatttatacaatggataaaaaatagatgtgccttattgttggcaaagatgtgggaaaagttggaactatcatgcactattgatgggaatgtaaaatagtacagccagccactatgaaaacagcatggtggttccacacatacacacacacacacacacaaatatacatatatatataaagttatacatatatatataattaccatataatccagcaatttcatttgagcgtatacccaaatgaattgaaaatagaatctcaaagagatagttttacacccatgttcatagcagcattatttacaatagctaaaagttggggtggcagcaactacagtgttcattgatggatgaatagattaaacaaattgtgatatatacatacaatgagatattattgtctttaagaaggaagaaaattctaactcacgccacagcatagataaaccttaaagactttatactaagtaacttcaaagagttacaaaatggcaaatactatatgattttacttatatgaagtacctaaagtagcaagttaatagaataaaaagtaaaatgatagttgccaggaggtaaggaaggctaaatggtgagtgattatttaatggatacagacttttcaaattttggaagatgaaaagagttctgaagatggatgctggtgatggctatacaacagtgtgaatgtacttaatgccactgaactgtacacttaaaaatggttaaggtagttatgtgttttttaccccaatttaaaataaaataaaaataaactaagtgcctctattgaagtaaggtctagccaaccagtagctctataccaaagtactgtattttaaaactgttgaacaagatgttttctaaaacctcttttatatttttcagttataatcatggtaaaatctgtatttgacattcctgtggactttttgctacagaaaagcacagtatttttttcttaggaaaattgcttgactctcagaaggaaaaatatatcagtgtgctccccaaggcattgtgcagaggttatatcagatgtcttggagtccattatgctgtagctgtaggatgttgtagggtagcaagaaataagtaactttgagaagtggctctcatgatatactaacatgctgggctttgtatttctttctttctaggttttctcctcaagtttgcattcatttatactaacttatagaaacatcccttccacatttgtcattatgactatagtaaaactatggaaaacaaagatgaaactgtaacattcctaaaacatatactgtatacataacctttagcttgttgtaatgtttaacacacgacactgtatcactttaaacaacatctcttcctcttatttgtcccatctaatcctctggcataatgtttttttcatgatttctgtcatttatccttcctctttttgattgctaaatacataatctaaaatgttaggttgcaaactagcttcaaattggctaggagcttgggagaactactctgaaaactttttatataaactctaaggaggtcaaattcagaaaaatctcagctgctggacttggatcccattaaccactgatcatttataattaatattaataaatggcagatgacacatgtatattgcttaactaaaaatgtgtgtgtagtattaaattttttaaaagttagttaagacccagaggacctgaatatatgtattggaataatgaaaagaacaaaactaccaacatgtgatctagtatcttctaactacaagcacctaaagttccagaggaaacagaagtacttttaattcatcatattacatattgtattgccatgaaactctatacctttacactgaaatgcctgtttcacaagcctatattaatctggacaattggcttattaatcattatagatatacagatataaatatatatatataatatatacacaaacacacacatacagacacctgttaatttcctagtctaaaaccaaattgtttaatacatatggtttttataatcagaaatttaaaaaaatatccaaatgctgagttgctttaaatcctaatgttccatagagccccactaaataatataacagctggaagggatttattcatctctggacactaaggagttagggcacagtagttcagttacctggttatataattctgggaacctatacaatgattaaaatggaaatgagacctccagttactgcaatgaaggtaaatggttttccaggggaattacacttggactcaaaatcaccttacaaaaagccaaaagacagaaacatgtattcgcttgggctatatgtccttattcaaccatatccattaccataaccatattaacatagattctttctgattggactgtgatttaataataatattatttgtttaaatgttggcaattttacataattatctcatttaaaattctttaaatattgcaggcatatatgcattattattatcgactgcattttaaagatgaggaaattgaggctttgagtgtgagtagtagatttcacactcaaagaccaggactcacactcagacctaattctgagtccagtgatatttcaagtatttgaggctgaaaagagtatataactaccttaagaatgtcagttaataagcaagttagtcagtactagaacctaaatcttttgtcaatctgatctttccattctgtctttttcaacacttttgccctgtgttcaagaggatcatttatttctaatcatctgctcttttctaactatacttatcacacatgaggcttagcatcaaccattatttcttattaatgatattatcattgttgaaaaaattgaaaacctctttttaccaccaaatctgcttcatctttctgtttacaaccattttgttattcaaataacaaacttaactataataagcaaattggccagtgatttccccttttgcttcaaatcattctgatgttttaaagccaaatagttttcacaaattgccaacattgtattcaaatgcactaaatggttatgttagtgctatcatgttgtctaaacaaaggcgctgtcagtcagtagagtcagtgaccttcaggctgttaagtggtttgtgcaattttcacaggattatgcttaaatataaatcctaataaagaatctcacttggctttttaaaaggttgttaaaattaatacttaatccaattcctataaaataatattgaagacataaagtaaaatttactaaaaaaaatgtatttcaaaggtttggattttctactcaatttatgaagcatatatggtctcctaaatgctgtgtgaatcattggacatgccagacatgaagcaaacttcccaccccaggaggcttctcagcctgaagcaagctgtaagtgggtagagttccaagagggaacacaacgtgcatgtgcgaggaaagcagatgcagcatgactttgggtttgttctttgggaacacacaactatatggaaaaatacatgctgctcccaattgctgtagacatctgctgaaggcacgtgagattgagactagggaatggtacagaatttctcctagaatattgtagtttaactttggaagcaaggggaattggctgttaaccgaataagagtttcattctaacatgaaaattgtacagcgtgctcattcgtgtgggcgcacagagggcgttaagctatttctttataaaaatatgggaacattgatttcctttagcagtattatttgatatctatttacagtttagttgggttgtcaaacatcagtgcatttctaataacatgtgtgtttgtgataccttgctcgtggcaaaggcttaaaaatttaaaaaggctttgaaatactttttaggcatgaaattgagctcacaaaataagcttaatggcaaattagtcaggaacacatggatatgtttcctttaatttgtatacagattttcagaattaagatgtggtaaaacctactagcagtctattaagccttctaaggcacttgcaacataattagagatttgcaaattcaaggttggcctaatagaaaaacgaacaaatttgtgtttgcattttagcattgcctgagtatttttacaaacacttcatttagcataattttgaaatggtggatatgttctgatcagaggactaagcagtatgaagaaagcaaaagaaacatgtttttaaaatcagggtaatagatacattaagaaactgcttctgtgctagcttttattttgttaccattgtcctatgggaagatgaggactataatttttcaagttgacctccctgccaccatattctctagagccactagaatggaactagtcttactctgttttcctcaaagatttaagtgtatgtgtgctacacaattatttaacacttcaataataaaataattgaaagtaattgtatggagtcatagaactgaacatagtcaccaacacatttttttaaagtattttatggtctatttgtgtttcttttcagtgatataagagattttcatttgaagtacccatgaaagttttcttagggcagttcaaagggaagtctgacagaaagagtgtttaggttgatgaagaagctttctacccttgggcagctttatcttaaactttaaactaaccatggaatcatatgagtgaggaactcttagacttctttcatttatatccctgactttaagcatagatgcatgaaaatttatttgattttaagacttcttagtgaatggattttcaaccttacttcaatgcaaaaacgtgattttccccagcttatcaaaagctttcaatgctcattctctttacattcaataattcatttgtctcctaatgtatacattttcccaaattaaaaatattcatttatattttttcctgtatttgcccttttgtctgtcttaagttggcccatttgttttattttggttatttgtctaacttagaaaatagaattcctttattgaatataaagtcccaaagcatgttacttagtttgtgtttcaatattcagcatcttgcggaatattgaaaaccagtaagtaagagctttgctagtttcaattacagaacatgtttgaaaaacatgcagttgtgttaccttcttcagtggtggcatatggttaatctaccaccaccaagtggaaattgggtaggtgactacttcagttatcaaataatactgcctggtaacatcaattttgttcgtatatgagcataaagtactggaaaactttatacttttggatcatttaaatgcatctaaaaatcatagtttgtttcaatattaatttgcttaagaaatcctttttctccctgtcaacattgcagaggccaattttagcacagttgtgacagttccttctaactcataaattacaaattgatggccttaaactgattttgttgttactcagcctcatttctgcatcttaagactggtctcatcctgaaaactagtaagaagagatctaatatcaaacctggatattcttaaagactggattatttaagactcgttcaccaaattttctaataccagtaaatggggacacattatattgaataagggtattgttagccaaattctaagattcatcttaaattgttttcttataagaattgtgtatttaccattttaaaaatcactattattttaaaacacttagaaagtgaacatttgaaaatgatgtgcctttggatgctctgtaatgttaagcagatccagacataaagacaaaagtaaattccagagtatttttgtagccatggaatcaccataaaaaggggtttttgaccccaatgttaccgtaacattgtcttcagcatttcatatttaattacagtagattactcaccaatataataaatatagatttatgagatactttaatgttctaaaacaaatgaaaaccacccaagaggagcctcaccaaacctgaggttgtccagattgcattgactaagattaagtaaaagatcattcatctccagaggtcatgcaattaatctcagagtgggagttaaagcaatgactaagcagaaaaggaagccaaatacaagctcgtaacaaaaggtgctggggctccaacatcaaggaacttgttatttcctttttatttatttatttttttttaatagacctaaaacactcattccttactactggtttctttgggtcctaaaattccacttggttaggtcagctattttccatgactatttttgatacggtcaaacaaatacaaagaataagcttttaaaaaactacagtgggttttcatgtctaggaaaacaacatgacacttcattttatgtgtcaacagaaagtaatttaggatgaatgtataataatccagggtttgaacaatgaaaaagctcaagatacactttaaggaagacatattctactccagggttttataattatttaaattcaaataaaatcaaagttcatcttcacttaacttaggtacctgatacctgttgcaaaatattgaggaaaatgtttggctgtcattccttgaagctgaatctttatacccttgcttgataatccctcaattccctgtggcagcaaatttttatttctagtaaacacaacttgttttttccttcaccttattgagattcaaaaccttgtgttttaaaccaagaataattttgaacttggtcgttccttattgcaaggacttcctccaactagggtgaattttcacccacgattagcctgcctttggagtttatgatgtgaagtgccacagctgatggcccatgaaagagactgctaagtctattgctcacatcaatattcccgctggatattttgctcattccttgggaatttcaaagaataacaaataaccaacaaatcatcaaaaactgtaacatgttacccaattcttgggaataagccagtgagactaaaatctgcttaagtatcacaaatgtgaattcccagcatttcaagcttgtaaactgtatccaacactcaccaatgtctattccatttcttagctgtacagaaggggcacattcatctggtaactgtcaacaatgaggttccttccttcttgaacccagctggccatacaagcaggcaggagttgcatgtttgaccctgagacagcaaagggtattgccctgttgggaagacaacaggattgcgatgtaatctggaatcaatttgagattagcaccagatgctccatgccagtaataagtgctgatcataagacttaattttgtatgctattagaattaatgataaggtataagcatagtatgtcccaaactataggaatgaataagagcagagtgaaaaactgaaatggtaaaacaagaatagaagttttaaaataggtaaattgaaaatatttgtttactttattttcatagcttgagtaaaagagttggaagacaaaggagaaaaggacttgcaagaagccaatttttttttttatgaatgtgtttgtttttcctcaaaagtcagtcgtaaatgctcttcagggaagggagtcagagagagccaaatagtggtcttaaagttttgtttgtgttattatagttctcttggttttttttttacaaaaagagaatggtgaaataacttttgtcacgttagtattagtctcataatcagtggaacacagtccttttttgagtcattcctgaaatagaaatgagcatgaaatgagcctggtattcattgaatattaataggtacatttagatgcatgtctaggactgtgcagtatatgagagatcctttactagtcatcttgaatttaaatattgaaatggtaactaattatatttcactgtatacacttttaaatagtagattatatattatagttggtaaggggaaacatattgtattatttggctggacaacagctaatagtatcacagacaactccttgagattctctaagttctacacataagcttcttaattaccaaactcataacagaatatgtgtcttgaagcagctttgagtcctattttttatataattataaaaatagaagtcaggttaaaaaatgattaatattggtgcaaaaatggttttaggtatcccttcaaagattctcctaaaatgatttgtaatctggcaaataaaaatattctccatgctataaatatgctcagtaataagtcagaaatagaatatcaatttctgtgaattttcaaagaaaaacatgctgggttaagggccaacatcatataacatttattgctttgtattacattatacacacacaaacacacacatgttttgtgaacttttataaatggaatcaataaaaatatgtgtatataaaatatattgttctagatatgaactatatttttatattatacttcaaaaatatgaaaatattgctgagaaaggaccatctgtgtcttctcacatctaacttttcttgattatttctaggaaagcagactaaacacacagttctgacataatacagcatcccattttgatttctggttagctcagaaggctttaccagccaaagaaagtctctgaaaagggcaaacctttctgacctcaggaggttctgataggaagaactgaagcggtgaacacccagaggagagaaaacatgggaataaattccccaaagttctgtaaccacagtgatgtgggtgcatagaggaagacataatttcattcttaaagaatgtccctgttttcacattctttcatttgtcttaaagttgatcttgcagatgatatagtccagatgaatttctgcttaataagaattcttgttcacaaattgacagaaaaatataccaaccatatatgtaaaaacacagtggagaatacccaagcataccataatacctttctcataattcagctaataatctatcagatcatttttaggaaaaggaaatttttgcttcttacaataattagattgagagtagagaattagattgagagtagaggtataaactcgtaataaaaattagaatgtggtttctttctgatgctccgcttcctttgatttattagtttgcatcttatcaataaattcaccttatccaaatttgctggaacaaagttttcaaaaaggaaattaaggctcttatgtgctaatattctgtgtagacaaattagatgctgctcataaccaaaacgatctcatttagtttactctagaacatttgaatagtgggatgagggtctttaaaactgttttggacatgtgaactgaaatataagaaaaccattacaaagttgggtttgtattagttttttgttgctgtcatcataaattaccaaaaacttagtgtcctaaatgacacaaatttattatcttacaattctgtaggtgagaaggttgacacaagttttaccatgctaaaatcaaggcatcagtaaggctgtgttcctttttggcaactctagggtagaatccacttacttgtcttttccagattttacaggctgctcacaatccttggttcatggcccctttctccagcctcaaagcctcaagtggcaggttgagtccttttcacacagcatctctctgacacactcttcagcctcttcttccactttccacttttaaggactcatgtaattaaatggaccaatctggataattccagataatctctgcatctcatggtcagctgattagctagatgctagaagtgaaaataacaaagatatgcaaatatgtatgagactcctttggaagttcataatttcatgggagaattggttgtaaacaaataaatgcaaaattgacagatgtgtcctctggaaatagaggagataaattattattggctcttaaaggccaagtagaattttccagctaaagagaaggagaggaactttccattgagaagcaacatcaataaaatcacaaaagcaagaaagagcatgatgtgatcaaattatagttaactatgtagtgtgactgagcaaaggcaaattagggaaggaggtgctgttcaataacataaccaagagtcagattcagaagggccttctaaaccatgccaagaactttgggagtacaggcactgggcagatttaaaaacaaacaaaaaaccaacaggaataaaagaccagccctctgcactataagaaggtaacctgacagcaaagtggaaaatatctggaagaaaacaaaaaaaaaaaaaaaaaaaaaaaaaaaaccaccagatctttgcaaaaatcattctagaggttctagagatgacagaggtttgaactgaatgaggataaagaaggaatgacacatttgagagatatgcaagaagtaaggcagatggccttgagtgggttaacaactttcatcaaacatcttaaaggaattaagtgctcctcagattttacccaaaccagattaaggctgttctattattaagggtgagttgattcactcagctgttttatagtttcatagagaccatttattatcgttactaattatttttattttagggattataattttagaattcttttcattttcaactacttatatatcatttgtttctcatacctaccccaaataatgagaatagtaggaattattgattctattttataaatgaggcaaacaaagcacagaaagtgctttacttaaggtcatattgctgatgagtaatatagccaagtttaaaatgcacgtttcctgatacctatttcagatatttaaaatttaatgtcccactttttttaagcacacattttaaaagatgaggtcttgagagtttaagtaatatcccccaaagatagactatgactaaatagcttgacagaaaatcaaactcagatctttctaacttcaaagcccaaggtcatagcagctatacattactgcatccctcctcacctgctggagaagatcagggaagaattaatagagaagtagcctttaaaatgtatcttgaatgatgtatgtaggtaaggggtgatcttcaagatacttaaaaactatacagtaaaatatacaaatacagtaccccatatataaatatgttaaatatattatcatacatagataatacagctgcttaccaggtgttgttagcagtagtgcaaatcatttgtgaggttattcagtgatgcctgaaaagagttgctaatttttagaaatcacccggtattgttttcagtttgttagggttgattcacacacccacacccagacccattcatactcagggaaggcttcctcagagacattttgtgcttaactccttaaatcctctgcagtttaaaagttccagcagaccttgcaggatccaaaagtgtgcttgattaagggtgggcaagatgtaatggacaaaaaagggattcaccttcctctccccaaattctgacataagagataaacaagtaagccaaccttacttctgctttccttcagtattttcactccccaatatttgaagtcacttcttgactactactctttctcctaaatattctctggagataagggaatggcttatatacagtcattgatcacgtatccccgtttctacctgtctcagtacatttttgtattgctataacagaatacctaaggctgggtaattcattcaaaaaagagtttatttggctaacagttctgcaggctgtacaagaagcatggcaccagtatctgactctggtgagggcctcaggctgcttccactcatgacagaaggaaaggggaactggcacgtgcagatcatatgactagagaagaaaagagagagtgtgtgagagaatggagagagagagaaggtgccaggctctttttaacaagcagctctctgggaaactctcctaggaactaatatagagtgagaactcactcattaccatgagaatggcaccaagtcattcatgagggacccactccaatgactcccaaacacctcccatttggccccaccccaaacatttgcgctcaaatttcaacatgacatttgcagggtcaaatatctaaactatagcattaccttaactaggtcttaaggtatatatgaagtttactttgctcagaaaataaaaaccaaacatatgggctatttcaagctctttacccctttaaaacttttttctatctatttcatctggccttcttttttccagggtcactttatttcgttcttaaatacttcaattaaatgagaaatatttattttagagattaagacagtgttcttagagattgagtaagacagtgttcattctttcaggaattgtcacatttcctttaattttcagctcatttgcttaagcctttcctgagactttctcttcccattaattgcattgcacataacatctgctgtccttgctacaccctcttaaatggaaagtttcatcatactacccagtggtccattttggtggcattccactgaaagaaaaattcaatggattacaacaaaagccacagttattcgaaactcaaggggaagtcaggcttctgagactgtgtagtgccacttcaaaagaggatacaaaagccccaagatcaggcaagatgggctagaatcatatttcatgactttaaaggaagactacattctcaactccaccaaataaagcatcatttatgcttgctatagaagataattaaggaagacaaggttattttgtcatctttcaacttttgacaaccatcccaagtgctttcctctcttcctctatttctcttgttatttgttcctcttcctgaccacctctttttctccaaacaatcgcaaaaactttttggtagaccactgttttccagctttgggctgagagatggactctgatccacactcccaacctcagggaaactctgaagtcttcaaatcactaaaactgtcctagaactcaaatgccttctggaaacaagagaatggaattctttctaacttctctgttccaacctggacttcctaatgccatttcttgaaacagctttagggatactctagttattcatcattgacttggtcccaaaggaccaagcatgacaagtcaaaatgatattcctgaaaacatgatatagctctctggagttcactgtaatctcttgaagctgatattggaacagaagtagctaactggctgagtactctataataagtgggacttattaagacaggttgtttgggacactgggtaatcacagcatgcccgcatatgagagagtaacaccaaagcatctctgtctatgcctgtccttctccaactctaactcgaattaagtcacagccatgaaatcaagaaaagggaacaatatttatctttttcatttaattcattcaacgaatatttatagactcactacagttctcaggctcttgccaaagagaaaggagctaccacagcctttagagcaatagtagcagtgcttactaatataccaggaatatcggccttacatgtctccccttgtgcacaaaattatgcaagtaaatcagggaatcactgctagaatctcccaatactatccaccccacctgtattagtgcattctcacactattaataaagacataaccgagactgggtaatttataaaggaaacaggtttaattgactcacagttcagcatggcctcaagaaacttacaatcatgatggaaagggaagcaaatgcatccttcatatggcggaaggaagagaagtgccaagaaaaagggggaaaagccccttataaaaccatcaaatctcatgagaactcactcactattacgagaacagcatgagggtaaccacccctggaattcaattacctcccactgggtccatcccaccacacatggggattataggaactataattcaaggtaagatttgggtagggaagcaggcaaaccatataaccaccctactccaaaataatcagtcctgtgaattgcatttccttttcaatactttgataggtaaataaaaattaaggttgaatttctataaagagtaagttctttatatttgtagttgttactacattaattgttcttcctaatattatgaaaactggaaacaaaattcaatatcaccttgacaaattgcaaaaaggcctagaaatatgaattaaaattagtagatgatatactgggttgcacatagggacccaatcaaacaatagaaggaaacacactagttagtagcaaaggaagaggagtgaaatctactaatgataacgttaatgttgggagggaaagtctatgcataggaggttgactatccaaagaatgaaagtaattatttgatttcttctgcattaatcagatgcttattagaaagccatattctattttcctcaggacattctgaaagtttgtgaagagaaaaagtagatagggtacaagtcttaatatgctacatggaaaatatggttgataagaaaaagttaaaagtcatataagttacagaaatcactaaatttaaagattcaaatttctaaagagctcttgtgaaaggatgacactctcttcagaatcattaaaaattacactggaaaaccggctgtcttggaattgatacttaaaattcaccccaaaaatagaacttttccatcagtggtggaaagggacctataaataaatatgtgcatatacatttatatataaaaaatatatacacacacaaacatacatacacatttgttccccaggtctatacttccaaacctaccctcatcaataatgatagagaaagcacagtgaaaagctgtaaaataggtacagtaaaatcttactaatcttgctaaattacagggtggatatttctagattagttaacacttaacctccaaacaaattttaaagatgattaaatcagttgtattcccctccaagtcctatatgtaaccattattgatgaagtaattacaaggacctatcttgatgattgtggaaatggatgttgaaagtatttctgattaagaacagacaattgcttcaacaaatagaatgggagaaaaagtacctagaacaatctgcattacctgctataggtgaaatactccccttatcatatattatgggtaaagtttatcacaaattttaatgtagtagaggttgagtggggttttctatgtttttcaaactagttaagaaaccagtagtttgaagcaaaatctgcaacaaaagaagaatgagtaagatcctgaagcatagtgaaaccatttaagaacgtatttgaagatgcatgaaaatcatctttacatatgtagctaataaagagctgaaaacattaaaccatcactataaacatttatattatctgtagctaaaattgcatggagtgagacacatgatacgtggagcagcacaaataagaaactgggtagtcatttttccccacatgatgcaattccagattaaaggtacatttttcccccatagaccaataaaaagcttcagagaaagacatagtgggctgtgttagaatgagaattagacagcacagtcaactagtgcataacatgatgaaagagtagaatactatcaagatttcttgtataatcaatcacagcaaacatgtcagcaagtatgaggccatccgctcctgtccatacaacccagtagacaatttgggtaagggaatgagtatagcagtgccaaatgtggctatcaacacttcttctgtttctgtctcaaaagaacaaaattctaagacaagctcttagaacaaatggaaatttatccaaataaaaatcaaatgataaatgcccagagaatattctttctttggaattcgttcaattctttaatttaaccagctggaataaattttcaagtagcattctgctcagccttttgaaatgaaggacttttctgttaattggaaagttatattccatcaaagatgaagacagtgatcttgccttagtgattcttagaaaaaataaaaggcatttggtgaatatttatcatatactgattccagaacatgtattttaagcacaaatgaatgagctgtgggcctacacatttaactaaagaaaaatagggaaaattcaaatacaagttttattttaaactctacataaaagctaactttcactatgctcagtcatgagaggaatatgtaaagagaaaatagaaatagaaaccattaattttgagaatgaaagatggataatacagctgtggttcctgattttctgaagcaaatgaattagataagtcaacacatttaagtgttctttactgtgttactggaatatgtgttattggggctggggaaacatgagagtcaactcaaaaagatctacagcaagaaaataaaaatttactgggaaaaaattattttgaaaattcatatttttaaagcaatctgtaccataggcagtactttaaacttagtcattgattatagatatattaaataacattgttacatttaaattttaaattggcacgttaggcaaactaatttatcgcaaataatgtgaaaagttgtttaaaaattaatgatagtcaagtactaaagaaataatttttccagatgtcttaaaggaatcactggatagatggtctgaattataattgtgtattctgatttaaaataattttataggaagacttctaggtaatactatttatgtactttcagtctggcaatgtgtgtataacagaaatttttcaaagaggctgttccacttttttaaatatttaaattgctgagagaactttttaaagggtaatatgaaataaatatttaataagttccatagactcacgcatattctccagcttgagatggaagatggtggttgaagcagcagggggcgccagcgggcatggtggtgagatggggacagggtagagtacgagtgttacaaaaaaaagatgaacacatcaattcgtttttgagatagtcactaatattttgagaggactaggtccaaattgaaaatttgggatagaacacgacaatgttgttaggcaggctttaatggtctttgaaatattagtgttaggacgccccactgactaaatttctgaagataggtaataaaattcccatattataagctcataaacattatataaaacaaccaaagtatcctattcagggtcatttttttaagggaacaataatattcatccaacaagctagtcatgaatttcacggcaaaagtaatgaataatatttgacggtgcttaatagatgaaatttgccaacataccctttgataacaagtaagaatgagaataaatttatatgcttatttaatagatacaattatttaaaacccaagatctaattcaaaatgtgttatgcaaacatgcttagatcaagaaattgtctacatgtaagtcaatgtatctgatttactttccaagagttttatgatctatcctaaggtgatagataggatttcaaagtcaagataacaacttctgctctgaagaaaaaattacttattgtaaatgaacttttaaccaaaaagcagttgatacaagagaaataaacccatacaaaagaatgcaaaatctaaaatatttaatataaattataataccctgctagcttttaaaatattatacaataaaatacagaatatcctttacttttataatgagtaaaattcgtaaacattgccaatatttttaaaaatctttgggtactttctcccctgatcacttttaactgttcttttaacatagaacaggaaggcatcctagtatgcaatacccagtgcctttaatagtttcttttggactccagctaatggcccttttaaatggaagcaaggattccaggctggggttccaggcagcagaagcaatgaggtggaatggagttagcttgaatgaaagggttatggaaacctctgtcacgacattgagccaacattcaaaatttcagattctgagtctttagtggataataaaattatttaaacaacagagaaaaaaatttgtaaaggcctattggcaatggtccatttgtaaggaaggtatttaattaggcaaaagagagtttattatgcttaaagcagactatgaaaatacacattctaaaaagttgtgattactgatatttatgatgtctgctataaggtgaaatgatttataataggactgcattcaaacctcaagtagcattttaaaattttaaagctatataatttttctttctcttttttagtattaagtataacaaaatatgaaaatatgtgataatttcattaaagcttcaaaaatgtaacagtagtagtctaatggaaaattatttctaaattagatataaatgatgtataattttcaagttacatatatatatatatatatcatacctctatatgttgggggagtggaaatactaaaatataggcttgtagcaaaaataaaaagaaagagaatagagaatgagatagtgctgaatggtgctgactcaaaaagtttattccaaatgctattaagttctgagttaatttctgataagcagcttttccttgcccagcaaattcaaatttcaagagattaagaaagtacactccaaatcttgatttttataaaactcctctcttttaaacagttagtccacagctgggctctttccttgcctcagtagctgaagtgacataaacaaggatggcatgtcacattgtgctctattgagaaataatgtggaggcagaagggtgctgtggttaggaaccctccttatcctcatctgtagaacaggggttgaatagagcttctaggcaccgtactcttacttagaagttggcctggtacatattaaaagtaatggcacaaaccacaattattttgcaccaacctaataaaagtgtgtgttgaattgtagttataattattcttactatttttaaaaacaaactatccaggtcatcttcaccttgatctgcagcagggtcctaattgggagctgagaacacagagaggagaaatgtaaatagtccagcctaggaagaggttaggagagtgaggaaggtttccctgaaggccagataattcaacagtaagtctgagttagggcaagggatctagaaactgcattctagataaatgtatccaatatatgggatcagtaaacattatggtgggacaagtgcaggggtgactaaaaagacaagtgtgaggccagcaaagtagataagtaagcaggggtcatatcacagtggacaaggaccctgagggccatgttaagaagcttgggtttatctgctttcatttcctaaagtttatactcagtgccttccaatcattatgttcttgtttctaaattcccaaaacagcatgatacaaatagagtgcctctcttaaactggtcctttgaaattgatgataaaatgttatttcaatctcagtatattttaatggtcagagctatctttgtaaaagtgggctcaaagtaatatcccaaattaatagcatttagtagagtatgtaatgatgtatcaaattatttttctttgaataattaatcagaagcatcttgaaaattaaatagaaaaggcaatagaattcgtgtgtaacctaccgcataggtaaatcaggtagctttaaatttcagtgtggagaaattgtgtgcttatttatcaaaaagcaaaagacattcattctttgatatttttactatatttgttgtaaattcctaggttaaatttagagcaagaagaagttttctattttattaaaacaaacaaaagacatttctcaatttacttgataataatataggcctgtaaatatgtatctacacaatacattataattgcccccacaaaagaaaaaagtcatactatagcaattcctcttccttgcaaattttcccagtgatattttaatttaaaataacaggccgggcacagtggctcacacctgtaatcccagcactttgggaggccaaggcaagcaaatcacctgatatcaggagttcaagaccagcctgaccgacatggtaaaaccaaaccccatctctactaaaaatacaaaattagccaggcacggtggcacgcacctgtacttccagctactcgggaggctgaggcaggagaatcacttgaacctgggaggcagaggttgcagtgagccaagactgcgccattgcagtacagcatgggcaaaaagagcaaaactccgtctcaaaaacaaaaaacaaaaaagaaaaaagaacaaaagctggaattttcattctctatacataataatcaggtccaattccagattcaaaaataataagatcaacccctttttcacactgtgagtgctttatagaaggcataaagccatgggcttccagttgaatttcattccacaccaaataaaaagaaaagaaaaatgtaatacttatttaattggtttgagtcatataattcgtgatatttagtcctcagtctgtaatgtggaatacatttttagcatttgggtaaaaattataacctagtttgtcttgggaagtgaactacttacagctcaatggctccccttagtgacacttcgcaagaaattcacaaagcagcagcttttatgaagacctatagacagattttatccaaacatcaagaaaatagctgctattcataatttaagtggttctcaataagtgaattacagttgtgattctagggaaagcaactctttttttcataacctcattatgtttaaaggatattgaacgtgttctatggtttgcattttcacttggaatttaaatatatacaagttaggaagaataattcaggatcactctctttgtcattttttacatgtttattttttctagttcatatatgcacttgaacaggttttaaaaagataacctgcaattaatttaatttatatctgggtgcctattccaaatttatctattaagaaaacttgccttaaaattagtagctacagtaagtcaaaaacgtatttgatattcattaggaaaaatgaaagaaacaaaggagcaaccatgcaatttgaagtaagttttgagagtatatatttgaagaaattgggtcttctgttgctctgcagctttggcttttaaatgtggttgcacatcaaaataaactgggggggaggggtgtgaacttgttgttgactacaggttcttgggcccctcataagaaccactgaatcataatctccaagggtgggatctaggaatctgtatttttatatgttttggaacattgtctgcagaaggccataggaaatgtttatgtaaaagactgtatgtgtttatactaacagaaaataatttcagaatcttaaaaataacaattatcaattcaattatgtgatactactatgcaacaaaatcttaaatatggctttttggtctacatggagattttagctactctttcaaaaattaaggctcaaaaataccaaccactgactacattccctctacagcatcttattacttacagcaattttctgaaataggaaataaggtcaacatgtaagaatagcctattggccttttctaaactcatcacagaaacatccaaactctggcctgctatctgaattcaatacttgcccttctctagttttcagtacactggtcctcaggacaaactcccaacatggcaattgaagcccgtatatctttccagcttctatgggtaatattctatatatagactctgatcaaaccaaggaagttgactttcaatgccccagattcaccatgtccttgcatgccttagtgcatgttcactgcctggcatgcacttcttccctcatcagcctagcaaactctcagtcattcttttaggctcacctcaaacatcattacatcaggggaattattttcagtctctgaaatcattttcagtctctcttcatggagttcaatgctttcccactgtacccccaacaggaccttgtacacacctctattttagcattaacatgtgactataattattggcagtctccatatctaacttatatccccaggttttatcacacatttttggcacagagtaggggctttgttcatgtttgtgcaaggggttaataatattagttttcatttgtcccatgagtaacatatgccagtcaccatgctaaatgctctaccagcatctcatttaatccttatgaagtttagcaagaagtaaggattattcacattttaaatatatcagagagttaatcctgagaaatatcaacaacttgccagagttcacacaactagttggtggcagacctagaatttgaaaacagcatttttctggccctaaggacagtgtacttaaatgttacaccatagtgcttctctgcaagggctcagattgtacttgactgctaatagcaaattctctttgatgttttctacccaaacaccctcataggtagaacatcaaggggagatgaacgctgttttaatcactagaatgttccaaaacccagttcaggcaggtacgtgcgtgtacacatgcacacaaacatgaatattcagtgaatggcaaagcacacgtgtgtgtgtatatatatatgtgtgtgtatatatgtcagattgtcataactggaatgcttagtttgcaaaattgccaaaaaagcctgaaaaaaatattaaccacatcaatgaaaagtcaccagaataaaaaaggaagtcccctttaatgaaaaccttacaaaattatcccaaattacacgtgatttttaatggactacagccactcttgtgtatttctattttatttcttacacaagcagaaaatatatttatgcaaagggtagttagcatttccaaccactaacacatggcctgtaaaaaaataacaacctcattcttctgttgtgcaatagccctctgttgagcagcaataatgtacaatgtgttagtttcctgttactttactagagccttccctttcactcactgcccagactagttattccttggacataaagttataataccgagtttcaatctacttccaaaaatgtttaggcctgtcttaagaaataatcatatcagtttgctaataagcagaaatgcactgccagttgaggatgttgtcacaagtggctaaaaaacatataaatcaatctgtgaccaaggaagaaacaatacatttcttatgtgtccaaaacattatggttggggatcacagctgtaagatgttggaccgtcatcaagagaacaatgtcaaacactgaacttctggatgatttccataaaaataacattttgcttggggtcagtagtttttatggaactttggaatggtttttgctgacaattttttcgagttgaactcaaacacctccaaaatgctcctcaatatggaaatattatgtaatccaacctttgcagccatctccttgtgaaaactaagcacatagcatgaaaactagtatttttctctgtttgtacagttttataaaatttaaattatgctacatattcagaaagggaaacttactcttcagttttccctgtttggttattatattcaagtcagcacatcaaatgtgtactcattaaatccagcatggaaagaaggccctgatcccttctgtagaaatcttatcaacccagcaaaattcttttaagtgaaaagaataatggaatcgagtaatcagaatataagtagttcagtttaggcataatagttgcctctaatgttgtttgttcctctctgtatgtccaaaacaatttgcttcacccttgaatgaattctgatttttgtcaattgtccctttagattccagaatttgaaggtatgttgtgctgagcccaacaaggaaagctttcaaaaagtaactggaaggttttataaatacagtctcatgacaaagctagatgtggcataaaatcattaatccaaggagaccgtattggcgtagtatacctatgcaatattaataataccactccctaggattctgtaaccagagcccaagaaaaggaaagccaaaccactgaattcaatatttgcagcctacttcaggacatgaaaatattttggttctctcatgcagacaatttctccaaaatatttttgtcaaaagttacttattttagacagtctaatttcaaattttaaatgacccagtatgtgggatacacattcagaattttgtcatacctcaggaaacagttggttcctagtttttgtttactgtaatattgatttgaatctaggtaatttctcattgggatatatgtgttcatggatgttactaaaaccatgccttcagactacactgtagactacatatataaaaggtgtacatgataataaaacatctagttaattcactgtttagaaataaataaaaataatcatccaatttggtgccaggtttatctacttcgatcaaattattctcttcttctaaaactcccagcatttctccaatgccgacagaataaaattcagttcttcaagtggctccctgttggctacaataataccttttcacatccaaacctttaaagtcatgttgattccacttttaaaaatgtctcctctcataatgtgagtctgagttaaatctatgcttcaaacccagctccaggtcgggggcctgcatgaaatccagtatacatgtgataaatatctactcatttgctggatagagactcaacctgccctggtagcttgtaccagagggttattgatcagttatagtcatcaccaccctgcatgtagagaaattataatcaaaattaatttcaacatacaaatatttatgttaaaatacaattatcttgttattcatccttattatttctgcatttgttatgcaaatcagttcttttctcttagatagcaggcaaatatcttgacaaattataactatgtaactgctacttcgaaaaaaattgaatacaacatggtaccttaaaaatatgagccagataaaaatctctcctttttttttggagatagaatctccctctcttgctcaggctggagagtacagtggcgctatcagggctcactgcagccttgacttcccaggctcaagtgatcctcctacctcagccttctgcatagctgggacacaggcatgcatcaccatgcctcattgattttttttattttttatagcgataaggtctcactatgttgcccaagctgatcttgaactcttgggctcaagcagtcctcccacctcagtctcccacagagctgggattacaggcgtaagccaccaggcccagccaaaatatacattttaataaatgttttcaacagcaagaaatctatctaaaactttccatgaaacatgcataaataactatcatgtaaaataagttccaaacttagaagaacagaactatttggatttcaaacagtcatatgttagttgccttattatatcatatacgtgtttcacatttacattgtttggaatataccacagacttaataatagttgaatgattgaaatagtagatatttagtatctatcattatgatatataatctaagagaaatttaagtcattttttaaaatgtaattaaaaaatagaacataattgaatgtaatttttaaaagagtatcctttcatttcaggaaaaaaaggaagggagaggaaaagaaaaaaacctaataaaggagaaagtaaagaagcaatacctgacagcaaaagtctggaatccagcaaagaaatcccagagcaacgagaaaacaaacagcagcagaagaagcgaaaagtccaagataaacagaaatcggtatcagtcagcactgtacactagagggttccatgagattattgtagactcatgatgctgctatctcaaccagatgcccaggacaggtgctctagccattaggaccacaaatggacatgtcagttattgctctgtctaaacaacattcccagtagttgctatattcttcatacaagcatagttaacaacaaagagccaaaagatcaaagaagggatactttcagatggttgtcttgtgtgcttctctgcatttttaaaagacaagacattcttgtacatattatcaataggctataagatgtaacaacgaaatgatgacatctggagaagaaacatcttttccttataaaaatgtgttttcaagctgttgttttaagaagcaaaagatagttctgcaaattcaaagatacagtatcccttcaaaacaaataggagttcagggaagagaaacatccttcaaaggacagtgttgttttgaccgggagatctagagagtgctcagaattagggcctggcatttggaatcacaggatttatcatcacagaaacaactgttttaagattagttccatcactctcatcctgtatttttataagaaacacaagagtgcataccagaattgaatataccatatgggattggagaaagacaaatgtggaagaaatcatagagctggagactacttttgtgctttacaaaactgtgaaggattgtggtcacctggaacaggtctccaatctatgttagcactatgtggctcagcctctgttaccccttggattatatatcaacctgtaaacatgtgcctgtaacttacttccaaaaacaaaatcatacttattagaagaaaattctgattttatagaaaaaaaatagagcaaggagaatataacatgtttgcaaagtcatgtgttttctttctcaatgagggaaaaacaattttattacctgcttaatggtccacctggaactaaaagggatactattttctaacaaggtatatctagtaggggagaaagccaccacaataaatatatttgttaatagtttttcaagttttgttcactctgttttattgtttgttttattgagaaattcttactcttagagactcatgaattaagaaagagaattctgctaactcagagaacctggttcctatgtaattcagaatatattacatttctcagtaatatttgttttttgaatccacctttatctgagccaatggagatttacttatagcgtattaggagatatttattccattttcttattttaatcaacattctaattatagacacatgggcctccctagctgatttcactgctcccccttcattgcttagaaatgggcatcatttcttgtatgtcagatccccctgcatcttcaacatttagtcttttcttctccatattttctatctgtggatctctttaggggattgaagtcaccctagctgaaggcctcaccagtgtttcacagaggacacagcccaccccttgcaggaggaggtatctctgagtgtgcagcacagaatcgcatgacccaccttaaccttcctgttgtcatggaaggatgcacggctgctctgtccactgtgattcctagccctctcaagatcactgctttctgaagaatttgcaatgactctggcttctggctgcttatctctggacacccgttctccaccagttgtacagttcatgtaatctacttggcttaattgattttccacttctctcttcctcttctaagatataaacattttaaatgatttattcctgtttcttattctggtgtttctttccttgtccctatgagataagtgtctcaactcactaaatctattcccaatgtataaaataattctaattccattttcagctaaaacatatattaccaagaagaaacaaactttatcctacagaatgatgttaggtagaaatatgtccccaggtttgagacctttcggatgatttcatataccatctttcttctgagtgttacccagtcaagtataagtagccaaattatttttgcacatctttctgtttctcatgtcttcatttattcaacaagcacttactgggaaggtctacaactgcataggcaatgctggaaaaagggttaagtaaaccaggacatgacaatggtggcaaatgactatcaggtcttcccatgtgtttgactcaaacttattaccctatggtccttctgacaatggcagaaggtctgaatccttgatgctaaacttatataaaagtagaattattacaaaggaaaaagaaataaaaactaacattcattttcatatgttggatgaaatataaatgaagaaaaagataacatcaattttaactgtaattctccatccaccagtaacagatccttaagacaatagaatcatacagtattcaaaccagcagccttctcaaatttgagcaaaaactctatcaacctctggtaaagttcctacactagtcacagaaggtgttaactttctactctgattctgtctccataatggggtaaactgttgatagtttaccccatcaacagatggtcggtaaattattgattcgaagaatcgagagagtgcagcaacataaatctgttaatgtctgatcaagctcctgccctgttctccgaattcagcttcataattaagggaaggcctgttttctatcctcagatttaggttctagtagcagttgtgtaaccactagtgagtcacttaactcctctgggtccccatttctcatgtgcaacaagaaagaggggaactggagatgatcactctagttccagacaagggaacatttcacactttgtttacttcagggtgatgtccctgagtcctcattagtgactgcgtcctttggaagttatcccaaccctgcttttctcaaaagtgaaaatgtataggctctcagaggagacagatttaactctgcttctctaatgttattgaattaaaagctgttcacattagtggttattaaatattgaaataacactgggaagaaaaagcatatataaatacagctaaaaacaagaatagatattcattctcacaaagggagacagcaaagaaaatggaaagtgcactggtgctagcgttagacagcttgtgttaatgtctcaattctgctactaactggttgcagcttgtgtgaccttgggcacattgtatgatctcgcagaatatcatcccaaatctgcaaaatggaattggcatcatctcttttgcaagattgttatgagaattaaaaggttcttcattcaatataataataaatattttgtatataaatgaatatcaattaaaagttatgactaattccacaagtcaaacatataaattttatttcttgattcatgatatgtgatagtattcataaaaatgtacatgcatgataatttcaaggaataagtatatatgtgagaatcatggaaatgaaattaataatattaactagtaattaaattgtaattttgtcttgagtcttcttaaaattaggaaactacttaaagtacattttttataaatgggcataaatacagacagtatatattttccatggatatattttcatagcagaggaaccaactagattctttctcaatacaactgcaactatttctggtcaaattatggggaaaaggcctgttttgtggttgatctgttacaaacagggtgtaacttcttgtaacgcaaagataatttgtctggaattcatccaccactgaaaaaataaaattaaacaaggatcatgatcaaatcaattgaaatttttccaaatttaagcaataacatttcatcttactaacatagtagattattgtaactttatttcaaatgttcttagaaaaagaaaagcaaaacaaaacaaatggctgtacctcctttatgctagccacttaaccctttgactatactatattatgtaattatcccaaaagccctgtgagtcattgatgtccttgttttacgaaagaggaaactgaggcacagagaagtgtctaaagtcatacaactagcaacatgtgagtttggaagtgacacccagctctggctgactccaaagcccactttccttctccttcatcataacttctaaagtcatatttattattagttccaagattgcccatgacatataatagtgaggtatttcttcatgatctaaaactattatcccccattaagaagcctgagacgtcaagttctagaggcctcaacccaggataagacttaactctgaatctgaactcgaaatgtgactgtgtgtgtgtgtgtggcgcggcggggtagggtgaggcggtgagacacagagctgcaggaagcctatgggctggctggatgtggggtttgtggggaacagtggattgggggaggcaagtgcattggtaggcaagaggaataaaaaggagaaatgggaaatacgtgctatcagtaaaggaccaaagttcagaaagagaacagtaagtctggctccttgggaagccctcgattgttatagcnnnnnnnnnnnnnnnnnnnncagggtatttgccagcatgatcatctttccccctgagtccttgttcagaattgcaatgatccaggaagaaacatcaacagattttcttcactgttggaactaccaaaacaactttcttcagaggatacttcattttcttccagctactttcagacattcaatatcaggattttaattgtcacacaccttttcttgcccatactggctctcaagtaattttgaggctaacatatccatcacatacacaggtacaaaaaatgaaggaagaaagaaagaaagggaggaagaaacataggagagacggagggaggggggaagcaagaaagcaaaatagcaatcatttttattcatagtccttaaaatacagtggtaacacaactccaacaagtggaaatatttcattaattggaaaattggctacataataatttcaaaagacataattacatgaccacaaaataatctgacatataaacagtttgcaaactgttacagttacttctatatctatagctgtgtgcagtgaaaattgttgttcaatatgatgtggaggcaatccaacatactgaatcacctacaaaggattaagttttattttaaaaaagaaaactggcagatacatataagaaaagtttttaaacaaggttaaataataactttaccaaagtgttctgcctaacaggtttaatggaagtattcacttttgtactattagcatcagttactattttagctgctccgaatttctatcacaaatgaatttcaagcaagatctagattttcttcaacaaatttaacaacttcttaaacattttaaagaggagtctacctttataaataaaacaatcaaatgtattttaagtgcttggaaattataaagcacaataaatatataagctattactgttgctagccagtccctagctacagcaacagtttgacattcctttccccattgctcacactgccgcccacactggagatttcagtctaagaattacctatattcttccccaaaaggagtcaatagaagtacgtgatgagaccacatatttgagaatgcaacaatgtagcccttccttactagaagggagtaaggatatacttcacttccttctagtatatctgcattgttttttttctgtagctgctggcaatggagctatatcaaacatggaactagaggtgcaactttactttgtacattgtgtgatacccaaatacaataaaataaactaccactaaatgtggaatcttgaactggagacatttctgagtcagttaacgctaccacatacggtctccccagaacacgcacattccaggttggtcccaatctcccaagaggtagaaaatttggtgacaactccgtcaactatctggctatgatgatctcaagatttgaaaaaaagtaaaaagaattctgatcccaaaaagaaaggaacccttattttcatccttataactactcagtgacatgtactgcccctccaccagaatgacatgccaaaaacgagtgccatgccctggggcactgtgctgtccctggcagcagtccgtccatccttttgacttccttccctacttctgttctacactttgcttatttatggtttttgattgactagtttgggaaggaaaaaaaaccctacctaatgatttaaaaattaacctaggaataaactggagaagacataatttaataaattcctcgaagtatagagctatggaaagaatattatttatacttctttttttttttttttgagaaggagtctcggtccgtcgcccaggctggagtgcagtggagcaatcacggctcactgcaagctccgcctcccggggtcatcccattctcctgcctcagcctcccgagtagctgggactacaggcgcctgccaccacgcccggctaattttttgtatttttagtagagacagggtttcaccatgttagtcagcatggtctcgacctcctaacctcgtgatccgcccgcctcggcctcccaaagtgctgggattacaggcgtgagccactgcgcccggccccatttatacttcttaaaagaagtttaataaaaataaactagaaaacaaaaatagaaacactttgtgtttcacatacaagggattttcctcatgtggcaactatttggaagaaggtcctatttatcactaagttcacccttactgatctttttcccatagtaaaaaaaaaatgattatgactcactttatgaacacaccaaatgctacaggaaaatagattttagttttatccaaaccagcagtgagaataatttatgattccaaaaaagacatagacatgcagagtcaatttaggaaagtgagtcagtttcatgcaaataagttctagctttcttgattgccagtctccttttaatgttggaattttagggggggaaatgaattattgtggtaaaccaacaattccacttgttaactatggaatatttaaaggatagcttaatatgtacatgtgaaagggtcaagagaatagagttttatttgaatatccagatgatccaattaaatccaaaatggtattatttctagaacagaagagaccattagaatgtgctgttctagtatctctagaattctcaaatttattatgagaattatcctttccacaattgtcaaaatagattgtttggccataaacatccttgcaagcctaagcaatttgaaattcagggcctatatcagtttccttgcctccacccctttcacccccaaaagaaaccagtcaattagataatggataaattaacactatattgacaagcaaagaataattagaaattaataagcataaagagaaatgactgtgtaaaaaaatcacttgtttcaggtttaatgtagtcactttgggacaggaatataaaacatgaaacatgaaaatagtcagcagatgccctttccatccattaataaagtatcttttaaataaataatcaatcaacctatagattctgccattaggaaattagcaacagtgctttgctgtaccagtagagctatcagattagacaatcttcatatgtataggtgacataacattctcctaaaattttctatcaggtttctagatggaggttaaaagccttgtatgattttgtaataattgatataccaagcctggcatccacaataaatattgatgttttccattctgtaaaaatgatataaaacatattagtgcttttatagttatgcaactttgtatgttttgataccaaaaaagatccagaaaatgtgaaaatacagatagttatctaagtatagcttcaccgagattgggtgatttaattatcaatttgaaggaaaactcttttatctgtaacaatgatcataactgaactactgaactggccagcaaaattaatgtcttgatctgccactcaagcagtatttagtcattattttcaaatgactaaaattaaataaaataaactatacctttgagaatcattttaactgaagtagccagttataagggctagccacaggcagtgtttacaaaatgtctctttaagaggtgtaagattatttcagatccacaaagaaaaagcagcagatggtcctgcttttcccttgtatcacttgaaacatacaagacttaaatattaagttaaaagtgtattgagaatacttcagaaaacaaatctatgcccaaatcactccttaaagcatggaaagaaaaataatgctaaagtggaggaaaataattaaaagtggaattccctatatattctaatttgcaagatgaagcttcactcttcctgcaaaatactacattatgggtatgaagacgccacaccagtcctaaccaaaacatgtctcagcccttctccagccttcaccaaatatcacattgccagcttctcttttgtcatgtccttgcacttccacaaattggatttcccatcagagtgttagtacactctgatgaactcaacaaagcagaagtaagaaaaaacaactttaaaaatgttgtttttatattacaaagcaatgtttcaaataaatgttattcaatattactgaaatggcattgaaatagtcataatgagaaaagtgagaacttggttgaactttcttatactggttttacaatttaattctgtgttagtttgcaatacattaaaaaaaggaacgacagaatctttcaaaatccttggtccagtcctactgcacaaacacaagcacctactgcctcccttctctcccgttagtcaatcctaagccttgcctgagaaatatcagtgattctgtcaaatactacagactgctctctatcctgagtgccttgagaaggtctccagctattccagtgtcacctttgacaggaggcaaaggtggtaagcaaaggtgtcaaggccctgtcatccattctgccttgtgtttctttcatttcctgtacagggtaactgctcagaaaaactcaactatttctcacaggacaaatcatataaaaccttacaggattaaaaaaagagagagagaagcgcttgtaatgaaaagaaacgaaagaaataataagagaacacacaagaggaaaccagtcacacccattctctctagtgctatgtagcttaacccacacccaaagtaaactgccttcacttcaagaagctgtctctctgtaaataaactgaccaatgtatctttaagacataaacatcttggactgccataataaacattgcaaaataaatacaaaataacatctggaggcaaagctttgctaggagtggggtgagagggagtgctagcttttcttagcaccattaataaagtattaatttcattttcttttagtttggaaaatgctttccattattaaccaaaaacaaatcaaagacttactgattttactttaaaatccaaagaatggaatactgtctgtccataatggctttttgcaagttgggcttatcttcttagttatattttaattcccttgttttctactgtttgaaactagcactcagtcaccaagcagttaatttagatatgaaaatggtttatatttaggtctaattattactgtcctgttacataaaaatcttctttctgtcttgggaaaccaatttctccaatataatgtaccagaaaaacacaatacttccattgtaagagtatattataatgattatgacattcaaccattgtttctcattgcaatggcagagaccatgtttcatgcacttcctatcagcatccgacttatgtgtagttatcccattcaattaacatttatcatcggcaaacagcaactggtccagctctctacctgtacaaaataattacatcaaatgcttgagttgctcctagtaaattttactataatattattatgtagataattgccctaggaattacttctcttattttgtgtaatgctctggtaagattttttgtaggtgacatagaaagcattgtattccaatgccaagaaaaaaaaaaaactcattagaaatatatgtaacttacagccaggcgccatggctcacgcctgtaatcccagcactttgggaggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaacttgttaactatcaggggaccagtaaatgccttccatttagtcaaataaatatgtaaggatatttaatctcatataagtgttttttaaaagtatacttgtctctctttccataggaagtaatgtctggcagaggaaaactgctgagctatgtctgagatagtttcatctgctcacaggctgctcctgatggcacatatttattgtgtttctcacatggcctaaactataccagcaaaatgaggaattcagttttccttttaaaaaattttccttttgaaaataacaggcattttactaaacattcctttttttcttattttgattagccaaaatgccagttgcaggcaggctacataaaggatattctaaattccagaccctctttcatcagatattgcaaaggttgaaagtaagatcaaatttacccaagccacaagttgtaataaatttaaaagaatcatctttggcttccattattagtcatttcctctctttcaacaaacaataattcaacaaataaaaattttaaaagttctgtctattttaggctttgcagatagaaagacttgcatttaaatctctttattattgaccgtgcactcttggaaaaataatttatttgattctccatatattcatatataaaataaatataatatttttacagactgtatagagttgtgaagattaaaggaaactatgtggcatgccaagtatgtactgggttcccagtaaattgctactaattaaaatgtatgtgctttgcttaaaatagaatttccaagtcactctgaaacagaaatatcgatatttctgttatatataaatatatataaatacaatcatgtaaacacacatacatacacatatatttccttcaataatcaatctttctataatatttaatttaatcaataggtatttacagtatatctactgttcaccaggcaacatgcttgatacagataatacaaatccacaaaataaaattcttgtctttgaatcttcctactaggagaaacacataagatacccaaatgctatgagggtattttacctaagtctgtgcctcctggtgcggaggtcaagaggaatgagcccctaactcaggcttggatgcaggagcaggagaggatgagtgtttagtaacgtgagctaattcctcaatcatgagtacttctttggcagtgaaacaaaataggaaatgaatgtcgggttgggtatcacaggccatgagaaaagcctggcataaatgagaatatgcagtttggggaattacaagtagtttctgtgttctctggcaagagatttgcgaagtgtgaacaggaaacagatgataaatggccttatatgttatgggaaagagtctatactttatcttgaaaacagtgatgagtctgttaaggtttttatgaggagcaatgaaataattctatttgtcttaaaagttgcctttggtg

SEQ ID NO: 1781 - DNA, 3399 bp, Homo sapiens
ccctcccccctccctgccctcctcctcctcctcccctatgtggtgctcccgggagcccagcccaacactggagcgtctcctgctcgcgcacgccagaagcagctcggggtctctccgccgccccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaatgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaaaatgcaaagctgactgtgatacctgtttcaacaaaaatttctgcacaaaatgtaaaagtggattttacttacaccttggaaagtgccttgacaattgcccagaagggttggaagccaacaaccatactatggagtgtgtcagtattgtgcactgtgaggtcagtgaatggaatccttggagtccatgcacgaagaagggaaaaacatgtggcttcaaaagagggactgaaacacgggtccgagaaataatacagcatccttcagcaaagggtaacctatgtcccccaacaaatgagacaagaaagtgtacagtgcaaaggaagaagtgtcagaagggagaacgaggtacaatcataggagaggaaaagaaaaaaacctaataaaggagaaagtaaagaagcaatacctgacagcaaaagtctggaatccagcaaagaaatcccagagcaacgagaaaacaaacagcagcagaagaagcgaaaagtccaagataaacagaaatcggtatcagtcagcactgtacactagagggttccatgagattattgtagactcatgatgctgctatctcaaccagatgcccaggacaggtgctctagccattaggaccacaaatggacatgtcagttattgctctgtctaaacaacattcccagtagttgctatattcttcatacaagcatagttaacaacaaagagccaaaagatcaaagaagggatactttcagatggttgtcttgtgtgcttctctgcatttttaaaagacaagacattcttgtacatattatcaataggctataagatgtaacaacgaaatgatgacatctggagaagaaacatcttttccttataaaaatgtgttttcaagctgttgttttaagaagcaaaagatagttctgcaaattcaaagatacagtatcccttcaaaacaaataggagttcagggaagagaaacatccttcaaaggacagtgttgttttgaccgggagatctagagagtgctcagaattagggcctggcatttggaatcacaggatttatcatcacagaaacaactgttttaagattagttccatcactctcatcctgtatttttataagaaacacaagagtgcataccagaattgaatataccatatgggattggagaaagacaaatgtggaagaaatcatagagctggagactacttttgtgctttacaaaactgtgaaggattgtggtcacctggaacaggtctccaatctatgttagcactatgtggctcagcctctgttaccccttggattatatatcaacctgtaaacatgtgcctgtaacttacttccaaaaacaaaatcatacttattagaagaaaattctgattttatagaaaaaaaatagagcaaggagaatataacatgtttgcaaagtcatgtgttttctttctcaatgagggaaaaacaattttattacctgcttaatggtccacctggaactaaaagggatactattttctaacaaggtatatctagtaggggagaaagccaccacaataaatatatttgttaatagtttttcaagttttgttcactctgttttattgtttgttttattgagaaattcttactcttagagactcatgaattaagaaagagaattctgctaactcagagaacctggttcctatgtaattcagaatatattacatttctcagtaatatttgttttttgaatccacctttatctgagccaatggagatttacttatagcgtattaggagatatttattccattttcttattttaatcaacattctaattatagacacatgggcctccctagctgatttcactgctcccccttcattgcttagaaatgggcatcatttcttgtatgtcagatccccctgcatcttcaacatttagtcttttcttctccatattttctatctgtggatctctttaggggattgaagtcaccctagctgaaggcctcaccagtgtttcacagaggacacagcccaccccttgcaggaggaggtatctctgagtgtgcagcacagaatcgcatgacccaccttaaccttcctgttgtcatggaaggatgcacggctgctctgtccactgtgattcctagccctctcaagatcactgctttctgaagaatttgcaatgactctggcttctggctgcttatctctggacacccgttctccaccagttgtacagttcatgtaatctacttggcttaattgattttccacttctctcttcctcttctaagatataaacattttaaatgatttattcctgtttcttattctggtgtttctttccttgtccctatgagataagtgtctcaactcactaaatctattcccaatgtataaaataattctaattccattttcagctaaaacatatattaccaagaagaaacaaactttatcctacagaatgatgttaggtagaaatatgtccccaggtttgagacctttcggatgatttcatataccatctttcttctgagtgttacccagtcaagtataagtagccaaattatttttgcacatctttctgtttctcatgtcttcatttattcaacaagcacttactgggaaggtctacaactgcataggcaatgctggaaaaagggttaagt

SEQ ID NO: 1782 - protein, 239 aa, Homo sapiens
LTIKRKRRKEGKHYWVTMHLRLISWLFIILNFMEYIGSQNASRGRRQRRMHPNVSQGCQGGCATCSDYNGCLSCKPRLFFALERIGMKQIGVCLSSCPSGYYGTRYPDINKCTKCKADCDTCFNKNFCTKCKSGFYLHLGKCLDNCPEGLEANNHTMECVSIVHCEVSEWNPWSPCTKKGKTCGFKRGTETRVREIIQHPSAKGNLCPPTNETRKCTVQRKKCQKGERGTIIGEEKKKT

SEQ ID NO: 1783 - DNA, 34123 bp, Mus musculus
  misc_feature (1)...(34123): n = A,T,C or G
actttgaaagttatgttctaagagcaggcaagatgtgagcctgtagcagcttttttgcgacagttttagtaagtgattcatgggtttccctgttgtggagcaaaggcaggttttccttttcttcttcttacccctccacaacattgtctcctgtgggatccaaatgaccagcattgctggcatttaccggccaagtgtggcatgcgcttttctaagtgaaacggtcactagtttacgttaggcatggcagactggaggaatgactccactcaaatctagctctgtgaaccaatgaattacattgtgcttgctaattgagcaaataggttactgagaagaacatgggtgaactttattttcaggtacatggcctgccttctgagtgcttataccatggaagaaaatgtccctcattctcccagtaatcatcagctgtccacatcctcaggggtggaggggtgagtgagtggggtgaggcatctttctcccatcccccaggaactgttaactgcctataaacctgctatagttcccccattcccaccccacaacggagcattaatgggctcagtcctgctcagctcctgggctgtcagtcacagcgttgagtttagaagggcaacagcaatgtcatgtccagaggacagtgctccaccatacagagcgaatgctgctttcttgggttttgattgctgttgactttctgacttggaaatagcccatcagagttgaacctatctaagactaggcagacacatagtgtttgctggttgctcctcctctgtttccaggagtcattttccagcatctcagcagataagacagaaaagtgtagtggtttgaaagagaatgtccccggtaggctcataggtttaaacatctcatccccagctggcttaggagatgcggccttgtaggagggagtataccactgaagaaaggcttcgtgccatttccagttttgccttcacactgtttaggagacgaattctcagcttcttgctctgactactaattatctcccagcggccttccttctaatataacttcactgggggctggcatttcaatgactgaatgagagggcataaacattcaatctacagtaactttcttagttgtctctctttcttcccagttctttgcaatgactgattggaggatgaccagggctcctacttagggtttctagtcctgcacaaacatcatgaccaagaagcaagttggggaagaaagggtttattcagcttacacttccacattgctgttcatcgcaaaaggaagtcaggactggaactcaagcaggtcaggaagcaggagctgatgcagaggccatggagagatgttccttactggcttgcctcccctggcttgctcagcctgctctcttatagaacccaagactaccagcccaaagatggcaccacccacaaggggcctttccctcttgatcactaattgagaagtcccttactgctgggtctcatgggggcatttcctcaaaggatgcccctttctctgtgacaactccagattgtgtcaagttggcacacagaaccagccagtataccaggcttccccttcgttaatgttttcctcttctgatctagatgacctcatcctaagtatcccaagaccccagacctgcagagacaccatatcctttcacaaacgtacctgctggttctaccttcccttgtgttctgggacctccagcatccttgctaggttttccccaagcttcctggaggaacgtatactcttctagtcctgtgtgctgagatctgctttcctgattcagtctgcagacggaaccggaagctgctgccttccatctgtgtacactgtggtcccagcataaacactgctcttctccctgtagttcttgcttcttactctttgtacatctctggtaataactctgccacaaatctaaactctcacaaattgggaataccttgatttttctacaactgtgatgaacaatccctatcttagtgttgggaacttattcttagctgatttggggtcaaactcatgactcttacacttcgtcttttctctcttctaaatcctatgtagaggtgggtggtctgctgtgatgtcggagcagcaggtgaggtcctggggtctggtgcatttcccacgtgtccttgctgctcctgagagtgcatgctgcatcactccctggccttttgtaggatgaagtgaggagtgccttttcctcaggctggtgctcattgagatgcctttgttctgcccaatctatgcaggccattgcagccgcaggcttttcattcacaccccagttcagatagatagtcagaggctgactattcatttaaaatgcctaggccttaagctaggcttgttcccactgtctcgtgacgtatttaacccatccatactatcctatgcctgccacatggctagccacctccccttggtttcatatgtctagacttcctctgagtctggggtgaatttcctgcttacctgactcttcccagagtttccctctctctactggaattcccaccttccacctcctcccttttgctgataggccatcagctttttatagacaggtgaagcttttacacagtacagaagagattatccctaatggttggtgaggtcttgacctgactgtaaggccttctttgctctccttggcaagggtctggggctctgtgaagccgcctcacttctccttttccacagagacctttccttctcctcccacagccccgagtcttcaggggggcttcccttcactccctttcccccatcagcctggtgaagcactggcttgctttgctctcagaaccctgagtgagattatctcaagctgagtcacttgaggaaatataacctcagaaatggttatttgatctgtcttccctttcatgcagaaagctagaagattcctttgggagagatagttttcacttaccaaggtctgaaaatagccttgatcactggaagctagcaattggggttacaataatttgaataaacaagttctttgaagccactcttatcttttactagccatcttcccacaacatatatttcttagaaatttgcccagaattaatgatgctagcctaaatagccattgtccactatcccttcatgattttctttgtctgaaaagcatcatgctttgatcatttcttttgacatcattgtcttgtggatacccaggtatatgtacatttaataaaagcgtggatacttttctcttgctaatcagattcaatattaattagatccctagatccagctccagagcctaagaatcagtgtaggttggagaggaaccttctcttccctaatctccaaagtgtcttcatggtttcttctcccctgagctgttctgggaaaacagagtgaacagcttttcaaagacactgaggtggagtctttccctttgactcttccctttcacagtgccaggaacaactaagagggggtggggggggtggggactgaagggttttattctttgactaagaatattttatttaagtttgtaatttgtgcctgaaatcctcatagtttaaaggtccggtgcccaacatctgactcctgtgctctaccgtaatatgctaacaaaatgctgtgggggaagggcaggctcagaaagaagcagcagcaagagatggtgcttgacacacacatgggcaagaatactcattattgtttggggcttccttttatggtgttcaaaagaaggaggactttggtcactaggcataatttgggtggttttctattttgataaacaattttcaagttgtacaaccttgtctctactgagcatatccctacctgtaatatccctgattttagttacatgcgtgctccactgtaaatatgaataagatggtaagtagaagattccctctaaaagtccccttagaagacagtttttcatattgtgaatgaactcaaaagcagttcagacctgatcagctcctctaccctcatatccatgatgggtgctcaattgaatagaatatgtgtaagtttgatagttgttaaggtgaagaaaaacttaatgcactgttcatagtggtgtgtgcatgcaaattgatgcagattggagtcccttaaaaaaaaaaaaaagccaggcagtggtggtggcacacgcctttaatcccagcacttgggaggcagaggcagtccgatttctgagtttgagaccagcctggtctacaaagtgagttccaggacagccaggactacacagagaaaccaggtcttgctaaacaaaacaaaaaaccccaaacaaacaaacaaacaaacaacagcagcagcaacaacaataataatttgtgtgtgggtgtctcacctgcatgcattcagtgcccatggaggccaaggcaggcatcatatctcttggaactgtagttacaaatgtctgtagtcaccttatggctgctgggaattgaacccaggtcctttggaatcagtcagtactcgtaactgccaagtgttctctccagcccataggtgggagtctaagttgctaggagatgcgcatgtgcttagggcatgtaagcaagagacttcggctgtcaagtgcattactataagtgtatgcagactctaagccaagtgcagttccgggatgctaagctattccttatgcttacgtaccttataaagagttcttttctgagacgtctgctcacgttaaacaaaaatcttgatgtatgccacagaaaaggactttcaggacaaacaagtaagaaaaaaacttaataggataattaatatgaataaaaggggtacgtggagagagagttcagcaattaagagtgttttctattcttgcagaggacccaagttcagttcccagcacccattgttgggcagctgataactattttgtaatcccagctcccaggaatctgatacctttggcacacatccatgcatatagttaaaatacatctttaaagaaaagaaaaagcgttaggagttggagagatgacccagtagttaagactactcactgtacttctggaggactgaggttcaatttccagcatacacatggtggctcataattgtaaccccagttctaggggaatccagtgatatcttagagccagaagtggatttaagctcataccaattgtcctgcttcaacttcctaagtgatggaatcacacaagtgaatcatcatacttagacattttaagtgtattaacattagttatatagatgatttaggtggcatttgcagtcacatttttcaaaggatttaaaataaggactagagagatggttgaggttcaagcatgtctgtcttctgccgaggatctgagcttgagtctcagcacccaaaatgggtggccacaaccacttgtaactacagcacttagggagctgtacacctctgacctcatcaggcattttttgatgtcagtgttgatctttgtgtgtgtggtgtatgtgtaggtatacacacgtgtgtacgtgtgagcgcgtgtgcaatagctggaggctggttggctttggacgtcttcctctgttgctactcatcctgggtttttgagacagggtcttttggtgaacctggaactctcatccagccagtgtggttggccatgacaccaggcactctcctatttactccctacagtgttgttctcccctgctcccccaaccccatgctagtgtttcagaggagagctgccacgcccagcttgagggtgctgtggatcctaaccgaggtcttcagacgtacacagtcagcacttcacccatggagtcttctccccagccctgtcagcgttcatttttactgtgattacgtgcttcacaaaatatattttacaggtctatttgcatttttgtctgcatctaattttttataagtagttctaaaaagattcagggagggatgcttgcacaagattgtgactcagtcccctctgttgtctgcctttcactcccttaacatacaccatttatccattccttccagccagctccccacagagggacagcattattcattcttctgtgaggggggagtagacaggagtcacggtggcgggctatttggtttattcttctcttctttctttttctatttttgaaacagggtttctctgtccagccctggctgtcttggaactcactctgtagaccagcctggccttgaactcacagagatgcacctgcctcggtctctgcttcccaagtgctgggattaaaggcgtgcaccaccactgcctggcttactccctcagggtttcatctaccaccctgactttgccttctctggtacttctggtctgcagcagggcctctctccagagttgtttatcttctctttgctcttctgtccctctctgattcactttgacattccttcccttttgtcccacattctaaatcctaacgatgttaactgttaaatagtgttgcctaagatttacaaaatccaaaatgatgatccttatcacctcaccccccactccctagtctttagttctgtcagttgctataaagcttaacttgaggaaaagcaatttagctgagatcaggctggcctggggtgatccatcccaacctctacagttgctataatagtctccgtgccaggttacaattcaatttcaaccttttaagtttaatgtttattgaaatatacttttacgctggaacaagcacaaatggtaagtgaaacattttatctgcatactatgtgtaactacagtccagaccaagatattttcggcaccaggcagatggctccatattgcccccaaagacctcctccagggcagcctatagctatgtttgcccttcgttttagtcagggtttctattcctgcacaaacatcatgactaagaagcaagttggggaggaaagggtttattcggcttacacttccttgctgctgttcatcaccaaaggaagtcagggctggaacttaagcaggtcagaaagcaggagctgatgcagaggccatggagggatgttctttactggcttgctcagcctgttgtcttacagaaccaagactaccagtccagaaagacccacaaggggcctttcccccttgatcactaattgagaaaatgccttacagttggatctcatggaggcatttcctcaactgaagctcctttctctgtgataactccagctgtgtcaacttgacacaaaactagccagtacaattgaccccttgtcaacttgacacacaaacacatcactagtaagcctcaacacttacattcttattcatccccaagatctaaataactttaaaagtcccacagtctttacaaattcttaaaatttcaatctctcttaaaatccaaagtctttacaattaaaagtctcttaactgtgggcttcactaaaaaaaaacttccttcaagagagaaaaatatcagggcacagttctacaaccatccaatgtctgggatccaactcatgatcttctgggctcctccaagggcttgggtcacttctccagccatgccctttgtagcacacgtgtcatcctctaggctccagatgcctgaccaccactgctgctgctcttggtggtcatctcatggtactggcatctccaaaacactgcatgaccccttcagtcctgggccatcaattgcaactgaggctgcaccttcaccaatggccttccatggcctctcacagtgccgagcctcagctgctcttcgtgacccctcatgccttcaaaaccagtaccacctgggtgactcttacacattaccaagtccagccacagcacaaggtacaacattggctatctctggaacacagcctctgtgctctcaaaaaaaaaaaaaaaaaaaaaaaacaaaaaaaacaaaaaaaacaaaaacaaaaaaaaaccaaaaaaccaaaccaaaacaaaacaaaccacttcccagaagatgtcaaatcattgatgctggtctcttcttaatcaccgctaatttcttagctccagctaaccagcatcaattgtcccagtaatgcaaaggtttcactctagtggttctggtattttgttaatcacagctgattcttcagccccagctaaccagaaccactgaaccttcacaatcaaactagcaatggccctgaaaagagtctttaattttccctctgaaatttcacaagccaggcctccatcttctgcactgttctcaacattatcttccaagctcctacacaacatctcacagagttcttaacagcgaatggatcttctggcccaaagttccaaagtcctccccaaaacatggtcaggctgtcacaggaataccccactatgctggtaccaatttgtcttagtcagggtttctatttctgcacaagcatcatgaccaagaagcaagttggggaggaaagggtttattcggcttacacttccttgctgctgttcatcaccaaaggaagtcagggctggaactcaagcaggccaggaagcaggagctgatgcagaggccatggagggatgttctttactggcttgcatctcctggcttgctcagcctactctcttatagaaccaagactaccagtccagagattgtcccacccacaaggggcctttcccccttgatcactaattgagaaaatgccttacagttggatctcatggaggcatttcctcaactgaagctcctttctctgtgataactccagctgtgtcaagttgacacaaaactagccagtacacccttgtttagagcttcatacacaaagactcctctctcactttattttgatgacggtgttgctctagttggactcccgcattcagtagggatgcgctggggcacttccctactacccttagtaggtagtagttccattcaatacaaggtttgaatcacttattaatttttgcagctgttaaatgtgaagacaacgatcatttcaactcttgaacctgttaggatgatcactatctgtcaaatgctgtatgtaaacctttgtgatgaacagaactctgtttgttgttggctacaggaggaaaccatccagtacacattctaagccacctgcttgtggttatttgtgatggtggagtggatttcctccgcgagactttggatccgtgtttagacaaaggtatggcgattcagtatgcctcccggtttctgtctccagtacttagctcctgtattctaggctggtagtgaggcggaacaccaagtccatggtaacctgcagaggaggatgctgcggaaagggaacacaaaaggggccagggaaaaatgtagcccccaaaggacacatccttacttttcaccacctcgtaataatgctgtcatattatgactatcagagcattaattcactgattaaggcacagctctcaggatccaggctcttctgaaaaggtcatcagttgaaaaccagatccccaatgaatgagcccacagggagattttatattcaaaccacaattactttggagccccagaactccattttaagaataaaggtttcgtggctaaggacatttgtaagatttctttgactttctgaattaaatagtgcgcctcgcaggcttgcttcctttggattttagcagcatgagtcagatcttaaaggtagaaacggaaaatcatctgtaggcaagtgggtcagcacattgttttttctcagagtagctcccatcatttcagtacagcatttatagagcggtaccatatacaagctatttgcaagcgcaaagctccgtggatcttgtcatttatgtttcattgacatctcattctccttcagatcaggcccaagctgcgtggcatctcactgtggtgccatctccctctttcaggagcatttacttcagtatctgtggcggcccctttaaggccctggaaagggccggctggcggttgggcggcgaggccacgcccccttcacgtggccttcgtgccattgggcggagccagggcctctaagctgccgtcatttccggctctctgtcagtccggagtaggcgagcgagcgaggcagaggtttttggtcggccggagcggagcgtgagtgcgtgggaccccgggcccattcctcggggctgcggccaggccgaccccaggctaccgcggcccccttcgctctccttgccggtggggagaaaaacggcagctcgggggaagggcctccgctcttgcccgcgtccccgcggggcctcgtgtggcggccgctctggggagccgagccgaggcggtgggcgcgggcaggcaggcgaacggcgggtgatggccgcgcgcccctcggactgggtgatggggctccgggcggaggcgctagcggtctgccctgaggctgcgctcgcccacccctgtccggaccaccgtgctcgggaagccatcccttccccaccctcgggggacgctggccccgcggggtcgaggggcggggggcgcgctcggcaaacatggctgggctccggggcgaggagaaaatggcgctggcgcaaggccctcctcttgtgcacgctctcgacgccccacgcccccttcctgaggccggcagtagccccagccctcgcctcggggctttcgggagcttcctggccgcgacccccacggtgccacgcgccggctcgccctcgagagcctcgcactctgggatgttttcagtattccccagccccgggcaccgactggtcggtctataaactacggtcaccccttttagttaccttttgctcgaattacgaagccccccgccccccggcctccaagaaaccaccccagtaaagcctcattaaagttaaaagtccaagtgtagggaacggggctggctttagttcccagtaacaaacattgttttcttattgggtagatttaggttagataatgacgtggttctttgaagtaattttagttccccagacagcttttcgtaatgggagatagatatggctggctgtttgcaagcgaaagatttgtttatgtgcaattccctctcaaaaaacaggctttgtgtagttgtgtgaccgagctagcttgggaaacttgattttggaggtcgggttgtgaaatggagcagtaagaggaaaagcgaagggactggttaggagccttctccctcctgagtttaggtattacctctaacggactggccagttgtgtagagtcgtgggcaggatttgggtagctcacttttgccttgacctcctattttgcacattgaatgccagtttggtctttagagagctgggttataatttttttgatgtaggaggtaggaattgatgtatctttcttgagcatttacagaatcttgtgttttttaggacctttaagccatgtagaagttagtaagtttatttagatggagagagcagaagatagtttggtaaatagcttttgctacctggttttaccatttggtgtaagtatcttgaaaagtagttaggacctgcctaaggacttcttgaaatgtgggttagacgagttgtctgccctttgtgttatgcagtaaataaacagcaggctctgcactgtgtgcctgtctggtgagttttgccttgcacataaagccttcacattttatatatttccctaagtagaaaatcagtgcaaaattattgtgaattgtgtataacattgtgaactccgattgttgcctgttgttttgatagtgtggccacaaagtaaaaactagtgtatacagaacatgtaaaagatgatttataagggcaaaattaattaggtattatgcttacatgggcaagctgtttatgttggagctggtcccctcaatgtgagtggaattatgtacatttctcttgattttacggtcattattctcagctgctttcttgtagtctacccacaaactttataacctgtctaaaaatcagttgttaaaaagacccattgactttgagaagggtgaaggaatgtgcacatggcttttatttcttttttctgactgggttcagaataattggctgtgcttgttgtttgcaatttagacatgtgttctgtgtaacgactccagtaccacaaaaaggcagaatgagctgtggaagttaattttttcttttggtctgggagagctaagatgaaggtactaaaacaccttgtaaattattcatgtgatgtctttttctttcagaatgcctaaatcaaaggaacttgtttcttcaagctcttcaggcagtgattcggacagcgaagttgaaaaaaaggtaacttttactctaccaagttcttttatagaacaaaatgtatggtgcattaattgctctataatgctgacattgagttttgaagggaaaggcctgtcagtcttttaaagtaggttttgctatgcatcctagacttctccaaacacctgggatttccctggggggtgggggtgggtgggacgctggggatggtgttaccaatgctgggctcagaatgtgagagaatctacaagggtaattttgtaaagataaatgactgatggattccttgagtagaatattagattctagtctcatctgcaggacttacatcagatttaagaggtctttgtgttgtacttggggttcagcctggcagcccagtgcatcctaggcaagtacttgctatatctttagccttcttcttactttttatttgcaacagggtctcagtaagttgttgggctgaccttgtacctttgtccttctgcctcaccctcaggattagggacccagctcagactaagcaagtcctccattgagcacctctagtaaccaagagtcaacagaaatgcttcattagactctagagcactagaattctaatgagaccaaagacactacttatcattatttagaaattcgtgtcattcaaaaatccagttgatctagcctgctgtggcgcctcgtgtgagtttgatctctgttcttccacatggtaggagaagagaccccattataccaaatttgtcctgtaacctcatgtccccacatacaggcaccacacgtgcaacaaatacaaactgatggtaataacatttccaaagctctgtctgacctacaggtataagtcactattgggctgcatggatttttgaatgaaaacattaatgttgatagtttctcagtcattgctcctcttcaaattactgaattttagttttggtacattttaactttaaaagttatttgcttttagtaaataaagtcatccaacacagcaaatacaaaattacccattttgtcagaataagctttttctgtgttaggtgatcgttgttttgtcaacttcattccactcaattgatcacagcagtgaagtgtgacagagctgttcaccttgtggtcaagacttccttccacaccgctgtgtcttaatagaaatttatgtctgaatagacattcatatcctagaaattgaacacattgtattcacccttatttgtttacttgctttgttgaaaataagtaattaatgcacctgtggtttacaaagtgtaaaagcagcaggcaaagctagttttatagttcacttggtagagtgctagtctagcactcaggaagtcccaggtttgatcccctagccatgggaacggaagcaggagggtcagaagttcaaggtcacctgggataatggggaccctgttttatttatttaaagcagcaacccccctcttcttaaaatttttttttaaaaaaatttttgttattgtttaggttttgtttgtttttttggcctctgtactccctaagaaaagggagctctataggaaaatttaggaaagttggagcctataaatgtacagatagactgtagtatcatttataattttgaaataaggcttcaaacatcatatatagctgtacttgaagtcttttcagaacttgtagagtgtagcctctaagagtgagtgtcactgacactgaggttacttgctgcgtgcaccactcagaggattgtgttttgcttagctgactgtgtagcttgtctcacagtactattaattctgtaaacatttacattaggtgcttccatagttttcatttcatagcatattattgccctagcctcaacaaatttaatatacgtttagtaatattaaactagtttgtcctttccactaagaaggaacatgcctgccctctactgtttgggctggaaacttaacatgggtttttaaaaattcttatttttttaacttttcgctcattttgagaatgaggtcatatgcaatttttttatactagtgctaattctaaaatatggggttgagtacactagtcttactactgtccatcatcaattcttagtgctgaagaagtttttgagttgttgattttcagtgcctggtataagatagtaacttcctttacctaggcatgcttttttattttttcctcctaagagttaaattatgtagccctgactggcctggagcttgctatgtagtccaggctggaagcatacattcttgagaaagtacagataccttttggaatagacaaagaattagtaagtagtcagttttagtcataaatatgttggttttgtttgtttttttgattgatcttcagctttcctgcctcaaccttagtcagggttacaggatataccagtatactttgtttttaaaaacttaaaataataagaggaaagcttctggtggatttgtggtttccaaaagtttatacagaagttataggctgcttgtctttctctttccagagagtagtgtgtgggttctagttcacaagatcactgttttaacatctgaggaatctttggggattttgagagtagagtgtaaaaatactatcattagttatgtgaagactagattcatagttaaaaaattttaatgtacatatttttcataagtcaaaaatttgagtaactttttaatgaagtgttttgaacttcacaagtgtgtgttcttgcctgttttaagttaaagaggaaaaagcaagcggttccagagaagcccgtgaagaagcagaagcctggtgagacttctagagcactggcatcctccaagcagagcagcagcagcagagatgacaacatgttccaggtagagtcggagggcactgagtccagtggacagatcctgatctgagcacaccagtcttcccttgtagtcctcttgaccagagtagaaagtgagggtaatttgttcaattctgggctattggtaaaagcccagtagaagtctagttttactatatttaaatgatacaaatccaaaggtcacagaaagccaaaaaaagatttagaactatatatttgggaagcaaatttgagtaagtaggatgagtatttgactggaaagtgtaaatttgatagtatttgagagaaatggcataacttaggcttcataagaaacagaaggctggggacaatagtgtatgggtacagacaatgctgggatagcgtgtttagaccaggagtctgagcttaaggaaaggggcatcggagagaatagatggagtgagatgggaaccccagggagggctgctgggtgtcttggctttattaaagtgtttgtagcaattcagtatttgcttcactgcaaacactgatcggtgagatgaggcattgtaagtaaataatgctgtgagattatggaggcagttatatagactttcatttgtattgataagggagagagtgatgattacaaagacggtgatgaagaaagaccagctgtaaggtagacctgccagcaaatgtggccactgaggatctcctgtagcgcctggggggcttggctgggaattattcttgttggcttttacacgtgctcgaccaaatagccaaccaccaaagaacacaaaccaaagagaggaggcgatagcagcttatgagagatttgcaaatgaatgatgagaggagaaaggatgtaagtagataaagtggtgaaagaaaactaaaagtagtagaagaaagaaatagacaaaaagaaaatgtagattaattatttagttataggtttcagttcttcgacttcagtatagtttcggggcaaaggttggtttgatagagaatataggtgaaggtatgtgatgaggaatgtaaaagaatgctgttattgcttcaaatggatattaagttggatgcttacagtgctctatttcattcaggctttgccaggtcctagtaatccatgtggaatgtgatctgtaaccttgtggaatttaagggaaccatgattacatacgcatagtaaaaatgacaatgggtcctgagaagtagtgaacagattgagagagtaggcatgagaatctcattaaaaagataaggcacctaaatcttaaaacgtgatcggtgcggtgtgtggacaaagggagcattttcaagagcaggaaattgagttaataccttgaagtgggaaggagctcgggttgtgtatgaactacagagcctgtgtggttgaagcctgggaagtcttgctgatatcagaagtctggtggagatcttccagggctatttgacttaagtacagcgagtaactggggcaggataaatatataattgactagagtattttgtagtgtttgtaaagaagggctttggaatatccagtttcataactgtatcttggctttcttttaccatcatgctgtgcgctttcctttctacctctggcctgatggggtggggggagtctgaattgagggtctttttgtttgttttgtttttaatagccctagcttacttggaagtcactatatagaataggctaatttgagtttttagcaatcctcctgcctctcctcaagagcagaggctgtagacatgtattaccatgacttttaaaagttgttttttggtagagatttttgagaaatggggtctatttttaggggatgactttttttttctcactaggaaaaaaagagctttggttcattttttgttgggtttcttgagacaaggtttttttgtatggctctggctgcacaacagagctagttttagacccacagagatccacctgtagcgtacacctacagttttgccttttatgaagacttttgtctcagtcagtgttctgttgctgtgaagaggcactatacaactcttagaaaaacattttcttggagctggcttacagttcagtggtttagtcccttgtcaccatggcaagaagcgtggtggcaggtaggcaaatgacttgctggagagtagctgaattccacgggcagccggaatggagagacactgagtgtggcttgagcttctgaaacctcaaagttcactctcacttcctccaaaaagactgcacctactctgacaaggccaggtgtcctaatcctttaaaataatgcctctccttaagagcctaaggaggccattttcattcacatcacaacagcggcccttcctttgaatactttggatctttcctaaataacttggtgagtttattaaatgcatgccctatttttgggctgcattcttaattcttgtcctatgtctgtctgctttagtacacactttccttacatgtactgaatctagaaagtggggacattcaaaaaccacatagtttgtgttaagccaccagtataaataaggttttttatttattttttaaaaatgacagggtctcggtatgtaggcctgtctcttagctacagtttttgttgctgtaaaagacactgatcatggcaactctatgtgtaaaggaaaacttttaattggggctggcttttatagtttcagaggttttatagtcttcagaggaagagctgagagttctgtatcttaatctgaaggcagcaaaagctactgtgagccacactgggcatagtttgagtatgagacctcaacgcccaccccctacaagtgtgtacagtgttgtaagatacttgatcacactgtgaaccctgagattgtatttactggaaaaacctgtttttagttgtgtggctcagccttagcacatacctttagtcaaagcacttgctgcttgaatattgtaaacaggattaaacaaagtcaaccataggtcaagaggcagagcaagtgacaggaagtgagcataggatcattaagaaacgtagaggacaagaggagtcaggaggacagaaatgcacaggaaggagaaggagggacattgagtttgaaggaatttgtttgacatggcgtgagagagagggcattctggtgggacttgggctaaggaggaaggttagtcagctgggtgctttctctgcctctctgagctagcaattttccaccccagcacctggctcccaagacttcattggtaaaatcaaataaatgattgtgattttgttttgtgtgttttgcttttttttttttttttttaaaccaacaacagtacacacttcctccaataaggtcaatgaactctaacaaggccacactccccaatagttgcagtcctgtgggccaaccattccagctcattggtagctagctgtttctgttcagccagcacacccttggtagcctggagcttgctatgtgtaaaccaagctaaccttgaacacagctgcctgttgctgccttctgaggtgttttactttttgatttctctgagtttactgcattaggctgtaggcatttcatttaggttgaatcagattgtactgctgttatttcacttaacgctatagcatagacaggattgcctatataaagactgaatagtgttccattgcatgtgtaagccatgttctatttgtgtcctcatctaaggatagacttttgggttgcttctacttcttagctattatgaatagtgtaattaaggatagttaagatctcttgggagactctactgccagttgttttggatgtgcagttatgtgccgcaagtgtcagtcaattgaacacatacatataagtgaggatactctaggattggtaccatggtgtgtaagttgtctcactaagtacattctgatgctcacacaggagaatcttctgagtattcatttctcagaatatgtccggtctgttaagtatatgttttgccctcaaagcgggattattggaacattatgtttctatttttgtcaaaggacatccattctatttactgtgttatattaaatttcataatttttaaagtgagactgaagaaagatagctcaataagcagaaatgcttgtacaaagaaagaccagagctttaatgctcagcacccccctgaggtagttggatttggctgcagatggctataatcccagcactgaggggcagaaatgacagctcctggatactctgtggtctgccaacttaacagtgagagatcttttcaaggcaaggcagagaatgataaagacacttgaagtcattctgtggacatacatacatgcatgcacccccccttccaattgcagttgaatacttattccaggattataagtgcaagttgtgaatataaattcaaaacctctctttatgcattttctttctcactctctgctagattggaaagatgagatatgtcagtgttcgggacttcaaaggaaaaattctaattgatattagagaatattggatggattcagaaggtgaaatgaaaccaggaagaaaaggtgaggttttatttcttcagtttgatgttaatactgattgaatgcttgccttaaaatgttacagggaatacaggttaaggattggccttacttggttgatcctcttataagcagtttgtaatgaaacctaggaaaacagcatctattgtcacgttgaattgatcactaactttaacttcatttttatcagttcctaggcagattaggcattactttggaaactgtaaaatgagaagtagcaaactcctgggtttagtgtttgctttggattcagctctagcaagatgttctctaatacagagtccttaaaggtctctatccccttagtattggtgctttgtccagttcaagcctcttagcatgtagaaacagtttattctgttacaaagtaactagaaaccatttgcaccaacttatgtttagttttcttgtgacaaaataggagataaaagcaacttaagggaagaagggtttattcgacccagccagaaggcagctgctcacgtggggcccagtcaggatgtggagagaagagtgtcctggggctgggcttggtgtcactgaggccttaggcgggtggggccacccacattcagggcaggtcttctttcatcagtttaatctgtccacagatacttgtggacactcacagaggtgtgttcataatggttctaactaaatccattgagttgatggtcaagatgaactgttaacttgtgctccagggagcgtagacaaaggcgcgcacatagtagaggagggactggttgggaagaggcaggcgatgggcaggagtgggaaatggggcatagcaagggagtggagggtgagatacattatatacatgcaggaaaatgtcaggtgaaactgttgtacatggtcatgttaaaaaactttgaaaaagattaacactacactacctaaatttatgtagttctatgggttgatttagttgaggaaatgctttcttgggccagtaaggtatggtgcctcagcaggtgaaggcacttggtgccaagccgtatgatccaggacccatgaggtaaaggagagaatggatactacctatactgtggaaaactctgtggcacaggggggcccatacatgtatgcatgtgtgcacccattcagtgaataaatgtgtattcttttttaataaaaggaaaaaaatgtgttcttctagtactagtctgcccactgttaaaggtgacacttctttgatgcagttttcaagtgtgtcttagaagcttccttttttatctttactgattatttctgtctgagatttcattcaggattttccacagtggctaatccttgatttcattcttgcatatgtttcctaaggaactgacttagcctcacaggcttccttcctgctgctgcctattacattctcatggtccctcagcagttttctgaaaaatacattgtttgcgtgtatgggatgttggattgaggtttcattgtacctgatttaaatattataaccaccctttgatgtggaagtcatatttactgattaagaaactgagtctaggaaaggcagctagggatggtgaagctgagtgtcactcttgatagcacgattccagagtgcacccatacccatctgaattgtgcactctgccatgccccttttgagtcactctaaggagtttcccaaagtgaaatggatgctgatggaagaactcagcacagagctaaacacattgaaatttggtggaaatatggaacaaatgttggaagagacaggatataaaactgccaatgtctggatataaatttgccaatgccaaatctggttctctatatgtttgtgacaatcttcggattgttactgtacttattggtcaaaataggcattatgtaggtgcactgttggaagttaaactggatataaaattgaacctatgactaacaaatttaagattttaatatcaatatagatcgctcataaaaacttcaatattctggttgccattcaaaaggcagctggtgtaatagagcgtgtatgtggcgtgcctgagatctgggttttgttctcaacactaaaaatccacataagtgaaatgacagttttgattcaaatatttgtatatatcaaaatcccccaaaaggcttgattttcaccttgtatttcttaaaccttgtttaggtatttctttaaacatggaacaatggagccagctgaaggaacagatctctgatatagatgacgcagtaagaaagctgtaaaatctgagccatatcaaacctgtactgttgtagttgtctttttacattggcttttgttttctaaatgttgttttccaagctgttgtatatttggattgcagaacaatttgtaagacaaatacttttttttaatgtgcattattaaaatgttctaagtgaagctaattgtcaagtttattaaagaggattgctttgtgccccctacctagtgtgtaaaataaagtcagatcattacaatcttaactgtggtacccttttttgatcaaaaaaacctagttactgtttaaggccaaaagaacaactaggcacactgttgagtcagcttacattcagaaggatttgtattacattgagtttcttagattgctttgtgaaatgtatactcagcctttttctttccaaccagatttactgcgttttcctctccaggacttctccctaccacaataacttatcttttcttcagttctcttagtgctcaagtttaaatcactctttactcagatagattacgcttatttagaaagtcaaactgtcagttttgttgcctcctaagtctactgtgctaattactagtatctgtttggcaacatgacttatatgagaactccaagcaagtgtatgtcattattcatagtgctctgtgtagatgttgcttagtttacagaacatagtgactttgatgtctgatgagctgtcactcagtaaacatttgtgctagggtgatggttataaagtcagatattaaactagattagacttgtaaaaagtgtgaaacttactggcctactgttatattctaataatgtgtggattctatgtagtcagatgtggcactgagctcaactgtggtaggttctgtgggcagttttagagttgactgttctacagttaatctggacaagtgacttccagacttgatgttaactaggtttgatagacatttccattggttttcatttcaattgtgatgattaagcaagcagacaggcacatgttttagggacattgctccaatgaaaagggcatagtgttctgagggaaaatgtttgcaaaggaaagtcaccacactgaagggagctagcctgtgatgagaaaggaactttcttgaaactaaatgttgtgcacatgatatgttggtgataacattaagatgggtcttcgtagaataatagctaacaaggacaatttatagatgtgaaaaaatgctgccactaagggctgccatatcagaattgcactgtcatactgagtcccaccgtctaagcattttatagaactgttaaggattaaatttaaaaaacagtctgccaggcctcatgtggttaactgtcctccccacagatactctttaggtaactttttagtgtgttactccaaattgatacatatatatcaaagggtttaagatatataccatagctcattcttgagggatgatcctcttataatgtgttgcatttcattgattttataaagtattccttatttgtcatgtaaagaaaggatagttagaacataagactggtttggtgcagatgaggggagaataacaggtaaattcctgaggccatgtgttatatgtacatttcagctgtccgattgcagagatctgccgtctgctacctaggcattgctagctgcttagcataaaattccatgtggaaagctttctcgggcataatttgttaggttgatagctaaatacattcactaatgttataccagagttgttgttatttttctttgtgtgttgaaaaggaaaattgagttaaaagaagaggaaggacttttcagatggaaaagaaagggtacagtccttctattttgcgttcagatgcctttctcctcagtgtcttagtttcttttctgttgctgtggtgaagtgccctgacagaagcagccaagggagaaagggtttatcctgactcacagttccatgttccagtccgttgtcgcattgtcacagtggcaggaactccagacatctggccacatggctccatagccaggaagctgagagctgtgattgcatgctcagttcctttttgtctcattaacctgagcccaggagctggagttggccacagcaggcaagatgattctccagacatcatgcctagaggcctatcttttgggtagttctagattctgttgaactaataaccatcatagtaagttttctcccaggaagaaggcttgacattttaaggcataatatcttattttgtaacactaaaataattagatctgctgccaggttttgccctttaatatgctccatagtaaggcttccaaatgggttttcctcttagggtaaaaagcctttggccaatttccacaatcactgaaaaagaaaaactcagattttcttttgtttgcttcacaaatgcctaaaatcttgagaaatactacctccttacctagtcaagacgctgtgataaccagtctgtgctgcgtagtgttggagtcagcagcgtggggaaaaccgtggggaaagagcatcctggtctggctgcaaagggaggaagggattgaacagttatgtaagcgttcctgacaggaacgctagcacagagcttgccatagagcctgtgaacgtcttcagaaccgttgagttatatttaggtatcttttctgaatttctttgtggttcactttttatagaaattaatgtagtgaaacactaaagatttttttcttaagaaaggtatttttttccagataaactataatgtaaacatgcatctagtgagaagtatgtgactctgtaattgtggaatgactgtatgctttgtttagtacatcttccgtggaggtgtcagtgaacctattattccacctgtgaatattttaaatgttgaataaaaacaagaaacacaccctttgtgttatcccatgttcacacacctgaagatggagtgagttcacacacctttatctgctgtaagtaatgtttctctggatgttctagaatctgtactagctttcgagtgagtgttaaatctgaagacttcggggacttggtgtgggattaatgggagccaaatgggaaaatatatgcaaatgccaaggagtgcacagcatcaagtttttatcctgcaagtgctgtgcagtctgatgctgtggtgtgtgtcttagtcactgttgtcaccatgaccaagtcaacttgtataaaagcttcagcccatcatgttcatggcagggaccatggtagcactcaggcagacatggtgctggagaagtagctgagagttctacatccagatgtttaggcagctggagaaaagatactgggccttagttgggcttttgaaacctctaagcccagtcctagttacacacttcatccaacaaggccacacctactctatcaagaacacaccatctagtcctcaagtagtgccactgccaggtgactaagcattcaaatgtgtgagccaggctcatccaaatcaccacagtgcacttgtattttcatttataaaatccctttcatcttgtcaagttgtattacgcagctatgtagagagcttgttcacatttttatttatgaacttcaataaggagaaataaacttaggacgtttatgcgacttttagcgttagattttaataaaacgtggacttaaatgtcctgttagaagggaaaaccaaagtagtacttgagcttcctgcagtctagatgaagttaataggataacagattttacatacgtgcagtatgttgcatgtgcttgcttactgcacagtggtctgttgctgaccatttaagacaggcctctgccctcctgccttacgtacagtcttcagagtccatagtctctagaattgaactcattttagcgttggactaatagtgacctgaccctgtttgttcctatgttttattgcaggcttcttaagagtttgttgcaggctagagttcagtttattatcttctaacagagaattgagaagtatagaaaaagtctgaaatgagagcagagttttattggcaagcagtataaactgagaggggtcccagagctggaagaccccctaatgagagctaggcttttccttggttccaagtacccacttgtggtgacccccttctctctcctctgttggccctatggtgttcatgtgtcctttctggcatggggctgcgtttcacagctgcaacagggcacatgcccagactactgctagttagttggggtccttgagcccacttcatggtgtagtggggagggagaaattaacgcaggtgaagagggaagtgggttgccctctcccctgggcccggggctcctggatcactactgtaattagatgatgacatataccacttcctttctctgattctgactgcactttgcctctgaatctcaggtggatacaataatattccttgtttcagaaaaactggatcaagtagttctaccatcaaaacctagaacacatctgaaattgtgtgttctagaaaatgctaggacgttatagttttaactgtcctgttgatgggtttagcttccggcctagttttgtttagtttcctattgctgtgatataataccctggcagaaacaagggaacaaaggctttgtatttgttcggcttagaggttcagagtgagcatcatgatggggaagacgtgtggcagcaggtagggaaggcacagggacaggagtagcaatctggctggtcacagtgcatcgaaggtcaagaagcagagcaaggacagcaagtgggccacactaagaggacggcactcagtggggacattgggggcagttgagggagttgtgggagggatagcactaaggatgtttgagaaagccatttggaaatcatgctttctaaatttacaaatacatctatatatacaagagtttagctggagctaccctacgtaggttgcctagtatgggatgcctctccttgagttgttggtcaggtgaccctcccacccaccaccacaaaaaaaaaaaaaaaaaaaaaaaggctgttgctcatgtttgcccatcagaacctggtaagaccccgctgctgaagacatcatatttggtagcaggacgtggggaaatctctggccagctttcatagtaccagaaggtgcaatgtaggctgtagggggtagggggcgtgagtcaacagttttacttgaactgtgaattctgggagctacagtagtgaccattgtgccaagataatggctatgggtgcagcagttacatgttacaggagtcaccatgggtgcagcagtgacatgttaaaggagtcatgactttctggttggagttaaggcccagtgcctaggaggaaatgttaatctggccaagaactaatggctaagaggttccaagtccccactgctgcgaaccatagtggatgtactactgctgttctgctaaagggtcatagtagcaacgtgtcctttaaatttgcagctctgtcttcatgggagaagtctctctgttcagtagacactggttaatgcagaaactcatatctgaccaatacagacattatctagggagcgctcagtcgtagataggacacccatgtataacacccctttccaccggcttgactcctctaaataatcctatcagcacaaactggactaggtaggttataaaagaaatgaagttaggatgggggtagatttgggaggagttgggggtgggatggctatgataaatgttatgtgcaggtatgaaatatatatactaaaagtgaaagccaaaccttaaagccttctcctgtgacagattccagcaaggagctacctccaaaaggttacataacctccccaaagagtgacaccagctggggaccaaatgttcaaacacacgagcctatgggagaaatttcatgtccaaaacacaacagctttattttctaaaaatgcacattggtataagaatggtaagagaacacttaaatactccctccctcagacacccgttcaagacagtcatgttcccaatgtcttctagggaaagctttcaatctaggattggggatcatttaattatgccttttgatttattctgggaattcttttttctcgattttcacaactgtcatttctgagatttcctaagtgaggttcactggagctgacgactcgtggggggaaagtggaagctgtcaaatgcgggagaaagtctgtagttggaaaagtaggttgtcaattaggtggcccgtgtaggctgtagaggcgtgcagggcatgggtgggcatccgagaggagaaagagtttacctgccttcttttatcaaacacttaggttgagtcggctggtttcacgttcctctccttgtgggttgtcctggcgtgacttttgaaatgccaccctagaccatcagcacgtttttatgcctcaggtttgaaagtgtcttctggggttcaagtttgaatatgaatccactaaaaatactctcagaagtcccaaggctttcttcagagacgttagtaacaggatttttgttatctaggcatccatacccacattcatgtaacctgggaactctgctgcttttgaagatgagaaatggcttcttgctcattctacagccattagttattaggcagaggaggctcttagaaactcttgataattcagcacaattgagtcctcatggtggtccctgaaatagaagccgctttcatccgaaaagcatctcagaaaggttgatggtgtacacattagagatgaatccgaattgcatccaagactgggtttgctaacttatatttatgtgcttacttttttgggtcagggtctcactgtgtagccctcgctggcccagaactcactacatacaccagatggaattaacagacatccacccatttctgcctccagaatgccaggattaaaagcatgcatcaccatgcctggtccacagcttttcccccctgtctttttaaaactgtagcagtaatcagggatgtgtgggagggcacagcttaagattgcttaggattccttcctctaagtgttgaaaagttgaactagacaggtttgcctgctaactttgtagaactatcccttactgtgagctgccctgtggggagcctgttatatacacagatgtgggttaggagtccacatttattgagaacagggctagagaaccatgggtagcagctgtggggcatttatttctccacccgattttcattctctgagaaacgaaaaaacaaaacaaaaaaaccagacaacattttgtacaggaagaagtcgaggtctccagagaatcgctgatgtggtccaaatagcaaaagtggcaggggtgggatttgaactcccatcttttaactctaaaccttgagcccctatttacttatgtccttgtgtagcaggcacaggaggatggcagaattttttgttaattgatgtagcaatggactttattgaagtaacccttgccctagttttcactgtttagaataaagagctaggattagcacctgacccggcgaatcttgctgggtttcttacgtccatctcccgtttccccactgctgcagaaacaacagttgtccacacgtccacctccagctagctcagatgaccccttgctgatccattaaaccagtagtctttaacctgtgggtctcaacccctttgggaagtttggtatcaggtattttcagtacaattcgtaacagtagcaaaattacagataggaagcaatgaagtaatttttatagttgggggtcaccacagcaggagggactgtgctacagggttgaaacactagggaggttgagaaccactgctttaggctaagctaagaaaaccgacggtactagtaagatttcatcctggccagacctcatgaaggagggacaggaggagctgggcttgagtctaagggctgtggtggcttttgtctggtcttgactgattgccgggcatcctgtgtattatgactataaaagcttaaccattagtgaagatgatgctggcaaaaagaagaaaagtgctaaattcctgacctcgctccctctgtccacttttacacaaatgatcgtgagtcggtccaccattggctctggactcagaggctctttacggtgggtgagcgtaggatgctttctggaaccctttcagattcgctcttcatctctcctatctggccggctgcccaggatgaatgtggtaacacactttccccctttccagccgtggccagtgtggatccctgtggggaaatcaaagggagagacatgagttagacatttgtttctccagccgggctccctgctcaccctggctcactgtgagtctcaaagaactgtgacttcttcagtttccaacttagctcctttagccaccctgttcttttggacctaatactttcagggggtacacatgttttaatgttgcttactattctccatggtctctatgaagtcctctccattagtgagggttctctagaaaggcagaaggaagtaagaaaaggcttactaggaaacctgcctcacaaagtcagaggttgatttttaaaaaaacaaatcaatcaaccaaccaaccaaccaaccaaccaaccaaccaaccaaccaaccaaccaaccaggaactcactatgtaatcccaactggccttgaaacttgttacatagatcaggctggtcttgaactcacagagatccgcctgtttctgccttcagagtattgggatgagcatctgcctgatcgttgagctttaagatcctacttaggaccacagactggagaagcagagaagcaaggctaacaaggttgaaggccctacgaccagggctaagggtgaagctttctggtccaaggctggagggctaagacctagagttgccatgtccaagggcaaaggaagatggtgttcaacttcaggaggagaaaggggagcgacagaggagagcattcatcccccacctatgtttttgttaagctgacttaccctttttcagaaagagaaccttccttctcttctggaaatgctgccgtatttaactaaccaaccaaccaggatctttacggtgggtgagcgtaggatgctttctggaaccctttcagattcgctcttaactagcgtatttaactagcgaagtgagttagttactcctactctagtccagtagacactgcaaccagatagcatgacctcggtagacctagtaactatggttaagtaagtgggattaaaattttagacacttcattggaataaaggtgtgtaaggaaaggagaaaataatcacatagaaataagagttagaaacatttatgacatctttgaattactctcccagtggttgtagagcagctgtggaccgggtcagggttggcttggctgtcagggcaaacactggttcaagtgacgactgtggttggaaggaagatgggagcttttggtctgggaacttcaaacctcccacaggagcaattgtcacgcctcccttttccccttagcaagacatatcccagcagctgccgtcccttcagtactgggacctaaggtattactgtagataacgaaagaaggaatgctaagctttctccattctgtactgaagaaccttgggagttttgtgagcctaatgcctctactaaggaagtaacaccacagatggcccctctgacttttagtccagcaacatggctgctctggcaagggatcacatcgaaagaccttcgaggtctgtgatctggctggactacagacatgcccttagtacacacctttaattccaaagaatgaaggtaaggttggtttgtagacgaaaacagccatgtttgaaagtgctgtataattgaggggcagacaaagtgacaggtcatagaaggatttgacagaatgcgtcagagataggatatacccagctcatacaggaacagcataggagaggctacttaagagcagagagagagagagagagagggggagagagagagagaatatgtatgacagttttagagtcagattacagagagaacaaggtagacataagtgaaaaacagaaggagccagaagattagaacattgccaaagttggtttgaggccaagcagagcaattcaggcaaaagccaagagaagctggatggaatcactcagcttggaagattagattgtacagaggccggaagcttcaatgccgagacttagggatagttagaacagagaaagaaatgctccgggctcagcccaagccgtgccttcacacagcttgggcacagctctcatctcattccttgacctgaggaaataaaagtgaccattacactagtgttgtgtgtctttttgagacagagtctcatgtggctcagtctggtcttgaacttggtacgtagtagaggaggactttaaacttctgacttacacctccacttccagggtgctgggcttatagatgtgcatcatcacagtagtttatgtgccgctcgggcttggggctctgtgcatgcgaggcaagcactttgttaagacaggcaaaccctgacccttacgcttcactgtactagacacttggactctttttcccacctcagttacttcgggcttggttttacattcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtccccacccccccccaccccccccatgtagtacatttgtagtacatgagaaatttgaacaaatggttataggaaacatattcttcactcgttaattcacaatgttttttgtcttgctgtttgaaaataaattgtagatatatctacgcacacacgtatgcttccatgtttccactgaaagagtttggaggtaaagtacttttccaaaaccgcctgtagtggtttgaatgagaatggccccccttgggctcctaggtttgaatgcttggtctagttactgaagcgtttggggaaggattgggaggcatggccttgctggagataatgttactagaggtaggctttgagagttcaaaagcccaggccgatctcaatctctctgccagatgcaagccctcagcgattgttctagtggcatgcctgcctgggctagccttttcttcttttgagacatatttgttgtgcggcccggagtaacttcacattcacaagcctcctgctcagtcaaccaagtgctgagagttcaggtttgccctgctatgtctggcttcaatttatgactactttacgatgaggtatacagcttgcgagtagccaaatggaagggttggcggagcatctttgtcttccctgagggctctcgctcctgacaccatagtattcgccaacacaggtctggaagttccccccatgtagtacatttctgtggagtgccttagttctttcccctttaaggtgattagacactctggcaaaagcaacttgaggaagaaagggtttgttttaaggttacagttggcagagtgtgttcctaccatgttcaacccgcgagcttggttgcaagattacctgagcaaaccaggtggaagtcagtgaatgtggaagtctgaaatgtggccagggcagatatacaggcaggaaatgggactcctggtcccaagcgccagttggaagccttattgcaggaggtggtggcacacttgactattggcaggttccattctcctccctgtctggtgcagacgtctttgaggaagcgtctgttgaaaaaggtcttgatgatttataaaagcatcaggccgaggaactactgttgctgatcgtcaggtggactcttcagaactcgattctctatttgtgactggaaaatttggactcttcttgcttttttttttttttttttttttgtagcgccaatagatgtttaaacataggtgtggcctatgaatggctgcctaggaagccagacgtatcgtgagctatgaattaatactgtgtacagggagtttcttgatggctttggatcacacactcaagagagctccgtgcaaggaaatctggaaagttcgtgctgtgtcacacttgagacagctctaccgcagctcaaggagcacgcaagcaacagggagacggtcctgcagcaccacctggtggctaggaaggggatagaacggtgaccacactggtcaaactggtgaaatagatgatttccagtcagctcgggaccagaacaaaacacagcacagaacacaacaaatattagatgaaaaacaaataaacaaacaaacaaaaaataaag

SEQ ID NO: 1784 - DNA, 2776 bp, Mus musculus
gagcgagcgaggcagaggtttttggtcggccggagcggagcaatgcctaaatcaaaggaacttgtttcttcaagctcttcaggcagtgattcggacagcgaagttgaaaaaaagttaaagaggaaaaagcaagcggttccagagaagcccgtgaagaagcagaagcctggtgagacttctagagcactggcatcctccaagcagagcagcagcagcagagatgacaacatgttccagattggaaagatgagatatgtcagtgttcgggacttcaaaggaaaaattctaattgatattagagaatattggatggattcagaaggtgaaatgaaaccaggaagaaaaggtatttctttaaacatggaacaatggagccagctgaaggaacagatctctgatatagatgacgcagtaagaaagctgtaaaatctgagccatatcaaacctgtactgttgtagttgtctttttacattggcttttgttttctaaatgttgttttccaagctgttgtatatttggattgcagaacaatttgtaagacaaatacttttttttaatgtgcattattaaaatgttctaagtgaagctaattgtcaagtttattaaagaggattgctttgtgccccctacctagtgtgtaaaataaagtcagatcattacaatcttaactgtggtacccttttttgatcaaaaaaacctagttactgtttaaggccaaaagaacaactaggcacactgttgagtcagcttacattcagaaggatttgtattacattgagtttcttagattgctttgtgaaatgtatactcagcctttttctttccaaccagatttactgcgttttcctctccaggacttctccctaccacaataacttatcttttcttcagttctcttagtgctcaagtttaaatcactctttactcagatagattacgcttatttagaaagtcaaactgtcagttttgttgcctcctaagtctactgtgctaattactagtatctgtttggcaacatgacttatatgagaactccaagcaagtgtatgtcattattcatagtgctctgtgtagatgttgcttagtttacagaacatagtgactttgatgtctgatgagctgtcactcagtaaacatttgtgctagggtgatggttataaagtcagatattaaactagattagacttgtaaaaagtgtgaaacttactggcctactgttatattctaataatgtgtggattctatgtagtcagatgtggcactgagctcaactgtggtaggttctgtgggcagttttagagttgactgttctacagttaatctggacaagtgacttccagacttgatgttaactaggtttgatagacatttccattggttttcatttcaattgtgatgattaagcaagcagacaggcacatgttttagggacattgctccaatgaaaagggcatagtgttctgagggaaaatgtttgcaaaggaaagtcaccacactgaagggagctagcctgtgatgagaaaggaactttcttgaaactaaatgttgtgcacatgatatgttggtgataacattaagatgggtcttcgtagaataatagctaacaaggacaatttatagatgtgaaaaaatgctgccactaagggctgccatatcagaattgcactgtcatactgagtcccaccgtctaagcattttatagaactgttaaggattaaatttaaaaaacagtctgccaggcctcatgtggttaactgtcctccccacagatactctttaggtaactttttagtgtgttactccaaattgatacatatatatcaaagggtttaagatatataccatagctcattcttgagggatgatcctcttataatgtgttgcatttcattgattttataaagtattccttatttgtcatgtaaagaaaggatagttagaacataagactggtttggtgcagatgaggggagaataacaggtaaattcctgaggccatgtgttatatgtacatttcagctgtccgattgcagagatctgccgtctgctacctaggcattgctagctgcttagcataaaattccatgtggaaagctttctcgggcataatttgttaggttgatagctaaatacattcactaatgttataccagagttgttgttatttttctttgtgtgttgaaaaggaaaattgagttaaaagaagaggaaggacttttcagatggaaaagaaagggtacagtccttctattttgcgttcagatgcctttctcctcagtgtcttagtttcttttctgttgctgtggtgaagtgccctgacagaagcagccaagggagaaagggtttatcctgactcacagttccatgttccagtccgttgtcgcattgtcacagtggcaggaactccagacatctggccacatggctccatagccaggaagctgagagctgtgattgcatgctcagttcctttttgtctcattaacctgagcccaggagctggagttggccacagcaggcaagatgattctccagacatcatgcctagaggcctatcttttgggtagttctagattctgttgaactaataaccatcatagtaagttttctcccaggaagaaggcttgacattttaaggcataatatcttattttgtaacactaaaataattagatctgctgccaggttttgccctttaatatgctccatagtaaggcttccaaatgggttttcctcttagggtaaaaagcctttggccaatttccacaatcactg

SEQ ID NO: 1785 - protein, 141 aa, Mus musculus
ERARQRFLVGRSGAMPKSKELVSSSSSGSDSDSEVEKKLKRKKQAVPEKPVKKQKPGETSRALASSKQSSSSRDDNMFQIGKMRYVSVRDFKGKILIDIREYWMDSEGEMKPGRKGISLNMEQWSQLKEQISDIDDAVRKL

SEQ ID NO: 1786 - DNA, 35548 bp, Homo sapiens
aatgtagtcacaatcacaggtactggggttaggacttgggtagattttttgaggggggttacaattcaaccaactaactcaggtaactcccttcaccaatctgagtacagtttcttcctttctataatggaataaaacacctctctcccaggcttaatgtgaatacaatgagatgacatgcataagtgcccggaatataggaggtgctctgaagatgctgccaactcccccttagatttctttgttcctaaagtcaagctcagtgatcacacatagtagataagtttggcagttgattgattttctaaatcagaagtgttaatgcccagtggactttgcaccaaaggacccagagatctggctatgcattctctaagtgtcttttcacaaggcaagactctcccagtccctcttggagaatcacttttgagacacatttactagttctacctgctttctccttaaatcaccatggatagcagcatcctttctgcacatctcgggttctgcttggatttagcattaactccttgataacatgttatgaggacaaaatctctgctttctgtgtggaattgacacaaagatatttacactattgaattaaggcttctaatttggctttataggtgagctcctagtcagaatactgaagaattaataaaaattacataaatgacctaaagaaatgtgaattcatatagattgtttaaaatgggcaagttttattagaaaactatcctatttaacagcatccctggtaaataagaaaacaaacaaacaaaaatggctgggcgcagtggctcacgcctgtaatcccagcactttgggaggccaaggcgggcagatcacctgaggtcaggagttcgagaccagcctggccaacatggtgaaaccccatctctactaaaaatacaaaaaaaaaaaaaaaattagccaggcgtggtggcaggtgcctgtaatcccaggtacttgggaggctgaggcaggagaatcacttgaactggggaggcagaggttgcagtgagccaagatcacactgctgcatgcactccagcatgggcgacagagaaagactcagactaaaaaagaaaaacaaaacaaaacaaaaaaccaccaaccaaccaaccaaaccaaagcaaacaaaacaaaaaatagaagacagaaaaaagaaaactatcctccagagtaacagttcgaattcatagaggaaatatctcatttgaaaaaaaagctccaggtctttagagaaaataaattactaacctgataacatatttcagcagaatctaatgtggtagatgtctctagaagtttctttaaaggaaaatttagagcaagggctaaaacaagaaagagcagaaaactaaaccagcagggcataagaaagcagaattgttgaggaatttgcttaacaattataacagttgaagttcttttagcgaataaattaaaaactcgttggagagaaattatttaccgatttctttaccttgctactttcttctgtgtgtagatcccagtttttcttgttggatgctatgtcccggatggacttagtcagatatacttctgcaagagtttccattttcagtattgtcctattcagggatataaagtcaactatgtcctaggttctgccatgatagaatacactatttaactattgaagtctagggcttgataatctagcagaagtcaccgaggaacaagaatgtccatataaggggttactaaaaagcagaccttttaaaaaactgagataccagaatcaatacacctgtcttggtttgttaatcatagttaaaattttgaaaccaaaagcaacaagctgatctttcaaacaagaaatacattaactgaagacacaatgatgtgaaaagaccactgtgaagtaccagtggtatgaaaaactcaggatgtgattgagtagcattgtaatcttgaccccgggctgctagtttctctgacagttcagaggtgaagagtctgcataactatgctaaactgtagtactctgaaggtattgccaaattaaataatttgggtttctcagtgcaggtatcactctctcctgtgatctctggctaagcagggctgttggcagatcaagttcttgtttcagtcgagaccatgatggtatctgattgtctattcagtcactatacgtaacccattggctaatacatctcatgctatgcttcctgcaaggggtgtgatggtcaaccagccagcctagtgctgggccccagctaagaggtagatacttggattggatttttcaaattctttttattgactatcacaagcatagcaacatagtatgcatgttaagtattgagcactccagaaaatttaacacttaaatagactgtctttgtaacaggtaacacataacatgtgaaaccagaacacataaatgaactatcctccatagtagtcttcttgggacattacatatttgttcaaacagtgatcccacatttgcactcaacattttttcttttttgtatttgttaccagggccaattagtaatccataaaaggatatcatttttataaatttcttaattactcatattactgatcatggaacttagaaacctttttgctctttacaaatagaaattaactgcaaaagctaaagatttcttgttgctgggagcctgtaaaagactatgcctcaagctctgacagccattctcaaagaggaattctaaaagttaactttgaccaatgtcagagtcattacaatgtttttgcagcctccaagaagacgacttttgaaggagaaaacactcatttgaatgtaagttacagcatatttactagaaagtaattacactattttatagcacattaaataagtcaggtatagctagcaggaggagttgtgctattcacctactaaagacggtgtacatatatttgctattacaaaatgcgttcttctataaaaggtgacactgcatttctaatgaaagttggatctaagaatagctccagtaccaagttcagaaaagtcaccctaggggagaaatgcttagcagtttgtatttaaataacttccttaaatatattgctgttactcattgcatatgactttacacgtaattcatgtaattcatatttatttataattacttgagtgagaaggagtattaaacttttggaattacatattcttagcttttttaatgttgtactatgaaagttcatttttgacggtagataaaatacaagggtctgtagcaacttgtttggtggaagaaaattttagcgcatgggtcatagcgctgctatggggagcaagttcagtccttccttttctcctctcatccatattaaattgcccactttggtctccagatgaccagcattaccactataactgctgacagaggaatttcactctgtttgtttttgactgccattgttggctttctgatctgggattatgtctcattgaagccaagcctacataacaccaggtgaacactgttgctggtttcttcctctctgtctctaggcctaacactccagggtttagcagggcaggaaaggaagaaggaaaattatttttcccagcttcttcaaagcctgtgaagcaaggatttttttttttttaagacagagtcttgctctgtcagccaggctggagtgcagtggtgtgatctcagctcacagcaacttcaccctctctcagctcacagcaacttcaccctctgaggttcaggggattctcctgcctcagcctcccagatagctgggattacaggcatgtgccaccacacccagctaatttttgtattttttagtagagatggggttttgccgtgttggccaggctggtcttgaactcctggcctcaagtgatccacctgcctcagcctcccaaagtgctgggattacaggtgtgagccaccgagccccacccacaaggctttttatgccttaactttttctcacatcactgcatctgatggatataactcacaccctacaaagagtaggtgctccctgtgtctcctcttggggagagtgtatattgcccctgtcttagtctgctgtaatagaaataacatagactgggtggcttaaacaacacttattttattcaattgtggaggctgagaagtccaagatcaaggtgcctgcatatctggtgagggcccactttctggtttgcagatgactgccttcttgttgtatctttacatggcagagaacagagacagaataattaagctctctcttgtctcttctcataacagcatgaatctatttatgagggttccacccttatgactaagtatgccccaaagtccccacctataataccatcccactgggattaagggttcaacatatgaatctgggggaaaacacaagcattcaatccataacaaccctcttaccttgtactgtctcccttcccagttcttcagactcactaaactggaggatgcccaggtttttgttttatttgttttctcttttgcatgtatgatccacatggccccatcctaggtgttcctaaaacctctagacatccagagccaccatatcttttaatatccaaattgaatggttggtgctaccattccatgtgccgtgggacctccagaattcttaagttttcccaaaataacctggaaggagttatgttctcctagtcattcacgctgtgatctgctttcctgctttagcctggaggttaaaccagaggcggctgacctccctaggtgcccaccacatccctggcacataagcctgttcctctccctttctttcttgtttcctcttctttgtatattactggtatgtctcttgtgctacaaactcaggctctcaggaaatgtgactttcttcattttcttatgattgtgtttaatgatcaccatttcacctagtggtaaaagcttaattgtggccaatttcaggtcaaactcataatttctccctttccccctttctctcctaaattctggacagaggtggggtaggattacatggtgtcagagcactaagggtagtggtagagtctggcccattttccccatctgtccatgacagccgcattagtctgttctcgcattgctataaagatttacctgagactgggcaacttataaagaaaagaggtttaattagttcatggttccacaggctgtgcaggaagcatggctggagaggcctcaggaaacttacaatcatggttgaaggagaaggggaagcaggcacatcctacattgctggagcaggaggaagagagacaagggggaggagctacacactgtttttttttttcgtttgttttgttttttagatggagtctcgctctgtcgccaggctggagtgcagtggcatgatctcggctcactgcaacctccgactccctggttcaagtgattctcctgcctcagcctcccaagtagctgggattacaggcatgtgccaccattcccagctaatttttgtagttttagtagagacagggtttcaccatgttggcaagaatggtctcgatctcctgacctcatgatccaccctccttagcctcccaaagtgttgggattacaggcatgagccactgtgcccggccggtgctacacacttctaaacaaccagatctcgtgagaattcactcactatcacgagaacagcaagagggagatctgcccccaggatccaatcacttcccaccagccccctcctccaacattggggattacaactcaacatgagatttgggcagggacacagatggagaccgtatcattggcctttgcttaacagttcatcttgtctgattcttgatccttctcacttcttcacactggtatttgttgagatgtcctttgttacagcactctatgcaagttgagggtggtgagatttcctcttcctcactgcaagtcctccccaggtctgctggctgtcactgacacatctgtgccactcttggccaaagagaaagacattcccctgaatgctgcagtaccctggggcatctctgaactcggtgaggaagcctgaggtcggccatcctgacacaccacacagatatctctaccccaactctgtggtggagggaggggcgcttgggttgcagaggagctcggagagctcggctgcctggaaagcaaggcaccagtttgctttgctctctcagatccctaagccctctgggaatttgatgcttccttccttccccagggctggtgtggggacagacagcagaactacttctctactccttagacactgaagaggggcctcatctcctttctcttctgactcctccctttcacagttgcaataatctctacaggcgagtggggtgggctaaaaggaactatttttgtttgtttgtttttgagacagggtctcaaaaacacccaggctgtcacccaggctggaatgaatgcagtggcgcactcatggctcactgcagcctcgacctctcaggctcaagcaatcctcctgcctcagcctcctgagtagctgagactacaggaacttaccactacacccagctgatttttttctttttctttttctttttctttttttttttttgagatggagtctgtctctgtcaccaggctggagtgcggtggcatgatcttgactcactgcaacctctgcctcctgggttcaagcgattctcctgcctcagcctcctgagtagctgggactacaggcacgcaccatcacgcccagctaatttttgtatttttagtagagacggggtttcaccatgttggccaggatggtctcgatctcctgacctcgtgatccacccacctggacctcccaaagtgctgggattacaggcgtgagccgctgtgcctggcccatttttttgtattttttgtagagacagggtctcactatgttgtccaggctggtctgcaactcctgggctccagtgatccacccacctcggcctcccaaattgctgggattacaggcaggatccacagcacccagccagaaaaaaactttaatagcacattaccttaaatctgtaatttatgcctggaatcctaatagtttaaaaaagtcaaaagccaagaatctggtctgtgtgttctggtctaacatccttcttctagtcaaatgctgtagctgagaaaacgggggatggggaaagagtgaaggtcagaaagcaggaagtgctagtaacaaaagccacattgggtaagatttcaaaataatatcctgatacttgaataagcctttttcggaagctttgaaagaagtgagtaacggagggtgtcgacagcataaggccttggagggaaccgcattaacagtcccgtgccatactccaggcctccaggaacttcttcctggcagtctcctcctcaagctctgtccctttcatagtttgtgagctatttcccttctcagccctacttcccagtctacctccctttctgggacacctacagattctccaaattcagcacattcctttttgtgccaccctcttcttccagaccaaggcttggagtggaaagtgggagttctttcacttttaaagatgccctctaggaatttgcctataaaaggagctattccccaccccacaatgtacaaatgcatgtgaattacacctccttcccattctattatttgaaagcaactgctgtctttttttttttttttttgagacggagtttcgctcttgttgcctaggctggagtgcaatgggtgtgatctaggctcagtgcagcctcagctcactgcaacctctgcctcctgggttcaagcgattctccttgcctcagtctcccgagtagctgacattacaggtgcccgctaccacgcccggctaattttttgtatttttagtagagacggggtttcatcaggtttgcaggctggtctcaaacccctaacctcaggtgatccacccgcctcagcctcccaaaatgctgggattacaggcataagccaccacgcctggcccctattttgtttaaaataaaaaagtttccttcctctttcatctatgtaaaaaattatttttgtttattttcttgagttatgtttaccttttaaaaatgggcaacgcttaggatcaaggattttcgattagttttacaaagtaccacacccaggaaaattgagccaacaaatttgcatgcaaagtttcaggtctccctacttctaaaaatgcatacctccttaacagctctccacctccgacgcttagagaaccgaaacccaaacctacagcaggcacactgcccaggttccctcagtgacacagaaactgaatgaaaacttgttaaagcaggaagggttgcagatggaggggataccatattagtttaagtgtacgtggtttaccttgaatattaagcatttctttagctaggtgtggagctgcgcagtgtcccatgacaatgcataatgtcagtgtttcttttctttttttttttgagacggagtttcactctgtcatccaggctggagtgcagtagtacaatttcagctcactgcaacctccacttcccaggttcatatgattctcctgtcttaccctcctgagtagctgggcacacgccaccacgcccgcctaatttttgtgtttttagtagagacggggtttcaccatatttgtcaggctggtctcgaactcctgacctcaggcgatccacccgcctcggcctcccaaagtgctcggattacaggggtgagccaccgcgcctgatgtcagtgtttattttcatggcttcttttatttcattatgatggagagtttcacaacaaactaagggattagtttgtatttttgtcagcatttaatcctttaaaagtcaggtaattctagaaagggacgtgtgggggatgctttcacgtttagtgttcagactttgattccatccgctgtgttctttgcgtctcaaccccattacacattccgctcccagctttaatgtttgcagggaatatataactctcttctcctataagggtgggatgggtgggaaccacaggtctaactgctccatatgtagatccaaacactcctccctttctgcaacccactgcccttccttagcctctgtggcatctccgatgtgcaattctgagcttcgacaggattccatcctctactttgtaaaatcccataccattcctctacctgaggcaggaaaatagggtctggagggagagaacataaggacaattcacgcttcagctgtaacaggaaatatcctctccatagggcgttaactttggtttcctcgtctataaaatggagagaacagtcatttctgctttggaacatgcttgttaggatgagtaatgtaaattgcctcctgcagcgtctgacacgtagtgggtgcttgataaatctttgttaatagatatgcctttatattgattcttagctgtaggaagtattcattcaaatacatattcaaataatcttttagctatattcctgcttgtatatggattcctcttgccttctgtgaactcccttacatctccaggacttcaatacaggaataaggagtactccaaagatttcttgcactttctggaattaaacgctgtgactttagcttccttcctttggattttaggaggcagaggcatgtattgaggtgggtgaagtggggtaggaagaccatttctgggaaaatgggccagagtattgatctttttcattatgaccccttcgcttcattagagtaaacatttattgaacaaacgcaaagcttggcgcttgtcactcatgttttattggcgttttccttttttttaatttttttttaagctatctcctacaggaaggatattagctctttcattctctcaagggtcagatgtaatcttccaacatctgactttcgcgtcacccatttaggaagagacgcggtccctttaaggccctggaaagggtctaagtgttggtttctgtggggaggccacgccccatcacgtgaccgcagccccagcgcggcggggccggcgtctcctggctgccgtcacttccggttctctgtcagtcgcgagcgaacgaccaagagggtgttcgactgctagagccgagcgaagcgtgagtgcgcgggaccccctacccctactcctcggggcccccaccctcccagccgggccgtgagctgccttcggccctccactcctctcgccggcaatggccgcgggaaatggcggctctgccttacctcccccttcccctcggcgtccccggcccccttctccgtttctgactccacgcctgacgcgctgtgggcccttccgcggtagactcctgtccccggggagccgagtcgaggcggcgggcgctgcggcccggggcggtagattgagggcggccggggagtgaggagtcgcggggagagagtcgcggcgtccccgggacaatgcggcggcggcctgcctaggtggggcgcgtgcggttacctactcttcccccgcccctcgccctgagcggggcgctctggagactgggagagcggatgcgggcgggagggggccgggggaagaacggctgatgtgcagggggagggaacgcttcgagagaagaaaatggcgcttggtgcaaatcccgccccttcccacgccgtcttctccgcacttcgccgcctcccacgccccctccgaccaacctgtctcccctcgcccgagcggctgctagccacggggttctagcggcttgctggggccgcgcgaccccttccctggtcttgtgcttgtcaccttcctgttataccgaagtcgtgtgcccttcagtcctggttcattttcacctcgtttttttctgatctttccctcaatcagcaaaggctgaagatttcgtttctctttttaaagttgcgttttgtataaattctacaatagtggtttcagtatcagttacttgaattacaagctgcttctccccccacccccacattggaacaggctcattaaggtaaatatatatttgttaaaagtttagaggctggttttagttaccgttacctttcttctccagtggacttctttgggttgagtaccaggtggttctttgaaaaattcttaggcccccaggcagtttttgataacagacggtagttatgatcgacagtttcaaagtgaaaaattatgttcaatttaattacctttttaaaaaatatctttttgtcgtattaattagcataaaaaacttaactaaattgattttagagatgaggttgcaaaatggagcagaaacaggaaaaacggataaaacgtggtcatgaacattgcttttcccttctgaatttacccttgaagacattaccagttaaaatcagattgagctttttgaatttaatggctaggattggggtggcccacttctttttccttgacctcctattttggaacatatgcaatgtcagtgctaatgcaagtttcatctagagagctagattatttatgatttttttttaaggaggaattttaagtctttttttcttgtattaaacaaatacagtgtgtgatgtgtttattaggccctttaacgcatacagaaattagctaatttatgcctagtgttccattattggaacgctaagcatgtgggagttatttatgtgctactgctcaagatcatcgccaaggtctgcttgcataaattcaaaaaattgcaacctctggcataaatgggttaataggacctaatctcttctgagatggggagagcaaaagatattttgataatcagcgttttatgacctggtgttataagtgccttgaatagaggtatccacgtatcttggaattccttgaaatttggggcttaggcttactgatagtttgctttctgcaaacttgcactcaggcactcagtaaacacccacttgtaagcaaggcactaagttatctatgtctctggggggacctgggaagttaccagcatggtaggaatttgcgggaaggttttgcacctcccataaataggttttgcacctcccataaataggttcttcaaattttaattatgttccagagtagaaaaatctgtgtaaaatgtaatgaattgctgtgaattgtgtaagatttttttttttttttgagatggagtcttgctttgttgcccaggccggagtgcaatgatgtgaccttgtgtcactgcaacctctgcctccggtgttgaagcgattctcctgcctcagtctcccgaattgctgggactacaggtgtgccaccgtgccctgttaatttttgtatttttagtggagatagggtttcaccatgttggccaggctggtctcgaactcctgacctcaggtgatccgcctgctttggcctcctaaagttttgggattacaggcgtgaaccatcgttcccggcctgaattgcgtataattttgtgtactcttgaattagtacctgtcgttattttggtgatacggccaaaaagtcaaaatatgaataaaatattatgtaaaaattaattagatgtcacatttgcatagtacagctagttccctgttgtgtaaatgttggggtcagttccccatagtgaataattttacgttagttccaatctcgttgatgagaagtctaaagcagtaatagtagaattacatttcttctggttttaatagtaattgttgtctgctgccttcttgcagtttaccctacccatagtgtgtaatgccattaaaacgaagtatagaaagatccattggcctggagaaaggttagaggtgtaggagtgtatgacatttagttcattgttcttactgggttcagcacattgcaccctgcgtgttatttgcaacttaaaagggtatagattaaaacttgtgctcagtgtaacaactcagtaccacaaaaatggtagaatgaaccgtggaacttgtccttgatttttttctttgattgggggagagctaagttgaaagtagtagagtaccttattaattatttttgtaatgtatttttctttcaggatgcctaaatcaaaggaacttgtttcttcaagctcttctggcagtgattctgacagtgaggttgacaaaaaggtgactactgctgcaccaagtcattttggtgatactcaacaatattgtccatatcccattctgaaggatagtaaaaggtgtattaacatcttaaaatgaggatctagctgggcgcggtggctcatgcctgttatcctacttctttgggaggccgaggtggcaggattgcttgaggccaagagttcaagaccaaccaggctaacatagcaagaacctgtctctttaaaaaaataaataaataaaaaataaaaaataagaatgtgaatgggtatttctggaggtacggttggtctctggaccacttgactagaagtgcctaggatgctttttgcacattcatactcataggccctaaatcagacttaacaagtcttctgttgagcatcattaggaaccctaaagttgcagaaacactgccttgcatcctagggtcatagaattctaagtaggccaaagtcactatttgccgttatttagaaatttaccagatttttttttgtaaaatgttaatttttttttttaaagacagggtcttactctcttgccgaggctggagtgtggtggcaccatcatggctcactgcagcctcgacctcctggtctcaagcagtcctcccacctctgcctccagagtagctgggactacaggcatcatgcctggttaattaaaaaaaaaatgtttttgtagggaccaggtattgctgtgttgctaaggctggtctcaaactcctggcctcaggcaattcttctgcctcagactcccaaagtgctgggattacaggtgtgagccatcatgagtggccataaaatgttaattttgacagttctcttagttactggtgtttattctgcacataaggttttctgaattttagacttggtacatttttaagtttgtactaagtttgtgctctggtcccttccatttaattaaatcagcacgcagtaaagctaacttgaaacccattgacaagataggctttttctgcattagatgacagctgcaccgtaattggtgaatttcgctaaattgagcatctcagtggagcataactgagcgtctcactctgcggtcaagtcttccgtgcagaattgtcttttatcgcatagaactttacatatctgaagagatatttatatcctagaaatagaataagttggtcgtgtttttcctaattagtatatatcctttgtaaaatagtaagtaatgactagcactggtagacctgtgatttccgaaagtttattcaaaagaagcaggctccctatcttttttttttcctcctgaagcttagcaattttagctaaaagaaaaggggagagcgtatgggagattggagaagttgcaaccttaaagtataaatatagaatataacaacacatggaagggtaaaataaggcttcaaagactatacttgagtaaatttcttaattttaaaatttgcaccctatatagtatttgagtatgttgatgtaacacatgtgtattgagcttttatttgccagacatgcactattccacagggaatacttagagcctgatttatagaataattgctttctgcatattgagctaactttttgtttgtcccaaatagtaatattactcttgtaaacacttaaccttgtataccacatttttcatttcatgttttacatgtatataatatttttcctagcttcatctaatttggtaacattcaattaatttagtaacattaaaatatttatactattccatcaagaaggaacatgactgccctcttctgtttgggttgggtattgtagtggtttttatgggttagctctttttgagaatgcgactttctaataagcttttaaaataatgctgtttttaaaacaacgttgtgatttttgaaagctagtctaacacatagctgtctacaatgattttttttttttttgtaatgaggaagttcttgagttgctggctgtcagtgcccagtgcaaaatagctctctaaagatttgcctaattgtaaattcctttttttttaattttttattttgagatgaagttttgcttttgttgcccaggctggagtgtaatggcgcgatctcggctcactgcaaccttcgcgtcccgggttcaagcgattctcctgcctcagccttccgagtagctgggattacaggcgtgtgccaccacgcctggctaattttttttttttttttttttttttgagatggagtatcgctctgttgcccaggctggagtgcaatggcacgatctcggctcactgcaacctcagcctcctggattcaagcagttctctgcctcagcctccctagtagctgggattataggtgcccaccaccacgcctggctaactttttttgtatttttagtggagatggggtttcaccatgtggccaggctggtctcgaactcctgacctcaagtgatcctcccgcctcggactcccaaagtgctgggattacaggtgtgagctaccgcgcccggcccataaattccttaagccagcataaattccttttggaataggcaggacataaataaacatatcctggaaatggaataagttggttatattctttttaattagtatatctgcttcgtaaaataagtaactgactagccttagtagactgtggtttccaggtttattcagaagtagcaagatccctccatttttttttctaccaaagaaatcgtatgtgggatcccaaaccacaaaataaccgttcctgtggttaatactactataatgcctgaagtgtcttttgggatcctgagaacagagtttgaaaacattactagacagaaggattggttagattcatagttttgttgttgagtgaaacttgcttatgtatatatttatgatattttggatgtagtcttttgattgtttaaatcttaaaaagtaatgggatcttttgacactggggtatgttttatttttatgtgtgcaaattttaaccatattcttttctagttaaagaggaaaaagcaagttgctccagaaaaacctgtaaagaaacaaaagacaggtgagacttcgagagccctgtcatcttctaaacagagcagcagcagcagagatgataacatgtttcaggtaaagttggctattttttttttttttttttttgacatggagtcatgctctgtcacccaggctggagtgcagtggcgccatctcggctcactgcaacctcagcctcctgagttcaagcagttctctgcctcagcctcccgagtagctaggattacaggcatccgccaccagacctggctaatttttgtatttttagtagagatggggtttcaccatcttggccaggctggtcttgaactcctgaccttgtgatccaactgcctcagcctccaaaagtgctgggtttacaggtgtgagccaccatgccttgccaaagttggctgtttctttagattcagaggaattattatctggcttgatctgaagaatgttaaaagtactatgatctgataattgcctaatatgtatgttacaatcttcttaactagggacatttattaaaatagaacaaactagtaaaagtattttgtacgatgctggattattgttaaagtctctaaagtctagttttgctgtatttaaaccaatgcaaatttaattgagaactgcacattttgaaagcaacttggaggaggcaggtcaagtgttgggacagtaaagtatgaatagattattatgggacaggaagcagcaatgtgacatgcctaattttggcctgatgagcaacagaaaaggggaatgggttgaatagataaagtgaaggaagttcattagagggacttgatgaaatcacctagagaggactcgtatagctttttctcttgggtttcctgtcttgttttagggagacttgacactggcatctttgtacaagaaggatttgtgaggaagggatgttggggaataaatgaatgcaggtgagattgcttaggtaattgtaggctttaatctgtatgtgaggtgataagggcttagatggtttttcctaaagaagaaattatgccaattacaagatacaggttaggaagaatggaccagaggaattaggcagtcagtgaagatgtggacttgattgtggatgtgattgaaaaaaaaaatggtgttgcttctgtagcacctgaagggcttagttgggaaatgttcatgtgggattatcagcatggttgactaaagctgcctactgaagtattaaacagaggaagaacaggaagcagatgaggggatgtcttgggttatattcagatagagaatggaaggaaaaagaggatgtaggttaagagagagggtgaaggaaaattagaagagtgcagtaatgggagcaagaaaaggatgagtgtttccaggagctataagtattagttgaaaccaaaaagttgggtggaacgagactacaattttttttttgagacagggtctctgctctgtcacccaggctggagtgcagtggtgtgatctctgctcactgcaacttccgcttcctgggctcaaatgatcctcctgcctcagcctcctgagtaactgggactacaggcaatgctccatgacgcctggcaaattttctttgttgttggtagaaacagtattgcccaggctggtcttgaactcctgagctcaagtgatgcgcccaccttggcttctgaaagtgctgggattacaggcgtgagccaccgtgactggccaagactgtagacatttatatgactagaaagtaaggctaacacatgtatattttgacctgttgataactttgaaaggtggagtgccaagattaaggtgagaatgggaaaatttaagttttttttttcctattgcttatttttgccttgttatacttctaggtaaaaaagatagacaaagtgcagatgaactatttagttcagaacacacattttagagattctgttctgttaagaggagttttgtgaaaactagatctaattttaggaattttctcaccagaaaaacggagcttcatttcttaaaccctcatctggaaagattcctaagcctcctaaggctgacattgcaccttttgaaagcctgcctctaggaggaacataggtcatcttttcttttttttttttttgagacggagtctcgctctgtcaccaggctggagtgcagtagcacgaatctcggctcactgcaacctccgcctcctgggttcaagagattctcctgcctcagtctcctgagtagctgggactacaggcatgcgccaccacccccagccaatttttgtatttttagtagagacgggatttcacctggttggccaggatggtctcgatctcttgacctcgccatctgcctgccttggcctcccaaagtgctgggattacaggtgtgagccacggcgcccagcctaggccttattttcagagtggctttcatggatctagtagtgtaggcattatgaaataatatgatacttaatttcattgccattacagcttgatgtacatcaaacatcaatacataagcagttctctaaatgtattaaagagttgtaccaaagaaaaatcaatagacttatcttttaaagtctgaagtgattggggcagaatcgtgactagagagaagatactagagatgcttacttcctggttccttcagctctgattttgaagaactttcttccatagggatgtagtctacctgaggtgacatctgtgatagtaaagagactggagaattatctcataattatttagtacctgtgtcttgaaaggtcagaatagttgaggcaggaaactttaatccatatttttcttcagagttaggcacaaagggtcagtaatactgctttagtttatttgatgatttaaggatacttgatacttttaaattatttaatttaaaatgattataactggtcattttaatctggggcaggagtccatagaattgttttttaatttgagttttcttttttgtgtttgaaggaattattcataacctttatcacaggggtccctcctgcacaggaggtgagcggtgtgtgagtgaacattgcagcccgagctctgcctcctgtcagatcagcagcggcattagattctcataggagcgcgaaccctattgtgaactgcgcatgcaagggatctaggttgtgcgttccttattccttatgagaatctaatgcctgatggtgggataatttttatcctgaaacgatcacctttccccttccctacctgctgtggaaaaattgtcttccgtgagactggtccctggtgccaaaaaggttaggaaccactgctttatcagatcttcagaggggacagggaatcaaattcgtataagaatcacagttctttatgatgtatatgctattttttgctgctaatctccagattttgtggatataaaatatattgtcatctgattttatttttttccaataaaatgtgatttcagtgatctttattttttctatctttaagtaatatatccctatactactatctcatcacttgtttaatttttgctaataagaatttgtcagttttactctttttttccccccaagggagaggcagctgttgggcagattccttttttttttaaaaaaaaaaatgtttttgaggtatagtttatgtccaataaaacgcacacatttaaaagcataccttgataggctgtggtaaatgtacacgcctttgtggccagaccattttcatcaccccaggaagttcctcttggctttacagtcattgctcatgtcctaggtaatcactgatcttatttctaccactatagatttatgttgtctcttctagaactttgtataaatggatacatgcagtctattttttgtgtctggcttttgctcagtataatgtgttgagattagttcttgttgcatatatcagtaattttattgctgagtagtattttgtatgataatactacaacttgttaatccattcaccttgggtggacattgggattgtatcaagtcttgggctattaggaatacaactgctgtgaatattcttgtacaagtcattttgtggacattttttcccttttgggtaaataccagatacatttgctgagtcgtagggtaaatgtgtaactgtataagacactgtcaaaccattttccatagtagctgtagcattttacacagccatcggtactacttaggagattccagttgctccacatcctcgctagatattgtcagtcttttaagtttttttctttttagttacattgaatgtataatggtagctcatggtggttttactttccatttccctcatgtacatgtcttaattcattgtacatctttagtgtgtttattggttatttttatatcttttgtgaagagtatcttttggccacttaaaatgccaggtcatttgagttgtaacactttatatattttgtcagatgtaagtataattaatattttttttagacttcagggaaactttagttttcaaagcaatctagttcaaaaatgagtggaggttaacagagaggaaaatatgaaaccagagagaatcaaacagacagaataaggggggactggcagttggtcaggggcgtctgtgacagatcttctctctcttggaaatgaggtcctcacggattctggtcagttcatcattttcttcacgtccacggttctgcttcttcctcaggctctcctcgaaggccaagacccctgtggctccaacttgagtgaatattttctttaggtttctggtttacctttttattttctgaagcatctttttaaaaaaggctttagtgtgattgtctattctatcgatttttctccttttttgcttaatgcttattttctgtccaagacgtattttgcctaccatggccacaaaaatttttgccagtgttttttcctagaagttttatagttttagttttcacatttaggtctataattcatgtagaattaatttctctgtgtatgatgtaagatagagatttagagtcttccccaccccaaatgcagatagcctgttgtttcaacaccatttgttgaaaagagtattcttattcctttgaattaccttggattttaccccctccccccaaaaaaatcagtgaatatatccaatgcgtgtgtattttttgactccgttgtgttccactgacctcttatgtctgtctttactccagtactgcattgtcttcccttactatattatagtgagtcttggaaagtgctaagagacactttgttgaggaaagcctgttcttttctctggaatttgtaatttgtggtaagcagatatataagatttttgaaaaataattttctgtgaatatttttaagttctcaatctgactgtgagtgaggtgcattaaagatgttatttgaagtgaacatgaaaaggaaaaacttggttgttattgactggaactctggattcgtatattcagaatggttggtgaagcagtgtagctagttgcatctgtggattcctcttggttgtagtttgtactgcaaaatattgcttcctaatgatttttttttttgctggtaaaaaccataaaagtatattcacattgttgtgaaacagattgccgaaactgtttcatcttgcaaaactgaacctctgtggccattaaacaacagttccccttctcccagccctggtaaccaccattctactttttgttcctgtgaacttgacatcatgtaagtggaatcataaagtattacctttttcctttttatgactggcttatttcattgacgtagtatgtaacaggatttccttttttaaaagctaattgatattccattgtgtgtctattccaccccccctctcccattttgtttatcagttcatctctgggtggatatttgtgttgtttccacttcttggctcttgtgaataatgctgctatgaacatgggtgtgcagatgtctcttggagtctgtgctttcaattttttgggatatatattcagaagtaggattgctggatcatatgatagtttaaacagcaatttcctttggttgcagttttgatactgagagtagtacagttgacccttgaacaatgcagggtcaaaatgcaaggcaccaacccctgtgcagttgaaaatctggttataacttttgactttgtcaaaactgctaagtatagcctactgttgactggtagccttaacagtaacataaacagttaacatatatttgtatgttatatgtattatatactgtattcttacaataaagtaagctagagaaaagaaaatattactaagaaaatcataagggagaaaaattacattttactgtactgtatggtgtttatcaataacattagtttacgttgtctgtttataagatatgtcatctgttaataaaatatgtcatctgttagaaattgtaggcaaccacagctgcagatttcagtccgtggtacatatcaagcaattcaactttttttatttttatttttatttttatttttttgcattttaaaattaaagacaggatcttgctgtgttgcccagattggattcaagctcctgggctcaagtgatcctccggcctcagcctcctgagtagctgggatcataggcatgcaccactgcttctggcagtttttttcttgtgatgtcatgccttctctctgcttcttgggagcactttcagcatcactaggggcactttgtataggactcatggtgttatttaaagtttatggtattgcagtaatcatgatgaaaaataatgtgaaaaccgtgagagatcactttttactgcaatacgcaatttgttggagacatgaactgctcagcagagatgattagcatcacatggtgttttacacaaggtgttttaagcagatacttgtaacatttgagtacactgagataacaggaagtggctatgaagttaacactagtacactactgtagttaattttatgcagttatgaattaatactccatctttgtttacatttctctctaacttcatataatagatttgtatgttttatgatagtaagtgataaaataacctcatatctaggtatgttttatgcattcatgacatacctaactttttcttaatgttttcgttatttctaggctatgcagttgttctgtgagttttttcaaattgtcaagtctgcaaaaatttttccagtatatttattgaaaaaaatatgcatataagtgggacctgcacagttcagagccatgttgttcaagggtcagcagtagtcattttcatgattagatgtagagtgagcatgcagcaagttgtgaatatgaatacaattgaaacagataccactcttgaaaggagcacctctttttatgtttgtttcttttgcagattgggaaaatgaggtacgttagtgttcgcgattttaaaggcaaagtgctaattgatattagagaatattggatggatcctgaaggtgaaatgaaaccaggaagaaaaggtgaggtctaattacttgaattttattacagtgttaggactaaacgacaacttttctgagtagcttacttgaaatgttggcaggacacacggggcaaggaagagtcttactcaattgattctctatcttctgtagttattttggacatgatacttaacatttttttaatgagatgtcttaatacagcttttgggaataaaacccagaaaagtaacacccctaatatcacttcagttggctgctaatttacttgaacaatttttaaaaaggtttatgcaattctgaagcagattaggcactatctgggaacttgtaaaatcaggaatggaaaatcttggtttacaatgcttccttttgattcagctcctaaaagctattctttagggcattactcttcaagcggatctctgctttccttccatttgtgcttcatccagtcccaagcctcttagcattgtagaaacatattttgtataattcaccaaacagctagagaaggtgagccaacctaaatttgtatatttggattgctgctctaggttgaccctcagctaaagaaaaatgcttccttatttagttttattctgcctgcctgttagtttgaaaggtaccacttgtttgcttcatgcagtttttttttttttggttaaactcagcctctatatgtgtttatatgctttcatattttcttcaagtcacttctggattggtaattcacgtaccagagtggccgatgccatatttcttgtttattcttttttttcaatttcatggccttccagcagttttctgggaatactttctgccagttcttgtttacttctctgtttatatgcgtcggtattggaatgctagaacgttaaagtacaaaatatagaaaatataaaatttctgttcatacttttacatcttaaactggaaagacatatctcacattttttaaccatttatgtgttaggtgatatgctaagttcattattcatgttacttaatcatttacaacaactctttggcgtatagatgccattttactggtgaggaaactaaggcttacaaggtgatgtagttcttttttaagggtcatacacttagtgaaagtgaggctggaattttaaccctgacagggtgaccctagagtgcagttacccgggtatactctctgaggagtcctgtatgaatcacgtcctgggaatttttccaaagtgaaatgaatgcttctggaagaactcagcacaattggcttgaattcctgtggaaattttgggcaaatattggaaccagctggaaatatagtaatggggtatcacatgccaaatctggacctgaccattttagcctgatagttgacgggtattagtaagatgtgtcttcaaacccttatttattctcattggttacaataggtactatgcaggatgcactgtggaaagtaagactggatatgagattgataatgctcagtaaattgtgatgatatgtaattaacaaatgtaagagatatgattttcagtattgtagcattgtgtccaagtggcaattttttttttttttttagatggagtcttgctctcttgcccaggctggagtgcagtggcatgatcttggctcactgtaacttccacctcccaggttcgagcaattctcctgtctcagcctcttgagtagctgggattacaggtgcccaccaccatgcccggctaatttttgtatttttagtagagatggggtttcaccatgttgggccaggctggtcttgaactcctgacctcaagtgatccacccgccttggcctcccaaagtgctgggattacaggtgtgagccaccgcgcccagcctaaagtggcaattttgataaaacagtattctagttggaagtatgaaaatcctcaacgcttaaatagattttcacctttgaatttttaaactttgttttaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgaattatatgtagccagagatgtcattaagctttactgttatagtaggtaatatggttagtttgtagggaaaagagcatatgagcacatgcttgtgtattttggcctttgccccagtagaacagaccaatggcattctagacttgatgatactaagttttagcagacactagtaagtggtttgtatttaaccatactgatgaagcagacagattgaggcacagattttagtggctttgtggcaataaatagggcatggtgtgccttaggaaaagaatgtttataaagggaattataactgaaattaaaggaggcggcagtgaagaggaaataattctcttctatctaaatgatatacatatgatattttgagatttttataacagcagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacatagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgactgctaacttcatttaaatgtgttactggatatgcagtatactgaaattattaatcagtttgtgtataggaaaagagaactgggttaaaagcaaattaacttgttctgaaaagaaagtatagattaattttgttttctgtttaaattttatctccttggtaaagatttttttttcctgggcagaaaacttggcatttttaggcgtagataccttaccttacaatgccaaaatgaatttaattccagtactcaggtttttccctttaacagactctatgtgtatcagggctttctaatgggtttttcctcttcgtttttaaaatgtgagtagcatttgaccaatttccagtgctcttagcattttacttaaagaacaaccactacaaaagaaaatctttgtaatttgattgtcttttgctttgcttcattaatgcctaagaacttaagaatactcctacctcattagctactcaagatgctgtgacgatcaaatctattctacataatgcgtttagaaacaaagacttgggtgaaaaatgaaataagtatattctgacttggctattgaggggaaaattcagtattaagtgttcctcacaggagatatgttagcagaatactataaaagtttgaaatttttaaaaagtaaaagtacttaaatttaggtatctctcctgaaattctttgcagttcattttttatggcagttaatccagtgaaacactcaaaagtttttttttttttaaaagtgtttttccagataaactgtagggtgaacattcacataatcacaaatatgtaattctgtaattgtggaatgcttgtatgctttgttttcgtacatcttccatggagatgtctgaatataatactccatctgtgaatattttaaatgttgaaataaaagtaagaaatgtgccctttgtgttatcccggtttcacaaacctgaaggtaaatgggtaatttgtctgttgaatgagttttattaatagaatgcctttctgtgtgaatgctttggaatgtggattagtcttgggtccgtcctttccatctacctgatccaaatggaaaaatgcaaacacttaggtgtacacagcctctttttttttctttctccctttaagtgctttgtagtctaatgattccttcatatacttgactggtgtcatggactcctttgaagatttcaaatttacattttcatttatgaagtccctattttgcccttggttattgtttttgtttatatgttgaggccccatttcaatttctgtttaggaatagaaagatccatggtatattcacttaactgtaaatttgcttttagtaaaacataattcagccagaagaaggaaaaaaagagtacttggagttcacacaattaatcactgacttcatagttttgtagtatggctcaaagggagttactgggataggaagggtatttgcaaagtactaataaacatttaaaaaaattatatggaattagttactatataacagttcacctaatagttgtgtccattttagtaaaagatcttgctacagcccggtgcggtggctcacacctttaatcccagcactttgggaggccaaggcggatggatcacttgaggtcaggagttcgagaccagcctggccgacatggtgaaaccccatctctactaaaatacaaaaattagctgggtatgctggtgagcacctgcaattccagctacagtggaggctgaggcaggagaattacttgcacccaggaggcagaggttgcagtgagccgagattgtgccactgtactccagcctgggcaacagagtgagactgtctcaaaaaaaacaaaaaaacaacaaaaaaagcttgctacatgaacaggacttttctttgcccacttgcttcattcacataagccccttacagagtccacaccttcccagacctgcttttatagacattttagtcctggattaatagtgacccactgcctaagtgaaatgctcctcttcactttttaggttcttgatagtttaaatggtttatccttctgctggataacttactgcatagttaggagataagatttatgccactttttaactgctcctgaatttcaactcatttcaatagttggataatgtaacctccatgggtaacaggaagactgtatatgtagttcagaaatcagctgaagttgtctatgtagtaactcacgtatcttgaaaagtgatgtgaaagttccagttttgccttcctaagtaagctaagcccaagtcttttaaaatgttatgtatttattttttgaagagacagggtctttctgtgttgcccaggctggagtgcagtggctgtttacaggtgtgatcctagcgcaccatggccttgcacttgtgggcccaggtgatcctcctgccttagccttcctagcatctgtacactgcaggtgtataccactgtgtctgccaagcccaagtcttttaatagctcctattctgaaggctttatttttcaagtatgtagttgttgcaggaatggtacagaaaactcccatgtacccctccactcagagaccccattcagattttgtgagtttcagtgtcttttagcaaaagcatgtaacacaggatcacgtgtctcatttgattctctctttacttcagtttccttcagcctgacagttccttagtttttccttgacttttacaactttgatgtttctgaagatttggtaacatgaaggccattggtggtggtgacaagggtggggagggcagaggctggttgagtgaggagtggagactgtgtgtaagttcatttgagcagcttggttgtgaaggataaagaaaaataggatggtggctgtagaagggtgtgggatccagggcagagtgtgattgaaattacagtgtgcagcatctgaaggaaggtggtaaggttcctaacttcttcggtatgaatttaagttgacctttggtgtcagcaatggtttctttcttttttttttttttttcctgagacggagtcttgctttgtttcccaggctggagtcagtggcgtgatctcggctcactgcaagctctgcctcccaggttcacgccattctcctgcctcagcctcccgagtagctgggactacaggcgcccgccaccgcgcccagctaattttttgtatttttagtagagacggggtttcaccatgttagccaggatggtcttgatctcctgacctcgtgatccgcccgccttggcctcccaaagtgctgggattaaaggcttgagccaccacacccggcgtcagcaacagtttcaaccacttcccactttttttttttttggtgactaagtgccacctgaaccatgagtacttctagtaattttaaagaaaaatatgaattactacttttttttttgttttttttttgagacggagtctcgctttgtcaccaggctggagtgcagtggcacgatctcggctcactgcatcctccacctcccaggttcaagcaattctctgcctcagcctcctgagtaggagggattacaggcgcccacaccaggcccggctaattttttgtacttttagtagagatagggtttcaccatcttggccagtctggtcttgaactcctgacctcgtaatccacccgcctcggcctcccaaagtgctgggattacaggtgtgagccacaaattacttcattttaacaggaattcgatcacttggttctcacgcccctcttctccacagccaagctctccaaattgagaccagggcctagtcaaaccttgggttttgggatctggtaccagtcatgtctagccatgagccattctcatttattgttttaaggtgcatgagatctcagttccttgttggagtcacagggcctgcgctggatggggagcctataaatgaagggaggaagtttaagacctctttaatctattggaggagcctcgggaatggctcctaggccacagggtcgcagatggaaatggcccctctaacttgaagaatgtttgcttcctatttcagtgaccttgcacttgatttttttcccccacgtattttatctttattttttttgagagtcttgctctgtcacccaggctggagtacagtggcgtgatcttggctcactgcaacctccacctcccaggttcaagcgattctcattccttagcctccctagtagctgggattacaggtgcgtgccaccacacccgactaatttttgtatttttagtagagacgggatttcactgtgtttgccaggctggtcttgaacttcgggcttcaagcaatctgcccgctttggcctcccaaagtgctgggattacaggcatgagccactgtgcctggcccccaacgtattttattctgaaaaatttcaaacccagagaaaagttgaatcaatagtataaggaacactcatatccttcacctattattttgcaaccttctgtctctttttgctgaactgtttggaagtaaattgtagaaagttaacgtacgcatatgctgagctatttttacttctgagccaagtgtgtgtgttttttccatcaccacttctcttactccatttgggtgtcctacaatttaattctgataccatctacgtggagttagtgtgtcagatcccacaagttaagggctcagtcccacaagaaggcccccacttcagatgccagccgtaagtccatggttgtcactggtacttgtgaccagtaaattcagagggtttccacaatccccttctcacatttgataattgactggaaccattcacacaactcaggaaagcactttattcacaattacaggtttattataaaggataaaactcaggaacagccaaatgggagagatgcccagggcaaggtatggggaagggagatggagctctgtgccttctctgggagcaccactctcccagcaccttactatgtcaccaacttaagtctctgagccccatcatttagggtgtttttatagagattccattacacgtgattgattaaatttttagccattggtgattaacagtcctcacttcctcacccatccccagaggttgggaggtggagctgaaaattctaagcttctaatcaaagtttcatctttctagcaaccagtccccatcctgaagctgtctaggggccctgccaagagtccctcatttgaacaaaagatcctactatcacttttaactcaagaaattaggttttaggagctctgtgccaggaaccagggacaaagaccaagtatctctgatgccacttaggcatacatgtttacacacatacatacatgtgtatacatctatacaattttttggatgaatatttgaaagtaaactgcaggcatatttcattttaagtacttcaatatgtatttcctaggaatggaaagatactttaacatttttttaatggaaaataatcatattttgcaaaacaaaattatgagtgacattattttacattttaccaatctctttaatagaacatggctggattctcctgtttgcttctgcagataatcttttgtttgggttgaggtatgtgaagaaaatgtggcctcacagagatgtgtagttggaaaagggaggaatactttattattttttttttctgagacagtttcgcttttgttgcccaggcaccatctgggctcactgcaacctccacctcccgggttcaagcgattctcatacctcagcctgcaaagtaggtgagattacaggcgtatggcaccatgcccggctaatttttgtatttttagtagagacagggtttcaccatgttggctagactgatctcgaattcctgagcttaagtgatctgcctgcctcagccactcaaagtgctgggattacaggcatgagccactgtgcctggcacaggaatactttaatagcctttccaggtaattgtgggtatcctttgataacaaccacaaaatttgacaagtggtagtttcttaaaagttgtagtatgtaatttccccttgaaaacttgaatttcatcattgacaacacatgctgtcagttgtttttttttgaagtgataggctcagtttgtttgtttctgagaaattgtctgccaaatccacaggtctgaacaacgacaatttgtcaatcttggaagttaaaatggtgctccgtgcaaagtgccgctagttcagttcacactccaaacagttctgccggtgcttttccttgagactgccttggaacctcaatgtgcatttcccaagagtaaagacattcttctacctagcctcaatattatcacaacttaaaacatcaataattttatcaactattcagtccgtagtaagtttccccagttcccaaaaatgttcatttcttctcccaatgcagtgtcttgatgaaaattcatgctgttcatttggttatcagtctcttttaatctagaattattccctactattttgttttccacgacattgaccttttgtaagagtccaggccacttgtagtatgtcccatattctagatttgtctgtttcctcatggctcagttcaggttaaatgtcttttgcaagaatgctacataggagatgctgtacctaccgcaccacaccagaaggtacatcaggccaggttgtttcacaactggtcatgtgaattttgatcactaagttatttaaaatggtgattgcccgttctttttttttttttttttttttttttgagacagagtcttgctctgtctcccaggctggagtgcggtggtgcgatctcggctcactgcaagctccgcctcctgggttcacgccattctcctgcctcagcctcctgagtagctgggactacaggcgcccaccaccacacccggctactttttttgtatttttagtagagacggggtttcaccatgttagccaggatggtcttgatctcctgacctcgtgatccgcccacctcggcctcccaaagtgctgggattacaggtgtgagccaccgtgcccggccttgcccgttctattttattttatttattatcattattttgtgagacagagtttcactctgtcacccaggctgaagtgcagtattgtgatctcggctaactgtaccgtctgcctcctgggttcaagtgattcatgtgcctcagcctcccgagtagctgggatgacaggcgtgcactaccatgcttggctaaattttggcatttttagtagagatggggttttgccatgttgaccaggctggtcttgaactcctggcctcaagtgatccacctgcctcggcctgccgaagtgctgggattacaggcgtgagctactgtgcccccggccacaaataaaaattttttactctcaaggagcattcagtctatttcattctttgaaaagcatgtaagttttgggagcctagcatggaagggagtgatggttccagtgcgttggtagtggagactgccttttggtcatcttgggcttctcatgccattgaattagtagggaaataaggaggtgattgtggtgtttgagttcattgatcttgattgtctgagggaaattggactgtttgttcctacacagtggtggcaaggagagtgatgtttggaaaccagggggtttactggtgactgtgctcccttaaccagttgtcttgaaggaaaaacttcaacccgtaaatagaagacctccaaagactcactgtaagaatgaaggttttgtacttttcatctggtaaagaaccctggcccagcaaaggtgctggaggaggctaactggaactcggaatgggcagagggcaaaggcagctaagatgaccaatacagacctcacagaagtcaggattgtcacaacagtgttttatgtcatttaagtgtttctcctctcttttctctgaaataagttaaatgaataacaccaatgctggctaaagttttagg

SEQ ID NO: 1787 - DNA, 466 bp, Homo sapiens
cgtctcctggctgccgtcacttccggttctctgtcagtcgcgagcgaacgaccaagagggtgttcgactgctagagccgagcatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaa

SEQ ID NO: 1788 - protein, 127 aa, Homo sapiens
MPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 1789 - DNA, 80077 bp, Mus musculus
  misc_feature (1)...(80077): n = A,T,C or G
gttgatgagtccctagtgaggaagccacagctgttgctttgttaaacagatatgaagtgcctatcaaattggtttctgaacaattgtgttcatccctgtagatgggtgtggttgtcagagaagtttccttttccagttgggcgttagtaattgaagagacccataacaagtcaaagtgctaagaacaagtggttgttgaatactcagccatatatgaggcatccagaccgtcccctccaaatccccttcaaggcccagggagtatcatggaagaaaaggtagaagtaatgcaaagagccaaaggacggggcggaatgttgtgccattaattcaggtgtcttctgggcttgatgtggcctctgcactcttgacttcacaatggctgtgatgacctacacaagacccactcaagattaggcccgtcaacattccatcatagagctggaggaggctttgagatcctctctgaggattcattcttccctgaggatttataaacaattaacaatacacgggggtggggaggagacctttctttttagtggtgtagccactggttggacacccatgctctggtacataacctgtactggacttctgtaatcaatcttcgtaaaacttacaggttcatgacatgaaagacttgagaacagaaaggagactggttagaaagagaaaggtgattagcaggagtaggagggagacaagagagtttaattggcccatgtggtagttggggttggggtcatcagggaagtttctgacagcaggtgctgttaatatgggtgtcaactgccagagaatggactagtaacttgtggtggaatgttatatattatgcatgtcgagatgtagattttatgtataacatcagtgtggagatgtagccacattccctgtgaaaatgagaaatattacaatataatttccatattagaatggcacatgtacaagaagtataccctctcgagacactgatttatttgtggaatgtgttaagcatacttaaaggggaggatatgaaaagaatgaagggcaatgaagagaagaagtcaaattaaggcaagaactttgaactgtgctgcttgagtccgatggtaattgagggtgtggttaattaaaaagttcatgtgtgaaattcaagaaaagccccagagggttctctagagtgtgggtggtttgtgactgtttgcgatttgaggcgctgcgtgcacccacatttacccgattacgaggagcttgtcagacttcaagataaccaagagtgtgcaaggccacgggattcatgtcaaaactgaagagaaagcatgacaactggatgaagcaattctctccagcaacttgagggcgaaatttgatgtcacaacatgattaccaaaaatatgagagggcaaatgtcaagaatttttcctgatgttttcctcatggcgtcctgttctattttagtctcctgtatcagctatccatgttataatgccaagtggaatgtactgccggaaagaaagaaagaaagaaaaaaccatctgatgacattacacattataataacagatactttccatatcgcctttaattcctgctcagagcatgataaaagatagtgcataggttaaataatacacttactaattttttcttattagtagagattgagcactaagtctgaacaatgatatgctggtagatcaacacagtacaacacttaaagctagggtctagacctcttacatctgaaacctaacaggatactgtttaaatgttttgaaaaatatgatcttagaagtctatgggtttgtgttatatgagctaaaatgtctcaaaattatcttcttttcattgactcatcatttctctccaaaaatctgctgcattcttcagatttatcattgttaaaataaaaattaaagtgcctccaaattattgttgagtgagacatggtgaagggctgaagaaaaaaattccccatccctatagagtttatattttattggcttattcctagttatttttgagtataaaatatttaatatgatacagtaatatcataaaagtgatttttataatgtatgtttgaaattttggaaatttttgtcctgatattcttcatttgaaccttaagctatttgactgttgtaacatgactgcttatcacacagatttaaatataacctgggtcaaataatatctccaatcaaaagaaaaaatatctgaaataatagagtagagctagagaatatttaaaaattgacaatctttattttttaacaatagtttttttatttttgaaattataataattatattatttctactcttccctttccttttcccaacctctcccatctatcttatctctcttgttgtctctcaaattcatggccttttcttcagatatttacacacacacacacacacacacacacacacacacacacactctgagtgcatatacatcactatagcctgcccagtctgtataatgttacttgtatggatgcatacattctacgtcttggtgtgggacagcaagttacaggactcttttctggggaagactgtttttcccactctcaacattctttagttacctggaattcttagtctagggttctttgcatttttgatgggctatggttttctgtgatgatcttcatctgttgcatatagaagtttctttgatgacaggtgagagttacatttacccatgagcataaggatagatatttaagatgaagttaaagattatgttggctaagtaaagtgatagttgtaggttctctttcagggtccatgagttttctagcccggatagttggctaggtttgcagaatcagacatgatttccctcttgtcgagtgggccttcagtacagctagaaagctattggatactactaagatgtgagtgccactattacagccttggtgttcttacactatgctggtaattattgtggttcataggcatatatgccttttttttctttctttctcgagacagggtttctctgtatagccctggctgtcctggaattcactttgtagaccaggctggtctcaaactcagaaatctgcctgcctctgcctcccgagtgctgggattaaaggcgtgtgccaccacacccagctcataggcatattttttaatctattttttgagaattttcacacatgagcattgtatttatatcctttccacccacccaactcccccatgtccacttccactcctcagatcattgaccttatgctctttaattattactctctctctctctctctctcacacctctctctctctctctctctctctctctctctctctctctctctctctctctcacacacacacacacacacacacacacacacacacacacacacgtcagtttatttaggttcatcagagttcatttacttagtgctgcttgtgttctatctgtttaggcctggcatcttgggattgggttacctattgggggtcttatccctggagaagactaagccttcttctcttagaggccattaactgcctataaatttttaatctaggagtgggtttatgtgagcttttccccatgacaactggtatttagggcaccaagctagatgttcttattcaataaaacagacaccttttaagcatctaaattgtttgcatcttgttcaatctgcttcctgcactctttctcatcctcagcaccacggtctggtacccttttctcccctgttcattacttctccaacagttcctgctttctctagtttttggtctgtatttctgaggagtgctgtatcagctgcatggtggacgggcaaatgaacttctgtagaaggactcctattgatcaaagctcttgtcaagcttaacagaaaatatctggtggaaatctgggaccaatatcaaagtgatattgccaaacagttccatccattataaattaggttatttgtagcagtaggttattttaaacaagttgcacaagggctaagtattttggagttttgaactgatttcttccttctttgcaaatcactaactcaaaatctatggtctgtagaactttaaaaactaggcattaaatcaaacccatgacaataatgaccattaaataattttcaagcggacatcaagacgttagcttctactttcccccaatctcatttatacattagattaaaatctagatttaagagatagaaaattgctatgtgtagtggttacatatatgatctcagatcttagtaagcagaagcaggagaatcaggaattcaagcctagcctgggctacataagatactgtctcaagaaacaagcaaacaaaacaaacaaacaaacaagcaagcaagcaagcaagcaagcaaataagaaaaccgaaggtttaatctattggatgacaacttacatgtctgcttgtgaaatttctaagtgcatgctaactactctggaggataaaacctaacttacacccaaattaaaaaagaaaggtaggtagcaatacagcttagtgtgatcgcagactcgaggagtgctgtggtactcagacggaagagcgagcatctctgaggactagggccaagtctaaaggccaaaggagaaggagatcctcagacagcaaaacctaatagaggagttatccatgtgcctaaaattccattgtatatatttatgcactttctcagattcttttccaaagaaaggatacagctaaaagaaaaagagaagaaaaaaaaaaacccaaatataatcagtattgctatatgtgaatttaaagcacatatagttttcaactttttaaaatttacaaagtgtgtgaatacatgtgtgtgtgtgtgtgtgtgaatacatgtgtgtgtgtaatatgtgtggaggtcacggggaggcttaggacagttcactccttccttctgccatatgcatctgaagggattgaactcaggccaccgggcttgattgcaggtacctttatatgtgtgctgagccatctccctggcccgcagagttctttttactccattagacatgttgtctataaactaacaacactatattatatgcatttcttatgtctgtactcaggccaagtcttagatgggcaatatggctttcagaaatctttctaatgtcacatgcctcagaacatcttcagagaatcgaaaacactattgtagtagatgaaaagctctgtgctttcaagagaagcccttgaaggctacatgtaactatagcttctaattaaattgagtcacacatttaaataaaaatacatacttactattatttgtaatattggctaaaaaaatcacagatttgtataatagaagaagtggggccaattaatagagtcctcccaaggagagcggagacctagaggcaaattctaatctaattttttggtgtctactgatttttctctcgtttcttcaatagcgttctctaaaacattaactgtatgtttagaaatggaagtctcagtactcattgaacttcagaaagggtttttggatatgtgtcagggcctttcatcttttctgcctctagggggaagtgtgttttcaacaattctgtcgtgcagaagggattttcttgtgcattaaggcttcactgtggtagtcttcagtgtgacctcgggattggctggacaagatggaaggaccttggaaaatctgcaaggaccctcacttcacgagtttcaggccagggttctgaggcagggggattgtggagaaaaatgccccagacattttaaaagtacatttcaaagaatcattctttgaaatgacacataacttctccatactgtggggctgtggccaaaaaaaatacctggacacaaaactcactgacagaactagaaacaaaatagttcttggatattgatgaaaacatttctaaatcttttaaaacgtctatgagtttctgtaatatcgcatttaacattaatatgtttaggctttcagctagctaattttattcctttgttttctttgacaatcgaagttgataactgaattctgaatgtgaaaaacatggcccttccccaatttcagtgattaggtttttgtttttttgtttggagttgaaaggaacagtatgtaaaacctgaacgcaagactgtttctacttatcccttttctttcctattttactaacatttatgataaaaaatgttacaaaagttatctttatcaagtggtgttcagttttactgttctggaaagcctaaaaacatattgctaagatattataagatggtgcgtgccagtgtttgtgtgtgtgtgtgtgttacattgcattgaatttatcttagccaagtaactcccatctccagctttcttttttaccttttattggtgatgggaccttgtaaaattaaatcacccaggctggccttgtgttattctgcagcccaggcagcctttgatatcctcctgagtagtttgtgtcaccaggcccagttaaaaatgtgatacacagaatatgattgacagtgacaatctgcttggttaccaaccctattttacatagtattgtaggtgacctttaccaacagtaaatatcctcaggagacaaagagctgtttaaatgcaacttgtaggggctggtgagatggctcagtgggtaagggcactgactgttcttccaaaggctctgagttcaaatcccatggtggctcacagccatccataatgacatctgacaccctcttctggtgtgtctgaagtcagctacagtgaacttataataaataacttaataaataaatcttaaaaaaaataaatgtaacttgtacattctttgggtcacagttcatttttttctggactaagatggcagaactatgtgatagttatacatggtagttttagctggttgcccaaagaactctgatggaaagtaaacagatcctcctaacacccagaataagtaaacacaaacctcccaagagcacaatagacttgttactgttaataatcttgcactgttggcactggaagaccttttaaaaaaaatctcagcatctgttcagttggaatctgcaaggatgtgttgaacatgcacgcggacagcaaccctgtgttcccctcccctctgtttctggactgatccaccatttcctgttgtctgtgctctttaacaacaggctggaagctgagtgcttctacccaaaggccacagggaggccagggtgctagccataacgtaagtgcactgccctgctgttgacccaagagcgaggctgggcagcgccagagatgcgagaggcactccatacccggtgcccctgaaatcccagactcttccagtgagcccacatggtacactgcagaatcataccgctgttggctggtgttccccagacacagggcataccgggtagtaataggaaaccggctccgtccttcacgtctcctggcaaccagttgaaatccactaagaccctcggaatccaggatttagctgtttatttttttcttaaataacgatgactctataaacaaatgtttgctctcccaagtgttcaggaaggatttaattgctgcgaagtgctaaatgtcagtttccaacgtacgtggataactcttcagaattcaaatttatatatccacctctcttagaactggttagcagttctaattaaataaacaaaagctcacctaggatttagaagcccctacttacagcgaaggcttagggatcactgtccaactgaaatctaaccggcacccggtatgaagttaccttcgattgcagtttttttttttttttttttccactgctagagagggtgatggagagagggctgttagtcactgatgcctggatttgccatgtcctcgaacacctcgatttatcacttcatagtcacaaatgagagcaaggacattttagggggctcgtaactattaaaaaaaaagaagagaaggagaaggagaaggagaaggagaaaaggaaggaggagaaggagaagagaagagaagaaagaaaaagaagaagaagaagaagaagaagaagaagaagaagaagaagaagaagaagaagaagaagaagaagaagaagaagaagaagaagaagaagaagaaaagaagaagaaataactatgacttaacagcagcagcctggggcagcgggtgaagaatcgcgttcaagatcctgccgaaagagggcgtaagtttaagttaagattggagcacacactgacgcccagccaaatgaaagaacatttagaaacattttaaattaactttaatttgcaagactttggtgtcagaactaccttgtgtaatacagcctgttctcgccgtaaatgtctttgctgcgtgaccacgaaaagagggtgcagggccctctggacctgcgcagctgctcggttcagagacgcgcctctctggtctgagacttctccacaatcctttccactccgtctgcatcgctgtggtagctgtgaccagtggaaagactgggtctaccgggcaggacctttctgggcatcctagactatcgggcatcctggaacagaagcgctggggttggcagactgctttttaggtacttaaagattctctgggggaagatctggggggccgggaagcgggagtcccttttagttgcctggtttagcaaatagtaccttagggtgatgcttttcaagctccgcgacacttcctggagcggaatcatttatccaacatcggaagcaacaagtttcgcttttctggtctcagtgaccccgcggaggggctgcgcactgggacacggtgacgctgcgcccactgtgattctagcgtgtcccagcagcccagagggaggagggcacccacgccgggtgggggaaggagcggtgcgacaccgtgcaggccagatgggcttaccagctctgcaaatgaattttcctgcaccaggaccttgttccttgttccccgaccttgctccagggaccagaaaggtcaggtgcgggacaggactgggcgcacccagacagaacgtggccagatcaagaaaagaggtgagagtctatggagttttgcaaggaagccaccaatttggagaaacatttccccttcgtttttgcagtgtgtgtgtatgagtgtgtgctttgtgtatgtgcgcgcactcatttctttcaaacatatatacacttttttttttttttaatcctggggttggagaaagcggagccagggagaggcggggaccttaaagtaacgctgtgccgcgaggtctcccgcgggtgtagacgtgggcggttgcggctttgggccaaatctgagcaccggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccccacccgttgcagagacaagcccggcctcggcgcgccatgtgtggtaacgcgctgcgccgctgccacgctatttaaaccccggctatggatccagaaagccgcgcgaatcaatgggatcaaacgcgaaggaggtgcaccgtcaattacaagcacttggacaagtttaacttttttttttcttttacaaataaggccttcaaacgcaaccttagcaacgcccaaataagaagccacctctaagccaaatagcctatgtgcaaagggagggagaatatatatattgataataagtctatatgtatattacagacgcacaggtttacattctgtgaacttttttctttctttctttgctttaaaatttttttttttattttttaaacctagggacattgtagaggaatcttcctatcttttggcgagttactgaagggggtattctgttttcttggagcgcccaagggggcgcagggacagaggaaagaaaagagctgggaggaaaagggcagggtgggtggggggcagagggcgagccggcggccagggcgagcgcttgctggcaacacgatgcggtccttgctgctgttcactttctcggcgtgcgtgctgctggcccgggtgctgctggctggcggcgcgagcagcggcgccggggacacccggccaggcagcaggcgccgggcgagagaggcgctggcggctcaaaagatcgaggtgcttgttctattgccccgggacgattcgtacttgttctcgctggcccgggtgaggccggccatcgagtacgcgctgcgtagcgtggagggcaatggcaccgggaggaagctgctgccgccaggcactcgcttccaggtggcctacgaagactcggactgcggcaaccgcgcgctcttcagtcttgtggaccgcgtggcggcggcgcgcggcgccaagccggatctcatcctggggcccgtgtgcgagtacgcggcggcgccggtggctcggctggcgtctcactgggacctgccgatgctgtccgcaggagcgctggccgccggtttccagcacaaggacacggaatactcgcacctcacgcgcgtggcgcctgcctacgccaagatgggagagatgatgctcgctctgtttcgccaccaccactggagccgtgcagccctggtctacagcgacgacaaactcgagaggaactgttatttcaccctcgagggggtccacgaggtttttcaggaggaggggttgcacacgtctgcctacaatttcgacgagaccaaagacttggacctggacgacatagtgcgctacatccaaggcagcgagcgaggtgagcgggagcgggaccaggggggtccttggctctgactcagcggttctcagtggctctcccccaaaccccaccaagtcaatcttctgcagaccccacccttccccgtaacccaaggacccgtggaggtcgcgcgggggcttgtccaagtgtgagctgcctgatccagggacgggtggaggatagcccatcgcggtggaaggggtgtgcctacacagtctcggggaggtggatctggccagtcgagggaacgtctgagccgcttgctagcgccatcccaggtatgacaggtgtggctaaacaccaagggttttccccctcttcgacagctccggagtcccgtgagttccaggaattccctactctgtccattgcagtcgcgcgccccctggcagggccacagcgtctggggacgccccagcagtctcgcagcttcttgactagctgggggttgggacgcatctcctggctcccctggctgctctttccactgaccctaggtctctttttaaagccttccttttagattccttccatgccctttctagtgtcttacaagcttcgatacaagcaccagaagtgcgtcgccgtgtctgaattcaggcgactctcacttcccccgggagctttgggcttcgaagcctctgaaagcgcgcgcagagctgggcttgggcggagcgcgccggaggatcgtgcgccgagcttccttcccacgggtcccctgcccggccctttctccgcaagtcgctgagggtttggaacagtagccaaactagacagagaatttggtactggggaatgggatcatggctacggggagcgtgggaattctccgcagctgcccaggtttctgtcgtgtagatagaggaaggagccgaatcccagcatagggcatgagtccggacgtcccggttggggctcacacattggagaaatctcgcctttgtttccccttggtgcgcaggcgcccagaatgtccgcggtattaccctccccctatgaccccacaccgcaaagcttccgatgttcgttcggaggtgctatcctggtgagacctaggaggggccgagctaagccaggcacctagtttgcccagtgttggtcgcacgaatgctggggacctgggcctggctgtggcgggacagcggaacactaagcttgcaggctcagaacaggtgaggtgggcagaaaaagcttcaagagtgggaccacaactgcccctccccgctctctactctaacttcaaggtgttgtagacagtgcagacaggacaagtttcgacttaagaactccaggctgtctgcgcagaatcactgttaggtgcgcaggcagggcgttggttatgtaaaaggaaagttctgtcctatggtggcagatttgcccctgttgggcgagaaacccacatctactttttcccccactcccagtcctccggctactgcagcctctcgcggtcctgggtactgttacttcttcagttctgggcttccagagccttaactaaaagctggagacttcccagggcaggctgggaatgggggcgtgtcctcacgcctggctagatccatccgagctttgcaaattctggtcattgccttgctgaacctagaaaggcggtgaccttggtacagtggcctagggtgagaggcctggcagatctgtcagttccgctgttgggcccttgagccgcacagtgctcttagaaccgtgatggggggagggccacactgtgagagtgggctgggggttggggtggggttggggcaggtgtgtttcggtttaaaaggactacagcctgcgttctttatttttaaatagtcaggcttattttagatctcctagcgctcatttctcgttcaatttagcagtgcaagcttgttagtctggtgtgtgtgtattttataggtgaaattattatgatcttatgattctttctctaaaatctgtgtcagcaacaataaggcgaattttctgaaatataaataaaaaattccaggctgcccttctttcaatttcttactctttgtagagaaagttgggagatctcagggcgctgagtctccacctcatcgtggctgctcaacgcattaagtagtgggggtttagtatatggtttcaggggagtttgtggctcagccacttgctagctgtcaggatccggggctgttaaactgtaccccatcttcttcaggtaaagtgggcttcctgcacagccacatcttggggatgctggaagggtttaatgaactaagtgaccagaattctttgaaacagcgccagacccacacagtaaatgtgtgggttcattgtagcgggcgttgtgctatattcgataataatcaccttcacccagaaggggaagccatgtcctgggaagagctttaggcagagaagaccacacctctggactcagcctttctgccttgcaaggcactgaacgtggaacaaggagctcgatgagaatcaggcctcttccaactgctattctgatgtggagattttacatttgattctcccaatagggatgtatctgaaagcgtttctgtcacagagcatcttctacctttatgagccagggcgtgctttagagagtccctcccaccccccaaatatgtttggaaagaacatttcaactttaaaatcaaattaaggatatctgaatatcttcactggtaaagtgtgacctgtggccttcccaataatgtgattacgttttcttttggttacataatgccctttagaaagaaaaactgaacaaacacttccccaagtcctcccccaaattattcttatctcctagggggcttgtcagctaagtcaattgaaaaacttaaaaagtctaatataatcaaaagatacacctgagtatgtgtgatttaataacattgatctcacagcatgcatttatattagcagctaagatgataacacagagtcaaatttcaactacccggcatgagggcaatagagagtttcccaagagccagccagccagcatcaggcagccttgagaactagggagcagtagatgagatttcacaagggatggcttggctgtgcatcctggttattataagatggtgaccaatttttatatacatggggtgggcagagaatactggaaagtgctttttgaatatttaagtctttttaacatcaatttctgtttttaattacagataaacctttgagttgtaagagaaatattattttttccccagaaatcccacataaaactagagaagatgactccttaggcaggtagcgaagctatggtaaccttttacattcaggattggtctatctcatgtactaaaggggttctacaaatactttaggaaatagacacctgtggcagacatacctacatacatacatacatacatacatgcatgcatatatgcatacatacatacatatgatcttagatgggcgtggtgacacatgcttggaatcccagcatccaggaagctgacatgaaagacttgtgagttcaagaccaaccagggctatagaatgtgccctgtcctaaaatacaaacaaacaagcaacagacaaatactttgtatttagtactggatttatttatataattgcctactgatcttgatacatcacaggaaatgatacatatatactataaaaagtcagaaatacatttttttaattagagaaaggttatgttgttgtgtttatgcgttttctaagatgcaaaagtagaagtaacctacacaaattgttttgtataaaaactagttgtattcttttagttattgctatgttatgtatttgggcctggagagtgaccaaaaagatagaaatatttaatgaatacaagaacaacttgcttttaatactctggtctaaatgaccaaataattggtaagcagaattttaaagcaaagaaccctcaccaacctccctagcatacagtactggggagggagaagtgctacctgccacagtgtagaaattacaagggtctctggaatggatagagcttttgaatagcagaaataagcgtatggtctgtattttgtaaatggtatttgttactttgtagtataggaatagagacatccacttttgaaagagattccttctcctaactcttccataggggtcctggacctgagtccagtggttggctgtgagtatctgtatctgtctcagtcagctgctggcacagccatgccaggcccctgtctgcacaacatagcatcagtaatagagtcagggatttgtgcccattcatgggatagatccctagttgggccagtcaactgctcagccattccttcagtctgctccatttttgcccctgcatttcttttaattttgggtcgaacattttgtaggtgagttggtgttctcatccctccactgggggtcctgtttagctaatagaggtggtctcttcaggttccatatccctactgctgtgcatttcagctaaggtcatccacattaagtcgtgagagcctgtcccttcccaggtctctggaactttctagagattcccccttccccctcctcccccagcagctgcagatttccactcattctcttggccctttggtcctctctcctgtctctccccatacctgatcctgtcccccttttccccctccccttcccctcttccacccaggcccctccctctgtctgcaacccgtgactgttttgttctcccttctaagtgggattcaagcatcctcacttgggcctttcttcttgtttaacttctttgggtctgtggggtgtatcagaaacccatgtcttttagctctaagaaagtttcttgaattatttctttggtgattttatttccttaatatttagtgtatattttaaacttgatgtcagaccatctggctgattctttacattttttgcccccccttttgtcctctttaagaaaaatgccctttgcctgctctccaaagttactactgcatcaattttctttctagatttatttctattattttatgtgtatgagttttttgcctgattgtatgtctgtgtattacatgtatgcctgaggtgatgagcctccatgtgggtgctgggaattgaacctgggttctttgcaataacaagaagtgctcttaagcactgagccaatcccccagctcctatgtcacatttttaattttgtgatcacactttcagtatgcagcacgaggctcatactcaagaaagaacctagcatacttctcctgctcttctagattcatcaatgagataatttgttactttccctcttgctgggacaaatgggagctccttgagagaagagggatgctaacccattggaagctttcttaatggaagtccaggggcaggggaaggagctttaccttaacatgtgtgtctagtcaccacttggaatgtgattagctctcttaattaacacttagagccattcctgtgtgcccaacccctatgactagaagaacatgctgcagtaatgagaaggcatttatgggcgacagtgtggcacccagatggggaaagatgacatctaatgtcacaagttaaagtgggacaggttaaaaatgttaccaagaagcacataacatccatgttatcctttttttctgaagtgtaatgttttgatctcaaataaatagttatgattaagaccaggcatggtggcacatgcaaggcaaaggcaggtggatttctgtgatgtgatttgcagcctgttctatagagtaagttctaggacagaacagggttacacagaaaggagctgtctaaaaacagttgatgtttatatatcgaaatacatattaatacaacaaaagcagtgtgcattgactcccacttgtacaggaggattggctgaccccatttctctgttagtcttgcttactgctgggaggtctggggagcgattgagttttcctcatgtggcacacttctgcacatttccgtgtacttcctaagttgtacctgctcctcttatgtcacttgtgcttgttaacgatgtaatttggttactgtataaaatgatgaaatatgaataggaacagaaaattatctcagaaaaaatatttcaagactttcgataaattacataaaggaaagcttgctaaaagtacccacagttcaactaggcatgaatgagtcaaccgtgaaaggttaaggtacactgtaaaaaaccagggctatttattctgacggctctgttggtggtaatcagtgatatgacgtggtattgcttctacttgaattaaaactagatgatgatgataatgtgtgttatgaatttggattacttgagagaaacaatgtcctgcacctgaccttgggaaagaggatttctttctttctttctttctttctttctttctttctttctttctttctttctttctttctgttnnnnnnnnnnnnnnnnnnnnnnnnnnnnnnnnnnnnnnnnnnnnnnnnnnnatcagagtctgtccaggacttagggatgccaggtctctggcctcagggtctgttctatcctagggcaggtatagctctcaaaaggatacttaggactaacgcttggtgcctttggatacttgaatcaccccacctgcttctctgattcatgttctctcctctgtagcatctttctgcttataatttggctccccagttagtgtgcctagattgaggccatattgaatggcttgtattcctgaacattctggcccccatgggagttaagcaatctgcagttctgataatctatttatgaatatcatgtaggctatttgcccactgtgccagcaaaatcagtttctacatgtagctattgagagacattgaactctgttcagttgatacaagttgataagagttccttagtagacagccaatcggggcctcgcggatccctctggagaggcccattcttggaatccgcgctctgtgaacttgtccggctcgagcagtttatgtattacctgctttatgagatgccctgcttgcgatttttccatggaaggagtttgatctaaaatgagggcccaagttggtaattaggagtttctttgagatcttctttattgagacatcttgggattttttttttaaatcccagatgtataattataattccaaaagaaacaacacctcacacttacaggttacaggtgctttgtattgtctcaaaaccgtgttttctagtgtgcatggagcccttctgtagttaaagacgtcagtcagatcctggctactactgagctaatgtgtgcagtgaatgacagacatatcagtaggagcccagactttcatgcagcatacccaggctgttcaggcacagactgcaatttgttttatgtctttcggcacctatacttttacaaagagcacacacatctcagagggctggcatgaagcgtggtaaggcaatttatagcacccaggcctctgtgggcctcctctcattctgtgtaagaggaaagtacagttctcctgatcatggggtctgtgagccaagaaccatcagcttgactagagagtggccaagtcccccctacttcacgtaagccgtgtcttgcgtaggccatgggaaacaatctcttaaaaatgcttaaggcctcttacatttgacagtgtgactacaaactgatagaacactgatggtgtgtgtgtgtatgtgcatacatatgcgtgaacactactggtatgtgtctgtgtaaacatacaaatgaagataatataaatattaacgtatgaaagcttcaaggataattttcaggatcattcttcaatacttctaaacatattttttttggaggcaaagtctcatttaacacagactggcctcgtatttcaaggatgacccacacggcgctgagattacaggtgtctaccgctgcacccagttttatgtgatgctggggatcaaccccatggctctgagcactctaggcaaggactctatgggctaactcgtatcccaagacttctcgaaaacactgaagaacaaggccgttttcatacataactacagcaatagtcataaaacaagagctttaaggcaaacatatcctgccacctggttaccttcagtcaaatttcatcagctgtctcttgatgcttttatagaagatctttgcttgtattttaagatccagaatccaactgagtagcatgtattgcttttagttttctcttattgtaagtctcttgctgtttagtatgttttatgagcctgccttggttcctcattaagttgagtattttaaggagtacggataggtcattcatcctagggtcctctaggtttgggtttgtagctgctttatcctgaccagacgcactctgcctatttgtataatttctggtcctctctgtgttctatccagaggctgttgtgtctgtgttgttggctcctgtcacatggttttggtgctatttgctactttttttttgagttaaaattatgtatttccctttgtccctttttagatatggcttcatcttaggatttagctgctcatagccaattatagtttgaaaaatttaaatgaaaatttctacaataccaacaatttttaagtttcaaattacttttgttgtagtatgtcactataattattctattttattattagttaccattgttaatctgtcacagtgtctggcttagaagttaagttttatcataggtatgtatgtttaggaaaaaaccatagtatgtttttctacctaacttttgggaatcccacgggatgggtgactgtccctcctgtggataagtggtgaccaggtattaggtagtttgtgaggagctcttgaagactctgtagatgacctgttctgcacctgctgtcccctggctgtttggcccgcattcctcctgctgtgtgtgggtgactcacgctttgtttctctccccagtggtgatcatgtgtgccagtggtgacaccattcggagaatcatgttggcggtgcacagacacggcatgaccagtggagactacgctttcttcaacattgaactcttcaacagttcttcctacggtaactgtttccggcttctccgaccctgtcaacgtgtcagaaagaggagtgagagagtcaacagctctagtgaggcccatagatgtgctttcagttacctccggagccatacttgattctggaaatttgtgattctgagcactcccatacatgatgcctcatggtttctcaagcttttcatcttttctgagaatccactggaagtaaggaagttctctgtgatcaatgtagcccattcctaactccacaggagtgtacatgcagacaccagatgtcatggccgtggtggactgttggaataatttaggtgcgatttggggtaggattgtaggtagcaggaacagggttagaacataatgttgtaggataggttaggccaaggtgttgccaaagttagcacacattgtttcataaaacttttagtgtatgattgtatgtgactatgtgtaatgcgtactcatgttacacacgtgtttcttagaggcagcagtacaaaagaaaatgaccatcattgtaagttgagataaaagcatgtggaagtctttgttcctaactccccttccctgtagtttactacaccttaatcctctcttaagtagaatttcatgagccacagagatataggccaaagacatctgtgattccttataatggacttaggaaactcccagggtctgtgtaagaaaggattgttttctttttttcaattttttattagatattttcttcatttacattccaaatgctattccgaaagtcccctacgcccccgccccaccctgctcccatacccacccactcccacttcctggccctgacgttcccctgtactggggcatataaagtttgcaagaccaaggggcctctcttcccaatgatggccgactaggccatcttctgctacatatgcagctagagacacgagctctcaggttactggttagttcatattgttgttccacctatagggttgcagacccctttagcttcttgggtaaggattggtttttaaaaattaaaataagtatttctttgtacctatttgggtgttttgcctgcatgtttgtctgtgcatcacatgtgtgcagtgtccaaggaggtcagaagagggcgttgcatagcctgggaactagtgttacaaaccattgtgagcttccacgtggatgctgggacttgaatctgggttctctgggagagcagccagaactcttaactgctgagctgctcttcagcacctatgtaatggaagaatgctaaggggctcagcttgatcacaagtccaaagcctgtttcttccatggtagttaggactctcgtgaaagtagtcatttcaggactataggacatttttctcaaacacacacaatgtctgctcagagctacacagccttagagcggtaaacatgcagattacagatagcgtgtttatggtgagctccacttccgagtgcttgctgatgatatatagttatttagataggatccaagcctttaaacatttgccatggtttcctgccccggtttcctggtttacttaagcagtgattgttgtgtatatacagataatataacacacttctcccggggataaagaaaagttgatgagacaaaagtaaccactgcttcctgtggtggactgcaaggcgggtgtggtgctcgcaggaggaatacaggatttcatcctactcactagcgttctggtctgtccctctgtccctctgttctgtgaagtggaatgttgttctcatttattgacttaaggccagaatattgttatatcagtggttgtggcactgagttctttaacacagggattgaagcaggttaaaggttaaactatcaattctgtcttacaaggagaaatacagaaatacagaattttaagtgatgtgtaagaacgcaggctgtgaacagacaagcacgtttgcatgcgttacgcatgtagtaatggatgcaggtgttactgttagcattgctttcttttacagataaaacttgtgtggctttaccctcttataacaatacacgagcactacagaaaatgtggaaaatatatttaaaaattctgcaactccgacaagaagttacgttgtgatttcttagaaatatatatggtctattatatgtaggtatacttctcaagaataattttcaataaaatgataacattatggtaccaatgtatagtatacctttaattaacctctatttcttaatactgctttcagccttctgttattaggaacagaatatgctgaatcgtctgatgtatatagacacttacagtcatatacttagacatatatattatgtagtataaatctctagaggcatagcactggcttaatggttatatgcaagcattgctaggaattggcaccatttcccatacataggttttaccaacttatatttttatataccaatgatgaaaatgtctgtatcctttatcagtttttcaaaatataactttatttatctatttatcagaatttatttttatgtccataagcaaagtttctgtagttttaattttttaaaatctgtttctctctgtgtgtgagtgatgtgtgtgtgtgtgtgtgtgtgtgtgtgtgtgtgtgtgtgtgtgtgagagagagagagagagagagagagagagagagagaaagagagtgatatgtgtgtgtgagtggtgtgtgtgagagagtgatatgtgtgtgtgagtggtatgtgtgtgtgtgtacctgtttggtgtgtgtgtgtgagagagagagtgatatgtgtgtgtgagtggtgtgtgtgtgtgtgtgtgtgtatgagagagagagagattgatatgtgtgtgtgagtggtgtgtgtgtatgtgtgtatacctgttgtggtgtgtgtgtatgcccacctgttgtggtgtgtgtgtgagagtgatatgtgtgtgtgagtggtgtgtgtgtgtgtatacctgttgtggtgtgtgtgtgtgaatgcccatctgttgtggtgtgtgtgtgtatgagagagtgatatgtgtgtgtgagtggtgtgtgtatacctgttgtggtgtgtgtgtgtgaatgcccacctgttgtggtgtgtgtgtgtatgagagagtgatatgtgtgtgtgagtggtgtgtgtatacctgttgtggtgtgtgtgtgtgtgaatgcccacctgttgtggtgtgtgtgtgtatgagagagtgatatgtgtgtgtgagtggtgtgtgtatacctgttgtggtgtgtatgtgtgagtggtgtgtgtgtgtgaatgcccacctgttgtggtgtgtgtgtgtgtatggacgcctgttgtgtgcacgtggaggtcagatgacatctttatggagctgtctctcctgcttttgtgtgagttctggggctgagtgcagctcatccggactgggtagcagctgcctttacttactgagcctttgtggaaacccatttttatttagtaactttttcaatttttattatattttatgtgtataggttttttccttttttttttttttttttggtctgcatgtgtgcccgtgtaccacttgtgtgcctggtgggtgcctgaggaggccagagaaggcacagggtcccctggagctgggtttacagacagttgtgatctgtcatgtgggtgctgggaaccaaacctgagttctctgaaggagcagccagtgctctttattctgtgtcatctcttcagcaatccctccagttttatttttaatatacacatttaaaattatatttaaaattttagaaacataaagttaaccactttattttattttattttattttattttattttttgagccagtgtctttctatgtagccctggctgtcctggaacagctagaccaggctagctttaaagttacaggggtcctctggactgtcttccaagtgctggcattaaaagtgtatgacaccatgcctgggcaaaattaactactttaaataattaaattatttatatgttagaaaccttattccatgggttcaagctttgatttctttttcattgttttaaatttctttcttcttttttgtttaaatgggtgtggcctggcatgtatgcatgtgtaccacctgtgtgcttagtgcccacagggggcagaagagagcacctagctgtgaatcaccacgtggggctgagcacgaaattcaggtcctctgtgagagcagccagggttcttaactgccaaaccatctctctagctccagttttgattttcttgaaaatttaatcgcaaaatggtttcacacaaatcacaatgaatacttgatgtttctgattaaatctgattttcttctttttttttttttactgtacatttgttcaggctttgggctctggtctcaattagcctgagggactgtcctatctactaactcttgactgctaagacctaagagttaacagctacaaccttaatcttgaaaaagtgagttaatctgccgtcctcagcagccttagtctgttctagtgactcatcaggctgagtaacagataaacacatgaggggatttgagctaactacccagcagatagtatgaagcatagtaagtatttaacaaatatttgtcactcccattattaatcttagtttgctttgactactgctcccggaatgttaaaagttaagttgtcaaacctttctctttgtctgctttatgcacacatttcaggtgatccgctctgctaactgcattgctaactgacttgcagctgacccaccctaaagggctgtgtgcattatgagttataccaggaactgaataatcactacactcaactacagtgatgcacacataaaggttccgtgtacctgaaagagctccgtctgtgagaagcccagggtagggatccgattccccaagatcgttagtgttacagatattttaggtttcctgtctccgtttcccatatcaaagattgtgactacgactccacaggtcgttccttaattctggtttaaccaggtcgagaatagcagatgagaggagaaccttcctgctggctcggttctttttgttggttaccaggggaagctctactccacttctggttgtatggggtcggctacccttggatatagttggaaattgtattctctgttggactcctcaatatcagagctagtgtgggattctgggaggaagaagggaggaaggttggcggtagtagtgtggtgcctttctgtgtcctccatagatctggaagcatctttttcctcagagcggaagtgaccagtggcaccatccagtgggcagaatcacccgaacttccattctggagtatcattacaagggtcttctttgataatctaaccccccattatcagagccatgatcccacaaaggttctttgacacccagtgtcccctatggttcttcacacaatctgtatatttgttctagaccagaggttctcaaccttcctaaggctgcacccctttaaacacagttcctcatgttgtagcgacccccaaccataaaaccatttcactgctactctgtaacagtaatcttgttatagttatgaattgtgatgtaaaaatctgatatgtaggatatctgataatgagacctcaaagaggtcatgatccaaaggttcagaatggctgttctagaggatggtcatctgttttagaaaatacagttgacagtgtgtctattttctatgattagtgaatgtctcaatcttggtgagccctcagaagcatctccagacctgcccaaattttatggcgaccagagttcaatgtataatgtatagtacaatctgagggaatgaaagtgtttgaagagatttaagactgtacttaaaaaaaaaagtctagagtagatgatagtattgtcttacagatgtttttgtagtatctaccagcatggcgtttctctctggtcatattagcctccttattaccgcctccaaaggtaaggaagtgggaaggtacttgcacaatcccagctgcagcaccaggactattgctgcactcaccttgccttcttgagaactcagacagcaggaactcaggtgaggtttcgagtagagtcaaacacagacaacataaggagggattgcatttataatgcttgtaaaggtgatataggcacattaaagtcaatttggaacaaagagagaaaagaaaggacttctcatagattccttcggctgtagtggttgcctggcagcgtgttggggtttctcctgggtttgctgtgttactattttattttaaatctatgtgttgtgtactgccggtgcaggcttaaatctcgggatgcttcagctttgaggagctgcacacaggttggacgaggcttaagcggctggccctggtttgcatttgctcctgtttctaggatcaatcgcctggatctgtagcttcctcatctgtaagcatcggctttcagtctttgaaattgctatgaggattgaaggatcctaggctgcaggtaaagcagctctacagagacctgcggaatattgatgggtgtgcctgggaacctagcccctggccctgtgagacactggggctgtggggaatgggcgacatgaggcaagatgagggctattcttttattgatagctaccacagctgaagaaccacagaggttggcaggcagcctaggggaatgtctggcactcagttcttgggcagattctgtgatacccctttgaaggcctactgtgtgctcagtggttggtaggcgctgggagttgcaggatgtcccagttattggagcaaaggcagcagtcgttggggccaccgtcctggcttcagaactgctgagcccgggctgccttccctttcatacatattcttgattttctttactcagtgcaaacccgagttcctgatttattatttaatattaatttaatgttaaactcaaacaaatcaaggcaaaacacatgctttcccttactctgaagtgatgatgaagagccatcttcttttctaccctgcctctcaggagcagacttctttttcttcttaattccttcatcaggacagttgtggaaatacaacactgagggctgaggtggtggctcagtgcttcaaagctcttccagccaatcatggggctgagatcccggtacccacacaacaagccgggcatccctaatgtgcctgtgaattcaggtctcaggggtttcgatgttacctcctggcatccacacatgcacaggtgtgcatagacattcatacttacacacacgtacgcctccagacagacagacagacagacagacagacagcacactcacacacactcacataatttttgtttcctcttgctgtgataaaataacctgacattgttgggaagtcagagtagcctgtcacatgacattctcagccaagagcacagatcagtgaattgatgccacatgctggtgcgcagctctcactcatacacaatccagacttcgggtcccagaaatgatgccacctgcaacagctctaattgagacttcattcccagatgattataggctgtgccaagttggtaattaaataccatcaatacacacataatttaaaaaataacattaatacccacctctcacctgaaagtcattccctcaaggttacaagtagctttcttgacaaaatttttagccttggtgatggccatgcctccaaataatgcagtttaatggcacttcctattatagtaccacatacttccttcctatgttctcccctccctccctccctccttcccttccttccttcctccttccttccatcccttcctttctccttctcttcctcccttcctcccttcctttctccttctcttcctcccttcctcccttcccctccctccctctctccctccctccttcctcctcttctttctctctttccttccccatcttgttccacgactcccatcttttttgcacatggccttgcctaattgcccagactggcctcaaactcttcctgtagcctggccctctgagtcgaagcattataggtatacactaccacactgggctagccacaatctatttcgtgttgcttgggtggccactggtcacatgccacacatggctgactattgaatacttgagatgtggcaaaggtggcgaaggagctgaaattttcagttcacttgagtttaaataattcatgctgctggtggctgcccccctggggtgacgtagctcccgggcagcccagggaggtttctaactattcctttcctgaaattttacgcttctggtttcaaggcctctgttacatttctagttctatcagtgcctctgtatctcctgtaactattcctgctcaccaacaacagtctgtgcatagcccacactccttctcatcctgcatgttctttagggcaggtaacccctgggctccaaccctgatttgtgtaggactgacatccagtgtcttttttagccatattctctctggcttcagacctgtttccaacctttagcctggtggtggactttgggccttctgaagtcactttggatctgcagtgacactaaccaacactaccatttcttcctctccttccctccttcactctgctttttcatcttaaggatcactattattcttctcctcgattccatttgtgatgcgtctccctctccattgactgtccctccccagccactgtagagtttgtacacttatcttgtttccattctcatgggtgtgatctctttttaatgattctaaaagtaggaacatatttatatttttgaaaacatgtactatcatatcaaaatgcagagagagagagagagagagagagagagagagagagagagagagaagaaaagtaaagaaaaaaaagagagaaagaaaatagaaaagttcttggtgagcttggcgtcctcgaggaccgcttggtgtttttggcatgtgccttcccacagatgacctctcttaacctcttgcctggattactgtggctgcgaatgttcaatgtctccccactctaatccactgctatttcctaaggcatgcgcctctcctgccattcttccgttctgctcataaatctccagaggcacctagttgtctgctgaattaaattcgtccccactgatgggacaccgcgccaaatcaacctttgctttctttgggtccaacagccccagtgtgggagaagagctcacggcagaagaggtcatcattgtgaacagatacctacttaggttggtttgaacttagtaagcatcatcatttctatgtttttctagaaaacaagcctctaaagttatattttaggtcatgcttgctggcattattagactggatttcactcagttttgaaaactatattcttcctcttttatttactgagattattgctgttcaagttttgcatatattttctaagatagcataaaagtccacaaggctaagaatttctcttaagtccctgaagaaaaccaaacttgtctccattgatgaaagactataattatctttgtctaaaaacatcagaatttttatgcatgcctacttgtgccttcttaaacttagtctggaaaccaaatgtaggcattcatgtatggaagggaagcatcatgtattatatcttagcttcagcagatcttgacactttgactcaaccagaaactgagtcagtggggcctagagcgatagctcaaaagttaagagtgtatattgctcttacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaatattgttgtatgtgtactcaaaatattcatgaattttacccactgggtagcattgtttagtaattttggtgaccttgtcaatactgtgcagatataagccctcaaatctgcccttttcatcctggaaagatgaaagatgtatcactaacctccaacttttaacagtactaactttgtatgtaatctatcttcttgctttattgtaacctgccattccagacccaaatagcattatgcttgtcagccacactagtgacttggttcattttcataatggattgtagatatttggtagatattgatagataaataatagatagatagacgatggatagatagatagattcgtacatacacacaaacacatcataatggaaagcaagtgtgaatggaaaaggaacaaaaacctccctttgcttccacaatgccgcagttccggggggctgacaattgcagttccatggttattataaggcaattacatcaacagagcttgtctgtctctctcacatttcaaaggaacatgtgtccgaagagacagcttctcctttaatgattttgacattgtcatcttatacctaagcgcaaaactatgacaatacctcttgcctctgctgccaaaggtaccatgtagggacacattgcagtggaaaagacagaatggcctctttctggtgactggctcggaattataaatattttcctttctcccgtaggagatggctcgtggaggagaggagacaaacacgactctgaagctaaacaagcatactcgtccctccaaacagtcaccctactgaggaccgtgaaacctgagtttgagaagttttccatggaggtgaaaagttctgttgagaaacaagggctcaatgaggaggattacgtaagtgcttgattatgagcctccgccctccagcatcctgaaaacaggcttctaattaaaccagaggtgacaaagtgtcccattctgagccattcaaaaattccgagttcaagtctgagtgtcgctgttgcctcccgtgtatgtgtgtgtctttttttcctggccacttttcctctccccaaaccccacccccatcatcgttcctgcgattcacttacacgtctcctttgcaactgccaaagggtggaaaactgccttttcccagggatctgtgatgcagaacagggtgtctgtagactcccaccatttgctaagctaggagggtgttgcgggaggcggggaggcagttgaaggagtgcctgggctttgcatgggctaatttgtccaaggcttggtggcagaagatattttagggtttggaggctctttctttgcacaatccatgtcctcttcttggttggtctgttccggtctctcacagacagtggagttttctcctctgaggcaagctgcttcctccttgggtgttctaaggcttcccactccagcaatgtttttgttactaatgcattttaaagaagctcagcctggggtaagggtcaggctcctccctggttgctattgttcagcagcctttggcacacttagcgatgtttctgagatgttcacagtgtgaacccaatggggcaaacccactctctgggtaggatgagcttttgagttagtgggctgaggtgggtgtgctggtctgtctttgcttccctgccaataatgaaaatataaaggtatttaatgaatacctctatattattttacctaacagtccatattaactatgatttgaaagctgagccatagtgttattttgtctggcttcctttctgaagttgttaaagttcaattgcttcatcgtatgctgtctgacatagtgagatacaatggacagggggcttctcaatagactttctggacatcctggattagcaattattctcgttcagagagctaaatctcattttaattgtagtgcaagcaaactcacatgaagaagacattgctatgacaacgattcagtgtttttctaattctagtattttcaagcgtatctgcatatgtgaattattaatactgcctttccatgctgacttttagaataaataaaatttacaattttaagtagaattgaggttattatagtaatttactctaactctgaagatatattcattttgcttttttttttttttttttttttcaattctgggagtcaaactttatgtgtgcgttccaccacccaacccaccacccttcctttccatgtagcgtttgagcacagttgctagttcacacaggtggttgtgctgagttgtgggaaagcaagggaactagggtcaggagcctgtgctccgctcccaggatgggcagtagagcagtacagtgggcggagcttcatcagtctcaggcgtcacttggacagctttgctcccggttctttagcttctcagttttgcattcatgggcgtgtctgtttgcatagaacataacttcatagagccttgtgtgggttctgcgcctgtcttcatctcatacccagcaactatgcggtcccccagataatcacgtgacttctgggtagtttctgatttgtttccttttaacgcttctgcttcttaatgcttaggctgatgcgtcttctgctaaattaaagttttattgaactgaattaaattattaaattaagtatattgaatgaaaataagttgtaataaattaaagctcttgcggcaccagtgaggatcccaacaagttattgaatcgtctgagctttaaaacggaacagatttcttatctgttggtgtcaccgcagaggacatcattttgtctgaccgatgcatgaaacacggtgcttaatgtagggggttgaggcagtatctcagatttattttatttctttggtgaaggttttctgctgtttaaaaatgacgtattttctcagcatgactgaaataaagatggcgcaagcattaaagattgcctagaccagggtgaggcaagaccttgcacctttggagctttgctttaggattgcaaattgaatgatatccgggattcaattttatatttattagagtcacatccatattagcatgttgctagcacccccggaaaggctttgagctttccaaaaatgaaaatagatgcaattatttttttttcttttttttacaagctacactgcaacactagaaagacagagaaacaataatttttaaacagtaaacttatctgactttttaatagcacaatgattttacagtttttgcttaaacttggatggattaatttaatttttataagtgtgtatgtgagcatatatgtgcacaaacgtgtgtacatgtgtatacatgtatgttgaggccagtggtcatgtatggtatctccttccctccccatcttacttactgaggcagtttctcatgggacctggtgcttattgacccagctagtcagctgggcagcttcccggggtcaatctgcttctgcccttcctaatctgggatacaagtgtgtgctgctatacccggatcttttgcatggttgctagaggttgaaaccaggccctccaagcttttacagtaaggactctaccaaccgagcgagacacatagctagccccaattcatacagttttgtttttgtaaaattgatctttattaccataagttgctccctttaaaaaaatttaaaaatttaattgagaaaaacaggggaaagagagtcattgcttactgaggatgtggtcacaggcaagttttccaggcttcagagcgtggccctcacccgtgtaatgtggacaacgataactgggattagtggcttataaaaaaaaccccacaaaaccaaccaaacaaaaaacccagaagacatgaagttgggaatgggcatgttcagaggatataagaagactggaggaaggtgggaggtagataggataatttttcattgtctatatgggtgaaattcacaaaaataaagggaaaaggtgagaaattgaatgtaagatgctatgctatacagagaatgtacagttcccctcctggtagcacctgggaaaattatgtgtaagataaggttgttattattattattgttgttgttgttgttgttatcattattattatgtgcagccaggttattagcactgatatagttcactcagcacactcaagattcttccttccttatgctcgtgtgtgtggtaagctctgtgctttatcgcctgtgtagatttccatgtttgaattccatccaatgctttgatatgtttttttttttcttttcactttttgagacaggatctcatgtaactcaagctagctttgagctcactatatagtgaaaaatgtctttgaattcccaatgttcctgcctcaaactctcatgtgctgagattataggtgttgcccgccatacttggctctatgcttattgtgataaccagattctttattctgttacaaggttatatattagtttgtttccccattgctgtgtgtggtggtttgagaagaacgggccccatatatatttgaatgcttattgctttgaatggttggttactggagagtggtactatttgaaaggattagaaggattaggagctgtggctttatcagagtaggtggaacctctttggaggaagtgtgtcactgggggttcgacttgaagtttcaaaagcccatgtcaggctttctctctctctctttctctctctctctctctctctctctctctctctctctctctctctctctctcattctctctctccctctctgtctgtctacacatcagaatgtagctctaagctactggctccagggtaatgcatgctctctgccatggtaataacagactaaatctctgaaactgtaagcaagcccccagttaaatgctttctttttaaagagtatcccttgcctgaaatgcttaggatcataagtatttggggtttcagatttgttttcaattttgataaatattcatacacacattatttgggatgtagaatccaagtctaactgcaaaatataccgattcctagacaccttagacatgtggattgaagatataattttgtacactgtcttaactgcccctgccttttgactgcaagccaccacaagatatgaggaggtttctatttgtgatgtcatgccagcacttaaagtttcgaggatactcaatctgtattgttcttacatttatttatttatttatttatttatttatttatttatttatttatttatttaaattgctgtgatgggaagacaccaaccttgacctcttctcctccaaacagccaaaaaccctttccagtgtatgtctttgtcagcaatgctcatcagcaataagttctgtgtatgggacctccttaggaacaaaaaaaaattcagcttcacaaatggagatggtgtcagggtagtaaaagagttcaaaacaggggttctgaaaaaccacttggggtcactggtaaatgcaaattgagaacaaatgttacattggagaggcccctggggctcgaggcctggctcagaaaaggttttgccaagtgtctgcctggcctccaccaattggtttgtactgggtcacctacatgtgcagtggctttcactcaagggcattttaatggagctgcctagcactctgccctaggagtggttccaagaccagagtgctggtatttggttttagaatgcgctgtatggtggccaagctgagattagttgcatcccttgactcctgggccagtgactttctttttccactacatcagtctgatcctcttaacaacaatgtgcccaataaggaggcaaacttatgacccaaagattaagtgtatcaggccctctgtgtgagcctggcaggctgaagtatttccttttttcctctgtactcaccaggccaaagtacacacttttatttttttaacatatcagtttccctttactctctcacatacttgataaaatgtgcaaagattcactgtccttttcagctgcagtcaccctttgcccacatgtaagccatcattttcttgatcatcagatactgtttattgagttctccagggagcataactgtgaacctgatcctggaaaatgtgtgctcccagatggcatcctgatcctctaaaatctcatgagcaagaggaaaatacccacaaccttgggctctgaggtcccaaaagagttgtgtttccatgtcagttcacagaaaatgtcgtgtacctttagcaccataatgtgtggatggtacttgtctcccgcagaatggtagagaagagggccctttcacaggctgtcaggtttccatagaagctttaaggggatgaaggtttcttgcctcactgtgtgttaaccgtgcaagtgcacggcattcatatttggagacaggagtcagtgtttcacctatgtgatccacatagaaaagagatgagaaccactgggctagatcatggctgcagctggacagtataccattcaattattgtcccaagccatgcttattttcatgcataagaacaatatttgtacatgattacactgaaaaaaataattaccccagaagaaaaatgaagaaaaagctaaagtactatctagtcttatattagagaacccattagttttacttctgagatgagatagacactcactgacctgctcacttctcacacattcattcattctgcactagtgagtcagctgactttccaagacctgctgttctcacgactatttcttaggactgggtgagccaaagttgaagacactttttttggctctggcagcatccctgggttctccttcctgtaaatcccactcctggcttcgatccattcttcctattgtatttggcactttgagacctattcaccagctggaactttaacagttggttttccccttgggtgaacttcaccttcttttcctgatgtttaaataaaaaatcatagatttccagattgaaagggcatgatacaatgaatgaaaaaaagtaacacattcaattaagcagtacatttacagtaccataaggattacagatggacataaattgctccctgtctcctcccttctgtgcttatgactacacagagttgattattgttaatgtttttcctgatattgtctatatgcttttcaaattgattatttatgttgttatccttgatagtaaaattttgatactatatcttaattcctgaaatggaaaaagatgaaattatttgacacattcctttctctgcttaatattttcttttcttgttaaaaatgttttcataaaataaagcttgaagaaaagctaaaagaattatattcagagattttttttactattatgcttttgtaaacatttacagcataatcatatgttgttttatgagcacatgttgtttctcctgtaccttctctggagtttaatgactgttatcttatttgatttcacatagttcttactattttattttagtccctcaataaagggttttatgtaatgacattaatgtttttaaccttatctttctgctccagtttggagtaatttcttattttaacatcagtttggaactgtcttttagttctttcttgtattgcatgatccttttcttggatatcacttctcccttttgattcttaaaattcttgttttgaaggaaaagagcatcaatgagaaaaaggttttaatactttgtatattatacaacattttgtattatactactaataataatgtcaacattaagttgacagtttagctgggtataaaattgtagtttaatgtcctgatgtgtgttcgcttattcccctcccctttttaaaaaatatttttgggggggataaggtcttgcactgtagccctgggtaggttggaattctatatgtagtgcagactgtggaactgtggcaagtttaatgtcttagtttagtgctgagactacagatatgagccactgtgctggacttggtatgtgtatttaaaaatcttgatgtcatgccctccttcaataaattttagagctgagtgttagtcatccttagctggtcctgatattttctgtctcatcttctagtacaaatgctgtcaaagcaagtgttagttctacttctgcctttttcttttcctttctgagagatttttctaactttattttccaaactactgaatttgaaaatgtctgttatatatttaattttcaaaagctttcttggtgggtttggtggtacatgtccatgatcctggtacttgagaaaccagggcaagaagatcactacaagttccaggtcaaccggggcaacataatgaattccagaccagccaagaccatgtagaagatgctgtgtcttagtcagggtttctattcctgcacaaacatcatgactaagaagaaagttggggaggaaagggtttatttggcttacacttccaaactgctgttcatcaccaaggaagtcagaactggaactcaagcaggtcagaaagcaggagctgatgcagaggccatggagggatgttccttactggcttgtctctcctggcttgctcagcctactctcttatagaatcaagactaccagcccagaggtcgtcccatcaacaaggggcctttcccccttgatcactaattgagaaaatgccttggattttcagttggatctcatagaggcatttcctttctctgtgataactccagctgtgtcaagttgacacaaactagccagtacatgctgtcttcaaggaaaaaaaaaagagattagtaataagaaacacaaaggaaaacctccatactttttgcttgtttgagtggatcaacatttcaaaacagcactttgtctttggttcttgggcacagaggctaatttccctagtaatttccttccacctgttttaaagtatatattattttcacttcatttatctaaagttggggctaattttgtaattgatgctttgtcataatttcataatcaatcaaggtagatattattttttcaaaaagcacatcaaatgagttatttctcacaattgatgattctatttacatttgttgagataggattcttgccatcctttttattgttttattcatcctacattgccaatttcttttgggttcttatttgttgctgttttgttaacatttatctttttatctctcatattggaagcatttaatacatgtttttctcctatttctgagtgcttccttcagcactcctcagagctttgtatatataatgaatctgtctaatgttgaactgtattggagttccatgggtatcaactcagatattttgaagaattatcccaaacattattattttgagtacattttcttataggatggtcaatttcattaaaaaaattctcttctgaaccttctggagatcattaggctatattaacttttgggagccaggaaaggagtgtcatctaagatcccatacttacaactttttacaacattctcagcttcatgtttggcctgtcttcatctattccaggcacactcttctgcgtctttgctcagtgacacacttgtcttctgccaggatagggagggacaatttctttcttctctgtgtaagcttggtagaaggattctgattctagcgtgcataaagctagaggcaaacctgtgattccattctttaggcaccatccacgtttgttttggagattgggtttctcactgatctggaactggccagacagaaaaccctagagatatctctgccttcttggtcatgcctatttaaaaaaaaatggattctggggattaaactcaggttcatatgcttacaaggcaaacactgtactgactgagacatcttctaagcccaggtctgaattttccagcatctattgttttcactcctactgtgccccaccttcagaagttacccatgtctccaggtgtacagcctttaactccagtgcctgtacttcttagagccccttaccatactcccatgcatgctgcagttttggttccttaggcctatggaccagtttttctttccccacatccagaagtttatgttttcatctacaattttcttcctgaacttgctagacttgcaggcttataacaaatccacttatcttgttatggggtttctaaagggagtgtgtggtttatgagaaaccttgccttgattgttgaatctctatacaagtgtacaatggtgttgatatcgtttatggcatctctatctatctatctatctatctatctatctatctatctatctatctatccagggagagggagagagggagagaatgtcagagtctgagagagaagtgagataggaagtgagcatatttcctttggtctagaaaattttttgactcatttggttattgaccttttaatgactactttttcttgatttattagattaacatttttttcttgtcctcggaggcacaactctgccttctgtgattatttgtgtgcatgtatgtgtgtatatatgtgcatatgtgtatgtgtatgtatgcgcatgtgtgtttgtgtgcatgtgtgtatgtgtgtatatatgtgcatatgtgtatgtgtgcatgtatgtgtatgtatgtgcatgtgtgtttgtgtgcatgtgtgtatgtatgtgcatatgtgtatgtatgtgcatatgtgtatgtatgtgcatatgtgtatgtatatgtgtatgtgtgcacatgtgtctgtgtttgtttgtgtatgatgctgttttaaactcaggactttgtgtgtgtgtgttaggcaagtattctaccacatgcctcaatcctcatccctctttttacttttattttgcagcgagatctttctaagctactgaaactagcattaaactaaccctgtaagtccaggtaggtgttgcacttccagacctcccacctcagtctcctgagtagcatgcattataggcttgtgccatcaagccatcccttccatggttctcttctttaaagcaacaaatgagtcacattgcatgtgtttgagagtatatgaatatatatgtgtccaagccacatcctagatacagaggccaaaaaatacgttttgggagctggtgcttgagttttatcttgttttaaaagacagagtctctcttgtttttggctcttggttgtataccccaggcttgatgcttcattaacttctgtgtggttagctgtctggtctctgcctcctttttgtggtaggaatactggtgttaaagattgcatccagcttttttacatgggttaaagagatgtgaacttaaactgtcaggcttgtatggcaagtgcctttactcattgtaccatctccctaggcccacttcttagactcttcagaagaaagtgtaaacaggctataattaacacacataaacatagctcatgcaaagaagagttgttttctttacaggttcatcatgtatatgtatatgtatatgtatatgtatatgtatatgtatatgtatatgtatccatacacacacacacacacacactaaattttattttgttttatgttcaagactggattgatccctttattggtgcttttatgctggcttctttttaaaactcccttttggtttcatgtataggagcaccatatagtaggaaatagaattttaggctttaaagtatattttctaaaagctaagatgattcaattttaagattaattaatgaatgctaattctggcatagttatataaaagtattggggatgtttgtgtcctgggaggttattgttttcattatactgtgatgcagaggttgtacatcctttctagatgtcatgttgtgaagtaaaaaaactcgggaacaaaaaccatgacatatgggaacatcaacccacctagaatacctaagtatagagcttcttccttccagcagtccctgagctagcagagaccacctccttgctaatcctgagctgcagagggtgttatcctagtgccaaaggctgagaggaagaattctaatcttggactagtgcagtggttcaggctgagaaaaccctcagtcaggttccttgacttctctgcttaacaactgtagattctaactgggccttctcatttttaggtctctgctatttaaagctcaaagttatttctaacaagtctttgtttaaaagctaagtgtcgttgtcattacctgtatggaatttgttcattctttactgtaaaattactttctagataccacatgtgcagggtaccataggtttgtacacacgagtgcacacactgtaggagaattttattacataattgtattctgctttttataatgtcatatcagaaacatttcttggaaatattattctagatttagagtatacagaaccagcttttctttagctctaagctggtcaccactctaagtggtttaaccgtaaagctaagccccaactgctggacaaaaggaattgcaatgttctgtgtctagtttgttttacagagacacagcctcaaggcttctagatgtagaattgtggcctaattctaaaggatggaccaggattcctctgataaattacacccacagcatcttcctgaggactagagtctgattcctagaaccacctggtggaaagagagactttgactcttgcaaattgccctggtttccatttgggcagcatagcttgggtgggtctcctcacaaacaaacaactgaacattaaaagagaaaaaaaaattggaaaggatgtatagtgtacattaaaaaaaaagagacagttctgcatcttagtgctttgcggtttcaagttcagtgtttagtgcgatctgcctttaactcggggcaggatttggtaaacaccattttgtatttccaaccaggtattctgagcagaaggggattttatgacttggggtatttgctcatttgtggttagcaggccacccatagcttgctttttctttttctttaaacgctgaatatttgactatttaaacaaatactgtgggagagtctgatgcatggcagtgttgcgggggagatggggtgaggtgtcccaggagcatgcttcctaccccaggtctccctttgaagcttacaaatgcatgtggggtgtgtgtgggggtgcgcggcttatctaggcataggagagagagagagagagacaaagtttaatacataattgtctagagaggctaggtgtgacatattgagacatttaaaatgttgaaaagtaatgctgtaatttctctgagggggaaggccacatggtattcagtctcagttgtgtttcattacaatttttgcacagaagctccataggaagtgacattagttgaaaaattattgatcatcaataaaatcttagagagacatttcactgtcttcttgtctcacgccatttaattagattcaaaatttcttagttgagaaatggaaaagtcaggtgttccgccaaactagtgaaagagaaaaggatgcagcggatgcaaaatggatttggtccactctggcaacactctaaacagttaggccttcccgagagggctgcatcagaataggaggggctcccgttcttctgtagctcctcttgtcttctcacagccagccagggatgtttgtccaaatgaaaaggccttttcagacgcaggaggtccttgctaattttatttgtgagaataaaatcaaactgcaagttggtcttaacaatatgagaatgatgagccttcgtgcaaacatattaatgagattagtcttattaggaaaatggatgggggattttattaggaaaaaaagaagggggacagaggcatcgcaaggggttttcgctagctaaagaaatattggttggctttcaaaacacttaagtgaagatattgaacttaaaaatatcactttcattttcttaaagggggaaattgttttaaattattctggcaacttttaaatagtgttaaatagcactaatagactatttgaagaagttggaatattctgggttaaagcatttttgattataaataaggcactcattacctgtgattgttacacattggtaggtgtggctttctaactgtaaaaagcttagacttagcatagtgtgaaaatacaaagaggcacagggcttatgcaaaaggacttccaaacctagcgttcctgtttcatctctttaaggagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccttcttcactcactgaggactctttacacagtgatgttggggctgtagattagcttccccagaagactgagtttaaagggagaacctggaaaagaaaggcctgaggtgaatgaatgaagaggtggtgttggtattgtgttgctagagaatgttctttgaatgccaggagagtagtggtagagccactcatgaagtcacccaaggactagaggaataaatacagtgctttcataattgaacttttcttacatgacagtttgattttaactcagtcacagcagaatagctctggacctcaagtcactaggcaggagctagaaggaagtgatgtatgtgctgacttccagcttggaagcaaggaggctggcaagccaagttcagcttacccagccacttggctaacaggggattctgatgttggatgctgagtgcatccacaggggtttgtaactgtaggccagagatctggttcaagaggccattgttcattgatgctgccgtcttcatgggtactcgagctgggagagcccaaggtagtggttcaataatgttggttgaccttgttcagctcttatttagaaagccgtgtttgtgagatgtctgtggacatgtcttctaggagatagaatcttacagccagctccttgttcctctggctctcaggatctttctgtgccttcttccacaatgatccctgatccgtgttaatgtggaagaggttgggagaagtccagaaatctcatccctatacaaagaatcatagatacctaaggagttccgagagtgggagaggtggtcttccctagggccgagcacaccgatcgtttgtccaacaccaaacgatcatccctgagaacacacaaacaagggacggtctacaggccgactgggctgtactcagcaatctaggaatacatatacacatacatacatatgtgtaacaacagttaatgaaaacagaagccatgaatttgaaaaaggacaaggaatttagggaaagatttcgagggatgaaagggaacagggaaatgacataattataatcccaaagagcagaaggaataattttaaaaagtcagttgatgggtgaggtggtcatttttaattggtattttgacacaatgcagaactacttgagaaaggagattcagggagggggcatgtctctgagggactttctccatcatgttaattgatgtgggaggagctagcaagaaaagtggacagcaccagtccctggtcctgggctgtgtgagctagaggagaaactgactgagcacaagtcgccatgtgtctgttgctttcttttgactgtgggcataatgtggttagttttcttaagctccagtcatcatgacatccctgatactggtgggccacaacctagagttctgagttaagccatcctgtgtgtgtgtgtttgtctttgtatatgtacatgcatgtgagtgtagcctgtgcattcatctataggcagggatgactgtttgtctgtagatgacacccaatttgtgtgtccgactgcaacctgtcccttgagtggcaggcaggtttctttttgtagtttcccattggcacctggacctgaatgacattcatctacctactttgttgtttcctcaagatggctccatttagagctctgaagccaaatacagaggatgagggaagtccaagtccaaagagcttgttttgcacatcaaagagtatgggaggacaggaaattgtactagtcccaggacttgagagttccagatgatgataaactggttagtcttgcaggtatcagtatcagtagcatcatttcagagactatgggatggaggacagttagattcacagtttcagattcttggtcaataaaaatatatttttgaagaaggatcttaggcaaactatatgcattaaaacattggagaagcatccctttggagtatgtggctgtgtgtgagttgaggggacccagtgcaatgatgacaactgaagacccatggagtatgatgctgagtgaatgggtcacacatggggacactgaagtggcctctgtgagtgcagagacagggtgcagaggaagaatgtgaatcagtgccaacctccctaactgtagttgtgatactcagggagtgggtgaagaccttcacattccatgattgtggtacttaatgaagactcctaatgtctttgtttcttgaggacagtatctggttaggatactctttaagttctgggtcttgactcagtgcatcatgacaggttcttaaataacaagagctgacttaaggagcagataatttaatgagattaagccttgctttcctagattcatgacaatttacaattttataattactatctattattgcactttctatttcattgtcagctaaaacatggtgtttatagagaagccatcctcaactcccctgctttcctgatgtgacggaagcaggagggcagtctgttatgcgcttacaaagtcaagttaaaggaagtgaatcttttgtaggagtggaatacattagcctatttattttgtaatgttcagtgctctttgtactttctcattaacaaaaatttgccagtgccaaaatctcagtgatattccactttcttccagagtttataaatgttttagacaggatgcttatgtctatgagtcatctcaagtgagtttctatatctgccatgatatgagagtcaaacttttatctttccccgttgtgttctgtagtcttgccatatgatgaaaagatttggtttcacctgttgaggtatctcagtcaaactcagatgactgtgtgtgtgtgtgtgtatcttagattatctattttgttctattgttctgactatctttacacaaatcttactctgtaggcacatgataataatatattatgccctgaagttgccaataattctttaacttcattgatacataatttccaaaatgtaaaacgctgagcttcttatgaaggcaagaatagttagttcagttttattagtttggtagcaaccttgatggaaaagatctcataagcaactatttagtttgaattcactgattgagatcaccagctgcagtatgagcctccctccatgtgttggtctggaagtcttgcccttaagcagtaggtgcggaacccaagttacagcattctcagccaacagtgcccaaagaaggcctttgaacagctaaaacatagtgttatttattggttttatcatgggagaggccctcaaatcctttctttgaatccagttattccatttctgttctgatgggatcttacaatgttgcccagactggcctcaggcatgtgagctttagtgatgtggatctcagcctcctgagtcacagggactatggttacacaatatcttacctgttttaccctcattttaaatattgctgtaacaagcgctgggatttcttcccctagtttacagaagattaggattagcgaaaaaccaagatggcagcatctagatgctagaagcaggcataggtgagaatagtgggaagtggcaggtgacagttaggtcaactcaatcaaatgaagttcctgtatcagatgccagggccttgagcctacaaaaagagatatacctgtaatatggccggtatactcaggaatggtgcaatgtctaggtatgcagccttgcaaatattcaaaagagattgatgagtgaaatgattcaagtttgtgctaagtgcagctgcagtggaaaggagggtttgggtggccggaggaggtttctgtaagatcaagtgtgagtggacccctgaaagtgagtgtatctatgaacgtcctgggaggagagagatggcctgcctaagagaagtaacagagtttgataaaggtactatttgcaaaggggcaggtacggaggaggaaaagaggggtcgtggaaaaacagtataagatggcaagctattacagacctaggctgaaggtgggagagaaggggagataccaaactgtaaggcctatagcaattggaaagagccttctgtggtatttgtggaagacagcaggtcctgacactcaacctggacctctctctgagtttcctgtcttcctctgccctggtgtctcttctcttctttttctgctgtctttgttgctggtgtcttgcatgtcacctgttgtctgaacctgcccttctgttgagtttcaattcatgtctttgcccatgtgaatgttctcctttgcaaagcacacagatcacattggtctttgcatagccatatgggagttggatcaccggctttccagaaaatccacatgcatataagggagcgaaggacaggtgtcactcacatgctcatctgaaagctagtgacaattacattattatgaatctcacttttcaaataagatttccagtgctaggggtgatgagatacatcttcaatctctctctctctctctctctctctctctctctctctctctctctctctctctctttctctctgtgtgtgttatattcaaagggcaaacatatcaaaagatgcaactccccatgtgagcactggaagtttgtaaaaaggtcattgacacttgttttctgtgttagctctagagttccattcattgattgccttcttcgggaaatttcctggattgatttcctggctggtgtttgctcatgtcagtgagttccacgtgccatttctgaggtccccagtctatattgtcttgatgagcgtgggcataactctatgatcttgcagagacatattttttttctaaatcctctgctctaggtgatgagggagaagaaattctcctcttgtctgccaacagctactatctgggcagcatgatcaaagtcacttgcaagtccatagaattgatacaggggtggagctaagctcaggatggagacagttgtctggacaaattagggaaaaatcctatgccgaggaagtcagtttaggaaggaagagatctcccatgctagaagcaacagcaatattttagctctgtgcggagacacaggttgggaaccttagctccactgttgctaagatgcctgactttccaaaagctacctgatttgttttctcaaaattcaggaaaggtgcagtgtgtttagattatcttcccccaaggctaaaatatgtcggcaagtgattaagagccttgatctataaaagtgagacctctctttataagacattgaagagtgtggaagcccttggaacacagtgctttctattgttgctggggtatagactgttaatgttatgactaatagggaaattaaatgaaaactgataatacataaagtacgtttgtgtggtgtgtgtattcatggagatagacatgtgtgtttgcatatgtgtatatacatgtgtggagaggcctgaggttgatggcaggaatcttccttagtagttccacatcttactcattgaggcagagtttctcagttaaacccagagctttccaaaactgtgagtacagctgtttccatcctctgagcacaagaattacaggtgagctaccacatgcacttggcattcatgcgggttctatagatccaaagtctgatcctcatgcttcatagcgagcactgtatccgagccatcctctcaggccagctaatgtgtatttcaagtacaaagtacagatacgttaagtgtttaccaaatgtagaattatcttgggccttggagctacccatgtagcagtcccaaaccactcctgatgcttgctgtcttcagtgatacatgggactcagacaagattcacttccaaggccttactatgcccatttgacaaggcgatgctgccattactagctctgaaggggagaaagcaatccatggctcatctcttatttgctctctttcaaaattccactttttccttatgtgatcttcagctgaatgagagggttagaaggcatgtcttcttcagatgctcttgagaaattaacacccacagctttcctcatttgtatcgggaaccaacggtttgtggtaaggaagatagaaccaccgtgtgacaggcttggcttcatgtgaatgccacaggcaaaaccccaggatggtccagcttggcactcccctttgggagcgttctcccagcatcccccacctgagagctttgagggcttttctggtgtccaggcaccccctttttacaggttcctctcacgattcatggcatttgaagtgggcagcacgctctactttgagcattgagcagttcatctaaacaggaatttgcctccccggggagcaatgggggaagatactgtgcactgtaacagagtggggcatgcaagagtgccatctgtcatctatgctcatttgaaaaaggaaaaaatatgattacttttatttggctttttccatgagagagaatggctagcagcgctggcagacaagaggtcacatcgtgactccacgtgtacagcctgtctgcatgggtcagtgatactgtccgatggagatcgcaaacagccatgttttcttaatgcaacagcttcattatctggcccgggagtggctgcacttaggaatttaagagctcagcaaatgatgctaagcggggattttctggctagaaggatgttacggtggagggttttgattgtcaactttcaaggatctggcatctcagaggagacaatctcctgggcacacccaaggagttatttagattacataaatctgtggacatgcctgtgaggcattgtctaattgaagcaggagaggccacacgaaaggcagcttccctgaactaggatcctgggttgcgtccaaaggaagaagctagcttacacaagcattcactgctctctgcctcctgagcactgcagtgcagtgggagtcgccggctcaagctgctgctaccaggatttaacctctctgaggactgctcccttgacctgtgaggcaagacaagcctttctgtccctccgctcctcttgtcagggtacttaggtaactaaaacagatgatgaacactcaaaagaagttaatgcctagttaagggcatcccatttcctgtgcttggtaacaacagtatggtctgtcatagccaggaccttgaggttcaagggttgttttgtccagagacagggaggcacaccaagtaatctggctccttctagctgggaagtccaaaggaaggtattcttaatacagcttaatatcgtcttctccccctctctcattgtttttctccttaatttgcacttgcaattttcggtgcctgtaatgtgctaacgggtttccctcccactaaaaaccatgtgtgagagtgagaatgttctctgtgagaaaagacagtgtctgggggtttgtttctgacttgagggcttatgaggtaggtgcgatgaaacctcctccgcagagggccagagcgccagcttcactggggtcagcatctcttctgctaattgtggcaagagagggagacactccactctttaaggaggtaactgttgcaatctacttggaaatcaagacagaaggagatttcagaccagagtttatgcccagagcctgccttgttcggcgtcaaacttgttaggacaaaaccaattcaagttcatctttcttagccgttgattgttcttcctatagaggatgcctatgttcttcctatagagaatgcctcaagaaggaaggaattggaaagagacagttagggcatggtactagggtgtatgaccaggcccatcaatggcccacatcagtatggcatctctggatgaggatttagagaggaggacagaaggaggaggaggaagaagaagaggaggaagaagagaagaaaaggaggagggagaagaagaggatgagaatgaggagggaaaggaggaggcagacacagtaaacagggtgaggccctagaactcatgtcatattttaagcagagatgcagtagggggcccaagagtagggatttacagagtgttacaggcaagaacaaaactcaggaagactgagcaaaacgatggtacttctcatgcaggtgttgcttgcatgaacatgggtggggcatcatttcctggaggatgggcaactccacagtggctatgccattgaagaacatgactccttctctggaagccaacagttagcagcagatagctcttcaggaagatgtgggaagtctagtgctctcttagaggccccacctccctaacatgttccaaccaggatcccatgccattcccctgtagcaaggtgatttctttaaagttatagaagagaagatagacccataggggaagcatggctatgttaaatttaacagctaagctctacttgttaaaattcatcagcatgcatgctttctcaaatcatgatgacttcatggtctaagtgaaaaatttgtattcctttggaaaattaaattagcatattcaaggcacccgaaaattatctttgactggtagatgttatttctatagcattctctgcctaagaaaacagtgtctctgagacttaagcttggcagctaagagcaagaacccaaggcattcatggtctcagggacttccgtgagtgtttcattttaatccccagaaaatctctgtgaggcgatccagtgctaaattaagccttgtatttcacaaatgaggaatctggagatttgaggggttgagtgaggagtcccagttaggagtggactatagatccagctagttgccaactacaagatctctgtgaccttgaacctgtcctatgtgccctgagggtcggtgggataaacaaatttggacagtgctttctactaggtggtatgaggatcatggtgctataagagatctgtctggggcaccagggtgtgaatgaggagccctactttccatcaagaataaaatgggtcaataaaagcgattgcttattggaattagaagctaagcagaatccttgggtttaagacttctcatctctagaaaatcacagcaatccaagctaacggggtgatggtggcaggagctgtgtgaagacttttacattcattaacctgatagcaaccccagaaggaaggcactgttatttctttaacttttaagatgaggaactgaaggcccagaaccatggaggcacacagctgcaaaaggcaaagctggagcagcccaggttctggactttggcaagtctgaaatatttggtcctatgatgcaaaacaagactcaaggagggggtaggataaggacaaatgaaactaggtgttgagctgccctatgtgggtgtgcccatgaaagagatgatgttattcatgtatcttgaatggggagacgccatctgtgaataggcccttgagttgggccatacagaacatcagtgggggtgttcttcctgtgggttcccctttagaagaactgggcaggccgtttctcacacaagcacctcccagattcattgaggaatgttcaattcttcatgtaaccttggctttctgtcattaactccatctcttgaaacaaggtatgaatatttttgtgccgtttgtaccatttgcaaattacccagtgtttcaagatggtatttgatcatttcactccagtttatgttgtaatggtatacatgtggaagaaggacctacccaagggatttcatagtctttctcaggaggaaataatgcaagtcaagttatcgagtgcctaccaaggacaggccaagctccctggggaggactcttgatcccagtggtctgagtttccacctgttgtctccatgtggccttcatcctctcgcctcagctcagcagagcagttgctgctttcaatggagcagtggtctggatatgctcttgccacattattctattcatagtgtttttacaaatcttcctcccttccacacacctgctcattttcaaaactcagttcagcatttgcttaccaccactgagcttctcgcaccatctcactgagcttctcgccaccatcttccacatctctaatactatctgctctattttatgtctttttaccatatcccgaataagactattagtacacgactgagaacatcatgtggctcacaaaactagttgtttaatgcttgatatgcaccaaaacctttatgctgttgtgccatgattctggcaattacccttgaggaaggttcaacaccacgtgcgtggatacagatgaaacaaaacgcaacatgatgcagcaactctcctaaattcaatgtccagtgtttccatttattaaaccaagcttatggaaatcagagatacctttctggagccagagctcagagagaatgtaccaacaataaagactgcacccatttccatccttggagtctggcagagggtggaaagagaggctgaggtgttattgccaattcagaagacatcccagtcccactccctaggcaggcagaaagaaccatgctcatttttgtatctttgatacatataggcaattgacaacatttttgatgcatatgaacaaataggatgcctaaatttttattttgttttaatatttttgagataaggtcttgccatgtggtatagactggcctcagactcctgacttctctgcctcagcttgcccagttactactgttctgtggctgtgtcctacactcaagagtgtggagatcatcatatggactgtggaagttggagcagactgcactggggagtcagaatcatgttgaagctgacagaaaatggggtagaaggctaattgcatggaaaaaaacatatctgtaaggactgatggtcctggaatgattaatctggacaacagaacgatgtctttgctttctgtcatgctttgtttgctctgtaaattcccaaagtcagggtttttcctactcactcaatgccaggaaaacataagactcttggtagttacttttgatagctttgtccaactctgtcgtgggtctctcagacttccagactcaggctggaccattttgcctgcttgtatcacttgatgaacaggaatcatcagggtctcagactcacccaatgggtttcctttgcaggtgaacatgtttgttgaagggttccatgacgccatcctcctctacgttctggctttacatgaagtactcagagctggctacagcaagaaggatggggggaaaatcatccagcagacttggaacaggacatttgaaggtagggattcggtttccatggtagcagcacagcggccaaataagctgttgcttctgtgattgctatctcctggaacgaagaaccgttctagagtctttctttctccattaaaaaaaaatgtctcatatatattatatcccaaccacagttttttccctccttccctcccagttcctgtccccacctcccttcttcctccaatccactcctccatttcccttccaaaaagggcaggcctctcagagatgcctctcaacatggtatattaagttgcaataagactagtcacctcccctcatatttaaggctgcacaaggccttaatagggcaaaaagggtaccaacaacaggcaaaagagtcatagacagcccccacttctaccgttagtagtcctaaagaagaccaatctacatcggagaggcttcacccagcaactgatatggagaaccacagccaaacgttaggaggagctcagagaatcctatggaagcggggaaggaaggattgaaggtgccagaggggtcaatgacaccacaagaaaacacacagattcaactaacctgggttcatagggacccaaagagacagaaccaacaatcagggagccggtataagtttgacctaggccctctctgtatgctacagttgtgtagctttctctatttttaaagtatggataataagtcaattcaagtcacaaagttcttgggaaaataaggccaaacaatgcaatgcatgtggacatggtttaagcaaattttactgcaataaannnnnnnnnnnnnnnnnnnnnnnnnnnnnnnnnnnnnnnnnnnnnnnccacacagtaagcactttacccacagcagccatctaccttgccctgtgtatttaaaaatcgcattcaacattaagtgttatatactacagaactatcagtgtgaaagacacagtcaggcttagaagcgtgttgacctgggtgtactttcccatgatcagaccacgttggctttagtgggatgcagaagatgttagctgttgtatccaacccagtgccgagagctgcccagccagtccaggcctttggctcttactttcctttcaagacagtgaatgttagctcctgcttaagtaaaaagcagaaaagtgtaagaataacatcaacaaaaagcataccatctcatcattccaacaacctagattagaaatgagactgtgcttgtctgggaaacttaaacagaatacaaaggtacaaaattcaaagtggaagctttgcttcccactccagtctcctttccccaccgcagttgctgtcaacagccgtttcctaggcgagtccagaggtgtgctgtgctttctggtagcatcattatatacccccataaaacttttataaagtggatctcattgtcaatactacttttcactgtagttttatttatattacacttttattttttgtatgtcaaaaaattcatacaggcactcgtagatctaatgcactttaaaatgagaaatgtggttctgccttatagtcatacactactttccttaattctttttgtttattagtcctagctgacctggaacttgcttatgtagactggcctgaccttaagcaggaggcacccctcctgtctctgcctccagagcacgtggattacaggtgcccccagctccagcttctaatctctctttggctggcacattcttcagttggttttgttcttgtcattctgtaatacagtgacataggctattgcttgccttcttgacgttttgtgaatatttctcacatagaccattcctttcttaagatttattttatttatatgagtacatcgtaactgtcttcagacacaccggaagagagctgcagatcccatcacagatggttgtgagccaccatgtggttgctgggaattgaactcaggatctcaactgctgagacatctctccagcctccacagagaccattcctaatgtgaaggattttgggtctcaatgtatgttggtgctttataaagtgcagtgaatattgctaaacttccttttcttttaattggatttgttgattcatttgccaccaaaatggcttctttttcaaattaaaaaaaaaagttggttttaattacatttttcctttttgttcctccctccttctaaaccctcatatatactcctcttgttcttcttcacattcatgcctctttattttcactagttgttattgaatatatatgtatgaatctatatacatatatgtacacacacacacacacacacacacacacacacctaaacatagtctgttcagtcaatataatgttatttgtaagtatgtcttcagggttgactatttgccgaacatcctacagaaaattctgctaatctttatttttgttaatagtgtatataagactcactgacattccaaactggtctgaggtggttcctagagcaggcatcaagtttatgttcattcacccaatccattcaacaggtgtctacgatgtagcaggcactggttaaggaacaggggatgaagcactgaagtaaagatgttgcccataatcaatttctctcttgtacaaatgtgtgcgtgggaaaaggcaagaaacacacagcctattccagggatgataaaataaagaggaatagggatatatagaaagggatgggactctgaacatggcagcagagtgagacccgagggtgacagacgtcattttgtttaggacactgtgctgcagaggaagcaacaatttcattgtagtctgagtatatatggtaggaagttgtcaactgtgaagccgggaagtctatgtgactatgcataaatgggacagtgtgataggacctggtgttcaagatgcaacgagaccagactgatggacttagaaatcctgctgaaatcgaaagttgctttggtctccagggagatggtgtgccttatggctgctctatggcacctaacctgtagtttgctggtgagcatcttcggagaaccattaatacagagtgcagactggggaaacaggaagcaggcgaggccatccttcaggaccctacttgctctgtaagagttctgcactgtgccaaattgtcctgtgagcccttcagtaggctggagtatgcttatacttatttgtgcaacttttcattgaaaagtggaaaatctcaaggacaagaacaaagccaagtgtacatttgagagaggtatacaggatggtcccctctatcttctctgttttatggcctcagctcatccccagagattaaagggaagggcagtagggaggagtggagctccagatgggcttgtctgggtagtagctatggtagctactgctaactttctatggtattttcagtgaacaccatgttttactctacacaagagtgacagctttcatttcagacaagtagttgcttgggggtgagtaagctccctggatgaactggcttcttcctgcttcagctgaggagcaggaatcgaatagggtaattcagggggcatattaggacaaagtcgggtttcccagaagttgtgcacaatacaccgagaaactggtgtgtggggacacaaccttggtcaggcacatcccattcttagctattactcatggcatggtggtcatttgttcttggtcttctgacagcgggacaggagccagagttggggatgctgaaaggcaccagtgaaggaggttgttgagagaagggcaggtgcccgcaatggctgggatacagttttgtttagagccaagacatgcgctaaattttctcttacaccatcttgatatttccattttagggccaggtctacatagtcagtatgcatcaagagtataaataactgtatagttgattctaaaactattaccttttgtgtccaaatataaagactgatgccaaggtaagtttggatttgaatggtttggagtctattttatttgctaaacaatagtgcatttgaaggtagcccctcaaagaactctaaagtagatgtgtgaagaaaaactcaaaccttcctaacattaaaaacaattttaattttagtggttgctgtaagtgaccattaagttgtcaggagaaaaaataccctggatgttatttgacaaaattggattttattgccatgaaacctatgatcaactctgaagaccttcaataaatggtccaagaagaagcagtgtttcctctgtgtgagaggtcagggggacaaagtaaacaggactgtggcacaggatacaagctccctccactctaggcaaacagaaactgggtggaaagaatcactgctgatacacaggaaaattctgctctcagctcgacaacttcaccttctgcctgatagtcccaggtgaagtctcacttagcaaagcagtcgccccaagagttctcaccctatttcctggcagaatcgcaataacttagaggtgtaatgaggtcttggactactagggccacttcatcttataatactctgcaaaacactcaagcaggacacgccttcccaaacacctctgaacagaatgacaagtgatttccaatagccacaatatttggagaagaaattctatatctgtatctatctatatctatacatctatatacatatgtatatatgtgtgtataaactatatgcatattatttgaagttttatacacccacccaaggatacacaatatggtaataggtgtatcctttgcaacctgcctgttttaagaagacaaaaaatgtagacgaatggcacctctattctgtttccagcaaagtaacccaaagtctggaaaaatcagtggaccttcaaaccacagcccaaaggacagtcaacccaaaagactgcctctccaaaccacacaagaggatggaactttcccctgggatgcttcctagcagacactcttcttactgggacagtcatttctactggagagagccaaatcaatggaagcaccaattaagtacaacacagaattgtcccacaaagaaaataaatggcctttgctcattagagcagagctggtgcacacgtcctgctgcttagtgaatgaagactgaaataacagcctatttattatcagccactgttctctggtggcctttcagggatcggctgctgtgagcacccatcgtgctggtcaaggtgggtgggtcctctgtgttctggctgatctgctccagcttcatatcttttcatatctcactggctctggttataaatacagacacccttcatcagaaactccacagttctctggttctttcttgcctcggggtctttgtgaattaaaccagtttggtaacgtaggcttcttgatagtggtggtttcagtcataggtttcctcctatgtactttcatggggattttataattctcactcttttactgaactccaccttgatgtgttgagtcttctggagtggttgagcacagtcaagtgctttctgtgacattgaaagcacagtgatgataatggcaaatttagaataccatccttcattcccaaatccctagctcaaaatctcctcaagtgtccaatggaaactttcttataatgaaggattgtttcatgcaaaacaattctttaaaatactgtattgagaccaccttctggctatgtgtgcaagtgttatatgaaatgaagctttattgtgtttagagttgtgtcctaccctcaagatgtctcattatgtgtatgcagatattcaaacaattgaaaacatctgaaatctgaaacacctctggccccaagaacttcagctacatccaacttgtaggagtaataatagcagtaggggcactggtagaagaaaacagttggcttcgtttaagtatctgttgcagatgcctccagtgtttaatctcatgcatgtatctctacatcctcttggtaggaacatgatcctgtttatgccagttgtagagaggctcaggagaccaataaccttattctctctctctctctctgtctgtctctctctctctgtctgtctctgtctctctctctgtctgtctctctctctctctctctctctctctctctctctgtgtgtctataggtgtgtcacagtgtgtgtgtagaagtcagaggacaactcttgggagtcagtttgctccttctaccgtgtgggtcccagagatcaagcatgtgaccagtctggtggcaagcaccttcctgcacttcgctggcccctccttcactgggctgaatgctcagtctaggcctctccttgaggaaagcattcttttgcttaaacttatcctctgctgcaatgctaactcagtccccgcaggaatctttccgatagtgtttggataaccaatgagtgagcacacattaggcaatgctccttagacgttggccgcagagactcaacaaccaggcctccagctttgctgggtgctgatgcagttcctgtacgatgatcactcactgacttctgggccagcctggctttctttatgagagttgtccaatgatcaagtcaacctatgtgcgatagatgtttacctctctgctacttcttagggaaaaaaaaatcaaaactctagaatgaacacattgtttcggcatggtccttaattcattttttttaaagtgttccccaaagatcatttatttctctttcttttcttttttaaatggagaaatgttaagaatttaggaatgcagacacagatgaaattacaatgtctttccaaatgccaacaaaaatgctcccagtctgatgtgattccctgtggcatggatttgtttaaaaaaaaaaaatcccattaattcgttttcttggcaggcagaggcaccataagtctctaactcagttctttacctctcctgtaggtatcgccgggcaggtgtccatagatgccaacggggaccggtatggggacttctctgtggttgccatgactgacactgaagcaggcacccaagaggtgagagaaggctctgctttggtgactcgtgcaagtggggtctctgagggtgtatttgtcccggtgtccaaagcttgcttcaaataaaaatgaacctttccatgcagtgaaagctcactgatgattgagggctcaggcagaaggcaggacgcggcgccgtgtgtgctcttggtagagaaagcctacctttcaaatggtcaagagtctctcctcagaactgggtaataagggcatccgtggacagaggaagggcagcttacttgcctcttgcatttctgaatttcattttctagtggttgttacggatttgcaggtgttactattttaaaatatagtggagtctgaggacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctctctctgtcgacaaagatttgtaggagtcagttatctcattccaacatgtgggccctggggattaaatttaggtcgtaaggcaaaggcctttatctcctaagttatcttgctgttactgtaaatatttagatttatattaatctaactgaggaatgtgggctgtgcacctgtcgcatacttcacttgagcatgtatgtagtggcactggctctgtctcatattcttaagggaaatggacctaacacatggctgacagtgtagactgctctgtggtagaaggccggataaggctctatggaatgagcaagggaaaaacctgtaaatttatagattattgttttgtagggaaatcaatcgaacaaacaaacaaacaaacaacccacccttcccactatgcagtagcacctgataaatagatattgtcagcattggtaggctgtgacctccagatggccctcaggtggcactgtctgttgtgtccacacctttttttaaaaaattaggtatttatttcatttacatttccaatgctattccaaaagtcccccacatgctcccccatccacccactccctagtgttcctctgtactgaggcatataaagtttgcacaaccaatgggcctctctttccactgatggtcgactaggccatcttctgatacatatgcagctagagacacgagctctgggggtactggttagttcataatgttgttccacctatagggttgctgatccccccagctccttgggtactttctctagctcctccattgggggccctgtgatccatccaatagctgactgtgagcatccacttctgtgtttactaggccccggcatagtctcacaagagacagctatatcaggatcctttcagcaaaatcttgctagcgtatgcaatggtgtcagcgtttggaagctgattatgggatggatccccggatatggcagtctctagatggtccatcacctttctaagcctacatgacttggcttttttccctgccaggaggagccgctgaggcagtcacagtgtgcactccccccatttcccatgcttttctaaagctcttgctgtcagttcctgaaggtggtgatgtgcagagaccagggcatgcgttttggagaatgcctgcgaggctgtgagcgtggtgcctcctttgggaagaggtacctttggcctgaccttctgtctgtccgtctgacttttgcctttctgtaggtcattggtgattactttgggaaagaaggccggttccaaatgcgatcgaatgtcaaatatccttggggccctttgaaactgagactagatgagaccagaatcgtggagcataccaacagctctccttgcaaatcatgtaagttcagagacttaatttactgtcctccttctcccgtcccaggatcacatgagtctggaacatgtttctctcaagaactcatgttctgaaagtcccatgcatttttccgatgtcttcaaaaccatggaaacaactcacaaatggctgaccctcctcctttaccggaagcttccacattcctttcctttatccttttcttccaaatggtagggtattctgcctggatttatatctctcactctagtctcttagttatcagaggtttccacttttaggaaaaataaaaatgttatcagctgtctcttgttcatctcttgtaagaagtttcattattgatttcaaagttcacagttgacctccaaatccccaaatcctccaaatggggcactcaatgccattaaatgcttgacagcttgcaaagtatttaattaatttaataactattgaatatattattaacggtcagtttctgggttcaaatagagaagcaagtgtgtcttcttatgaatagcacagcaaagggagacggtttcggagatgattgtctttgaggggctttgtaatatgagtaagaacaagtgatgtcaatcttgcagggcagttagtgattttaggtgactatatgaacgatcattatgtctcaggaccatctttgttttttttttattgcgtatttttctcaattacatttccaatgctatcccaaaaaattcccccacaccctcccccccccactcctctccccacccattcccattttttggccctgttgttcccctgtactggggtatataaagtttgcctgtccaatgggcctctctttccagtgatggccgactaggccatgttttgatacatatgcagctagagtcaagagctccggggtactggttagttcataatgttgcacctacagggttgcagatctctttaggtccttggatactttctctagctcctccattgggggccctgtgctccatccaatagctgactgtgagcatccacttctgtgtttgctaggtcaggaccatctttgaatgatgaggaatttatatccatgtgataattatgagaaaggatgaaggagaaagtgtgttgacctcataatcgcccagtctgtattccaaatctcacactcctgcttgccagtttggggaccctaggagactcccctcaactcaccaagtctcacatttccagcatgtaaagggggtttccccagctttgatctgggcagccaaaatgtccatgcaccacaggctttatttgaaaccctgcaaggaaagtagctgttgagttttttgagaacggtgatcctaccgagaaagatttaactcaaacaggggttcacattttcacaaagctatataggacagtttggattggaactctgactttggtgagagaacatctaaaaacagaatactgacccagtgcaatctcccggaactttctagcactttgaagtgtcaccacccacctggagagacagaagctctgggccagtgcctttgtccattcacgcatcttcgcctttaaactcaaaaccaggatggatgtgtgtgagatcttcagtttgcagctttcatcagatccatcttgaatctgtctctttctctgtctattattctctctaaccttcttttcttccttcccctctgttctctccattctcctttcctgtcacagattatgctatgtggttcagactggcctcaagcttaagcgccttctgcctcatattcccaagtgctagggtgactggtgtttgtcccaggtccgactttgaacttgttttgaccttgctctgttcactctcgagtcacggtgcatttatctagtgttttctggaaacctttcctcagagcattatacatatatattttacattataggttacatataatactatatatagtacataaatattatatgtaaataatatacaatatgttacaatatattatacatatgttacaaagaaaggcaaattagtttcaactgggagataaacaaaagtcaaagtattttaacttatttctcaaaatgaactctgattattgatgtttctttttcaagcaggtggcctagaagaatctgcagtgacaggaatcgttgtgggggccctactaggtgctggcttgctaatggccttctactttttcaggtatggcccatttatggagttaaagttcaccctgcttcttttgcctttgtcccctgtctttgcaataatgttccctgtgatttgcccacacccttcttttaaacaagaaggatggcggttaaattaccaaaactgttctctgactccatcttgggtttggtaggcagtgagcccttgattcctatggtacttgctagaaagtggctgggatctcgggatcattgatccatttatgagaattacgaacatctacctatcaaattacaaacatgaagagtctttgtatcaaatacaaaaatgtggacaaagaatgaactttctatccgcagtctttcttcggtttagaaacaagtgctcatgctcacttgaaaggctggaaggagcttcagtggtctgtgaatccgggctgcagtgggttctgtgtttggagaagtcacatgtttagctgccattgttgtggcttaagtctcataaacttttaattatgcgcatgtgttcaaggttctagtcgtttgctgcagcgacagtggcccgtcctttggtaatcttcagtggttgaattcatggggcattgtaaatcatcatggtttatttgtaatatttcttcacttttgcattggagatgtaagtctgggtgtatgtggctctttgtgggaacaatcgtgttcctgttcctttggtcacagtacatttggtctgatctttatctgggggcacatcctgggagtcaagcagagcttctggggcagaatagataagactcccagggaagaaggggaaggcttgttctgtggcatttcagaaagcatgccaatttttctccctgaataaggacacgatgccttgggggtacacgactttaatctcagaacagggtttcatatttgtgtcacttgtcatttatcaaacctaacccagatgtccctggagggcactctttgtaagaggaaccatggtgttttacagccaagtgaggttttattattacatttgttttgcttttacccaggaagaaatacagaataaccattgagaggcgaaatcagcaagaggaaagcaacatcgggaagcatcgagagctgcgagaagattccatcagatcacatttttcggtggcttaaaagagatgcccctctcgcttcgtctacttgagattccttaaagagatagatggaaggacagacatcaacggagcagaaagggcgttctcggagaagtcattcttttaagcagtagtcatttcattttacattttctttagaagctcaggaatgattgttaatcactatctgccttctggcctctcatctcatggcaaactaatataatgaaacaacgcaatgctgttaagtgttctggctgctggaggggcatcagaggagatttatgtcttgaaagtctgctgcgtccatatcttgattgctttgggggcagttcacacgaggatagaaaaatgtggcttttctgaaatgaaatgtttcgtagctaggataaaacaatttttacaaggagaatattcttggaaagaatttaacacccaataagaggacaatggaatgaaagaaatctccaggctgggaatgcagtgcccctctctctggaactgggggacaggtttgtggttgatgaaggctgcgtccaacgtccacattcaggtctgaattcatatctcaagaaaggatcctccctgtctcttttagtgtctcatcagagctactctggaaaactgtaaatattagtgagcaaggaggatttatataagaaaattgagtctaaaatgcttcttatacgatgtaaaaaaagtcctacttcacactaacattttatttttaagtattttaatcttatattttggtattagaaatgtgtctattttttcattttgaagattaaatttcacttatattttaagagcacggaggaggtgtgtgacaaatctgtggagagggaggaacggttctcgttttctctgctgtcctctgtcccttggctgtctctagtctaactgctagtctggctgaagatgtacagaagtctgttcagcttacaaactctgaaggaatacgttgatgttaagccgttgttcattttcaactgttttaaatggatgttattggagggctacattctttctaactatggtcaaatgatgcccttcaaaaccagtagacttaagtggagtctataaagaaacacaacccctttccctcaagaataagcagacagtgagaatttgacagcaagacacagtggtgatacgtttaaaaaaaaactgcatgcaatttatcaaaatttgaggtgatgattttaatttaaaaagggaatgttgatatctgctgtgtccctttaaccttatagagttttgcagccaccacaaatgatgcatagcttggacagtgagctaggacagacaagggcatcgtggctaagactgagccagcctttgctgggtatcctctttgcactcaatcctgggtgcagaggtttcaattctggttccgactttatcatttgaggagagaacaagggtaccgtcttgtaattttgcctttcttggtaacattctgagcatctgaaacccagcttaaaggggggaaattaaataatttcttggaggtcctatccatccaggttaactgtggaggagtccaagcaagcttagcaagctctggaagctggcttcccagggaaggagtggaccacacctcattctctcagtggagtcaaagtgaatgggctgcacctgtgtggggctcaggaaacgggatgcaaaccgcatgataaaatgaattagcttctgaacaactgaagggggtgtggtaggaggtatgtcgtggttctgcctgtgggatattgagggaaaagtgctgacttaaaaaaaaaaagtaggccagaaaggcaaactttaaaatgctaatccaggaggcgcgtttgtggagcacaactcaggaaggctgcagctgatggtcagggactcacataatgaagacagatgggcagactgcatccaccccagttctcagaaccagagggctgcttgtttctctcttacattttcaatgatgttttccctgtgtttcagagatactcattttttaatgttttttttttttgaacctgtgtgttaattgcaggagggtgacagtgggaaaagttctctacctggctatattctttgggtatgaatatgtctaatcctttcttgaatttgtatagtttccccttgaatgtcagcatagttacaacagtattttttatttctgctccagctagaggaattgttccaaggttaatagtggatccccagattagatgttaaagaatagattagatgtttaaaaaataaataggcagggtgaatcgtgaagtccctggagtcatttcctacaattttaaagcaattcttattatattattatattattattaatattattaaggttgattgctcatttacatgcctgctgtatagtttgtctttcttgaatgtctttacatggctagacaaggtggcccatgtcttcaattccagcacttgggaggcagaagcaggaggatatcagtgagtttagggccaggatggtctccatagtgagtttcagatcagctgtagttacacagttagaccttgtctcagaaaaaaataaatcattatatgagtagccaaaatgtcattaagttttaaaaacaccaccaagttgggaaacctttgctgacagtatagatgtctgttccatggtggctctgggttaaaaactcttggtattgtattgtagaacttaaattcttaactgctaagcaacaactttgacaattagtcattcataatctgccagtagtcatctattatataattaacaaaatggaactttagttcttaagccattctataaatttttactcttaagtccaatgatcaaggtttcaaagggggggcatttcattagtgttttttatatcttgtcaaatataagttcatacacaagctaaactaagcgtatacttatggtgatggaaataaacacaagttttatagccaatattattgtcttagatctgggagagaagctgaactcagaaacaaaactttctgggtagagtcatatctgttcccaacacaaacagaggtttcacacggaatccgtcaacatgtattgttttgaagagccattggcgtgtcttttcctgaaccacagacagaattccacatgtcttgaaatagttgtttacatttcagaattcatggaggagagggagaatcctatggaatgagaacagatgccccacccccacttcctttttctcttgaatgaaaagctttggaatgccaagtcacttccccttgcttacaggcatcctgtgcctttgctcctggcacatctaccttctgtgtccctaacttacctcttttcttctagttgggactgattgtcagggtctaagacatgcagtgggacgtggaaagggaggccttgtgtatctcagagagtggtttcagaagctgtttctagtgatgccattgctttcttgaaacagagctactcgtgcaggtgttttagatgcgtcacaagtgcgcgcgcgcacacacacacacacacacacacacacacacacgaaaaaagagaatgaaagaatagcatttataaattggaaaacactagggtctgtgtttgttgagacacaaagagctcagatccctaataggtgcaactacaaaggcaaatgccaattgaactttggcccactacctatttgtgtagttataccctacaggtctttagaagaaggctggtaatgagctgaatttttcctttagtggaaaaaacagaaactgtctagaaatacaggatgctttaggggcagcatagaagtagggagaacgagccagaggcactggagggatctgtctatttttcagttggtctttagaacagaataatgaacagtttagaccttcttcaaaagccagtctccacaagaagtgctggacatgcccagagagaagaaccaggagcttatgtctctcaaagtgacagagagaagaagtttgcagctgacacgggctcaactgttcttcatagagctccacctgctatccatcacatttctatgggtgtgctagcacctttcccatgcaggtggaaacttgtgaggaggcctcctcatttactcagagaaaaaagacaaaatcgcaccgctgtgaggaggtagctggcttctactcagaagcctgacagcaacttgaccatgcatgtccttggacagtttacatctgtgattttcatgtacgcgaaggaacctggcttttttctcagcatatggatttttccgatgtttcctgcaggcctatggaatgaaaatactcctccaaaggacactgagttggaggttgttcaaatatcgcattaaccactaatgttaattcatcccaaatgcagagcatttcccaaatgctgatgctggtgtttctgttttaagtcacttcaaaggtaatcaaaaggatttcagtgggagctgactctcagaggtaaaaataaatatgttacaaaaactctttggtctatcaggtatcatacgattcctagtggagagatttgaaccaagtagacctcagagttaataaaacatgttccatttctttgattcatatttaaaggcataaatttatatgcacaggaccaggaggtccatttccccaagtgtgaatcataataggataccgagttcatttttactttctagaataaagctgtcatagtctctacttattattggggagagaaagagttatttctccagagaaagaggaaaccatggcttttgatggactatctcattcattactcagtgcctgtgtctgaacgtgttcaatatggtgtagcatagaagacagcaaggaagtgctctcaattggccaaaatcggagccttcttccctgggcatcgctgaaaccaaggggctgtgagctaagcatggcagaaggccagtccctcagcctgtgtcttttgagccattttgttcatggataatttaaatatgaccacaaaacaataaaaacgtaccatgaatctggtagaagagtcaaagctgcaccagctacatatagcttcctattctaatgtaagtagaactgtctgcatataatgtgatttaatttattgttgttctgtgtagaaagtgaggactcatgactgtggataaagccctgttttgtataatatatatatatatattttttttttttgtgcaaaattggtcatttaagcaatctacttcatttggtgtttggatagaaatgtgcgcgtgttcttgtaaaggtttctattcagcaagaataccacatagcccaaatataacagtatgttctcattaaacgtatactctacagaaacagtttcctgtctataattcaacaaatatgcactgcatatatccaagttttctgaggattttctgttctcttagataagctgaagtaaaagatcagttattggggatgatgtatttgaatgaaatattgagtccacgaaaggactcaagattttctgctccacaaaaggaaatttacagagattgtgacatgtcattggaatgagcgccaaacccagaaaatactgacttatcaggtaaaggaggcatggagaataacccctcttttggaacctgggcatctttttccccccatctatttattcactttacatccctatcaccgcctcccacctgtctccccatcacacagtccctcccatgattccaccttccccttctcctctgagagggtagagcaccccctgggtataccaccacttgacatatcaagtccctgcagggctaggcacatcctcttccactggagccagacaaggcagcctagttaggggaatgaacctgggcatcttgagatattacatgctccagctgatgtcattgattcatgttattgtgttcatcacccacagtacagagaaattcagtcctaatttgcaaagagctctcaggcttctgtgtcctagggagattgaccaacttccagcatttctagcttcatctgggctgcaagaggccatctcaatctctggaaagtcacatattcttatgcctgagaaacacatagtgattggcatggctgaagcagtgtccccttggtcctgatgccatagtcatggaggtccctgagtgaggccacaggtgctacatgcactgggaacatgtttgaagtgatgctggagcaggatgttgattggagtgaggcatcatgggaaggcgtggtagggatgaggggcaaacctggagatgacctctaggaaaaggtattcattcttgctactttcccatccatctctagggccatggattccttgattctttccctctctccctttagctcagtcccctcaaaacacgatattcagccagcaacttttgacaggccaaggatgccttactgggataatgggtctatgtcttatcaaggatccccgaggagacccagataacaccgatttagggatgtgacccaaccccaaaccatgaacatctagagttgccttaagtagcaactattaacgtcaaaggtaccaatggcttcacacctttaaaaaggagcttcttcccaggccatctgctagcaccaaaatggagccaaggaaaaagggttcctttcacaggcttagtgtaaccctcccaatcaccagcggcagaagttcccaagagcagaaaggaggaaggccagaggtggctgtgagcaaagacctgtggactacatatttgtgggagtagatacgctgtttgcttctgggtcacttgggtcccttctgtttcatagcttggttctgacccttgagctatgtgatcttgtgtgaaaaacgaaagcaatatcagttacaacctcaccggattgccatgacttcagacttcgactcctccatggcatatcataaaacattcaacagatttgtcatacttgttggcttctgcaaaataagacaaatgcacaatactttggagggctttcaaggccaggagagtcctggtaaaagtcccagtcagtttcctttcttctcagtctgattgggtggcaagtggcctctgcctcttgataatgaagtgaaactctgaagaaggcatagacaaggaccaaagggagactgtgatagctggatgatttcagagtgctgaacacgtacatccaaaaacgcgttctctcaccagagtggaggggctaatgttgaacctgtggccatgtcatgcctgccttctgcctcctctattgctgacgcagtcctttggattctcctcagaattccctcctgtgaagctgtggtttgcccgaaagaagacctttgtctctcagctgtcataaggaatagctttcctactattagctgccctcaggaccaggaatacgatggatataatgctttcgtgaagttgtgaccaaattatctaacagaaacaggagaaagaaagatttattttggctcttggagtcagagggcttggctcatggttgtttagacccatgtttctgggtttgtgtgagacagaacatcatgtcagagggcacatgtagaggaatagataggctattcacaggaaccagaggaaagggattcaggaggggaccagaatgagccgtagtcccccaaacatacacccagtcatttactttatctgcttagaccccatctacatttaaccaactcccagtagcatcaccagatccggatttcaccaagggaccattctatctccaaaagcccaccatctgacaatcaaactcccaagcctgatcctgttggtgacacttcacatttaggtaataacaacaggaatgctatcgagttctcccaccatgcctcactaagaggatgagaccactaagtagctgtcctatgcagagtggtcagcctggaaactacatgcacacatcctgtgaaagtggacccaacagtctatatgtatacatacatacatacatacatacatacacatacacacatatataatatacctatatacatatatacatgtgacaataataatcaaatgaagttaagttatcagcttgaattgggggagcatgggaagggggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacagagaggcatgaatcagcatgcaggctgagagagagcacactacaggggaggttgtgggattccaggtctccagagagccttcctctttccagatccagcagcctcaaggccagggtagtgataaccattcttccagaagagacccagaacagggctgccttccaggctgtgcaactcttctgccatgaagcagagtggtcagagccaggcattctctggtggggcagaggttagcctggggaaggcttgagaaatagcagttgttcaggaaagacatccctcaaagcagaaatatcctgggtggtcttaaaggtatttcatgcttcaggcaaacgtcgagcaagagagagcatattgaagcaaagcttgccgcctcatgtcttaagtgtgcacaccttagactatcctccgcatttcactcagaagggaagtgcaaagcatttggagtgcatgccttctctgttggaggatgctaagtgtctattgagggccacccgcagcccagggttgggctcagcatctgtgttccctccttcaatttcttcagctctgtgacaaggttggttttcctcctcgcctcagagatacataaactgaggcgttgaagtaacctgctttgggtttcaaagtgatcaagaggccagagctacagtctcaagtcaggcacccggctctcggtggtggcgtcacccatccatttagtaataagccaccgtcattttctgctctctgtgagtgacttctctttctgttaccatccatgtccagtcagatcccagctcttcatttcaccatcactacatgagacctgatctcctgatcccaaggaagcagggaagagactatttcttcactctgtctctgagcattcttttccccctctccttcctcacacaaatgctgcatcctgcattcctgaaatacttggtgcatttgataccctgagcctcttgactctcactctccacaggtcagattccacaatctgtcactctgattctttgaggcttgtggcactggcttagtcactatttgtctggttcaggaaaattgtgctgaacttgatgacatcaactgattcctttcttgcccagaaatcatctctttctttcttgtcagactttttttttttttttttttttgaaatggtcttatgcagtttggctagccctacacttgctacagagccaaggatgaccttgaactccagactccttatcctctcccctcccctcccctacctttctggctctttgtcccccgtgttaaatagcacttagtgtgggtttaagagtgacttgatggctgctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1790 - DNA, 1611 bp, Mus musculus
atgcggtccttgctgctgttcactttctcggcgtgcgtgctgctggcccgggtgctgctggctggcggcgcgagcagcggcgccggggacacccggccaggcagcaggcgccgggcgagagaggcgctggcggctcaaaagatcgaggtgcttgttctattgccccgggacgattcgtacttgttctcgctggcccgggtgaggccggccatcgagtacgcgctgcgtagcgtggagggcaatggcaccgggaggaagctgctgccgccaggcactcgcttccaggtggcctacgaagactcggactgcggcaaccgcgcgctcttcagtcttgtggaccgcgtggcggcggcgcgcggcgccaagccggatctcatcctggggcccgtgtgcgagtacgcggcggcgccggtggctcggctggcgtctcactgggacctgccgatgctgtccgcaggagcgctggccgccggtttccagcacaaggacacggaatactcgcacctcacgcgcgtggcgcctgcctacgccaagatgggagagatgatgctcgctctgtttcgccaccaccactggagccgtgcagccctggtctacagcgacgacaaactcgagaggaactgttatttcaccctcgagggggtccacgaggtttttcaggaggaggggttgcacacgtctgcctacaatttcgacgagaccaaagacttggacctggacgacatagtgcgctacatccaaggcagcgagcgagtggtgatcatgtgtgccagtggtgacaccattcggagaatcatgttggcggtgcacagacacggcatgaccagtggagactacgctttcttcaacattgaactcttcaacagttcttcctacggagatggctcgtggaggagaggagacaaacacgactctgaagctaaacaagcatactcgtccctccaaacagtcaccctactgaggaccgtgaaacctgagtttgagaagttttccatggaggtgaaaagttctgttgagaaacaagggctcaatgaggaggattacgtgaacatgtttgttgaagggttccatgacgccatcctcctctacgttctggctttacatgaagtactcagagctggctacagcaagaaggatggggggaaaatcatccagcagacttggaacaggacatttgaaggtatcgccgggcaggtgtccatagatgccaacggggaccggtatggggacttctctgtggttgccatgactgacactgaagcaggcacccaagaggtcattggtgattactttgggaaagaaggccggttccaaatgcgatcgaatgtcaaatatccttggggccctttgaaactgagactagatgagaccagaatcgtggagcataccaacagctctccttgcaaatcatcaggtggcctagaagaatctgcagtgacaggaatcgttgtgggggccctactaggtgctggcttgctaatggccttctactttttcaggaagaaatacagaataaccattgagaggcgaaatcagcaagaggaaagcaacatcgggaagcatcgagagctgcgagaagattccatcagatcacatttttcggtggcttaa

SEQ ID NO: 1791 - protein, 536 aa, Mus musculus
MRSLLLFTFSACVLLARVLLAGGASSGAGDTRPGSRRRAREALAAQKIEVLVLLPRDDSYLFSLARVRPAIEYALRSVEGNGTGRKLLPPGTRFQVAYEDSDCGNRALFSLVDRVAAARGAKPDLILGPVCEYAAAPVARLASHWDLPMLSAGALAAGFQHKDTEYSHLTRVAPAYAKMGEMMLALFRHHHWSRAALVYSDDKLERNCYFTLEGVHEVFQEEGLHTSAYNFDETKDLDLDDIVRYIQGSERVVIMCASGDTIRRIMLAVHRHGMTSGDYAFFNIELFNSSSYGDGSWRRGDKHDSEAKQAYSSLQTVTLLRTVKPEFEKFSMEVKSSVEKQGLNEEDYVNMFVEGFHDAILLYVLALHEVLRAGYSKKDGGKIIQQTWNRTFEGIAGQVSIDANGDRYGDFSVVAMTDTEAGTQEVIGDYFGKEGRFQMRSNVKYPWGPLKLRLDETRIVEHTNSSPCKSSGGLEESAVTGIVVGALLGAGLLMAFYFFRKKYRITIERRNQQEESNIGKHRELREDSIRSHFSVA

SEQ ID NO: 1792 - DNA, 95835 bp, Homo sapiens
agcttcctcaaaacagctattttgaattctctgtctgaaagatcacgtatctttgtcttcccaggattgatccttgttgccttatttagttcatttggtgaggtcatgttttcctagatgatcttgatgcttgtgggtgtttgtcagtgtctgggcattgaagagttaggcatctattgtagtctttgcagtctgggcttctttacacacatccttcttgggaaggctttccaggtattcaaagggacttgggtattgtaatctaagtttttggtcactgcatctgtatctgcattaggcggcatcccaagctcagtcatgctgtggcttttgcagacttatataggtactgccttggtggtcttggatgagacacgaaagagtactctggattaccaggcagagactcttcttctcttccatttattttctgccaaacaaacggagtctctctctctgtgctgagctgcctgaagccagggaatgctgacataagtatctctgttgtggccaccaccactgggactgtgctgggtcagatctgaagcgagcatagcagtgggtattgcccaaggtctgtagtaaccactgccttgctaccagttaggttcactcaaggccctgaggctctacaattaacaggtggaaaagccagccaggcttgtgttcttctcttcaggatgctgagttccccctgcccctgggtaggttcagagatgccatccaggagccagggcctaaagttggaaaccttaggatctacctggcgcactagtctactgcggctgagctggtacccaagccacataacaaattctttttttaaattttattattattatactttaagttttagggtacatgtgcacaatgtgcaggttagttacatatgtatacatgtcccatgctggtgtgctgcacccaataactcgtcatttagcagtaggtatatctcctaatgctatccctcccccctccccccaccccacaacagtccccagagtgtgatggttccccttcctgtgtccatgtgttctcattgttcaattcccacctatgagtgagaacatgcggtgtttggttttttttgtccttacgatagtttactgagaatgatgatttccaatttcatccgtgtccctacaaaggacatgaactcatcattttttatggctgcatagtattccatagtgtatatgtgccacattttcttaatccagtctgtcattgttggacatttggtttggttccaagtctttgctattgtgaatagtgccacaataagcatacgtgtgcatgtgtctttacagcagcatgatttgtagtcttttgggtatatacccagtaatgggatggctgggtcaaattgtatttctagttctagatccctgaggaatcgccacactgacttccacaatggttgaactagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcagccacatgacaaattctgtgccactattcctttcccttttcataagcaaaggaatctctccatatggtcatcaccacttcaggattatgatgagtacttcctggctactgctgatgttcactcatggcccaagcactcttcagttagcttgtcataaatgctgggcctgggagtctcccttcagggcactgggctcccctctggcccagggagtatccataaatgccatctaatggcatcttggggtctccatttccaagagccaaggcctggaactggggaccccaaaagcccgtttagtgttctatgccactgtggctgagctggcacttaagctttgagacaaagccccctttactattccctttccttttctcaagcagaaggagtctctcccagtagtcaccatggctgggaatgtgctgggccacacctaaagccagcatagccctgggtttcaccaaaggcccacagcaaatacttcctggctattactgctgactattcagggcccaaaggctctttagactgcaggtgataaatcctgccaggactgggtccttcccttcaaggcagcaggttccctccttgcccagaatatttctagaaatgtcatctgggagctagggcctggaatgggggcctcaggactccttttggtggcctatcctactgtggctgagctggtagccaaattgcaagacagtcctcttttctcttccatttcttctcctcaagtggaaggaaggagtctcttgtggagctgcaagctgcactgcctggggttgggagagggtggggtgcaagcactgccttggccatcctggctggtgtctcactaggtcatgtgtcccccacatccactggctccacgcctagcacagcaccaggacttgcccacaaattgcagtccctgtggcctagactgtctttcaagtttatttagaacccaaagcactttagcccactgtggcaaggcttgttgtatctcaggttccaaccactaggatggatgattcccctttggttagggctagtgtaaatgctcccttcatgggcactggctgagttctgcccagtatttctttctgctgttaaaaggcagcactgggtcccagtgcaaagtcccacagtcattgcactctgtctctcaagtgcacagattctctctccacaccacatggctgctgctgggggatgggggaaggttggcattggcaattcaaggctgtctttcctacccttttttaatgcccctttcagtgatatgaaatgaaaaccaggtactgtgatttatcatctggtttttggttcttatgaagtgttcttttggctctttgtgtgtgtgtgtgtgtgtgtgtgtgtgtgtgtatagttgttcaatttggtgttcctgtggggacgacaactggtgggggcttctatttagccagcttgctctgtcttccaaatgatatctctattttagaaatgagaaaattgagaaagtgaaggttaaacaggttaagtgataatgcgcagacattttgatgaggcttctaaatgcatgatcttaacacagtataccaccctggagactggatcccaacccagacatattttcctgcaaatggaaatacaatttggtgtgatcacaaatctgagcaatgttatggaaactgagatgggagaggagatcatttctgaggccattacaagagagtaagacccaatggctctgcaacatgcgctggcgtttgcacatggcccagtgcccatttcctgcactccccagccagggcaggaaagttttctaaaatttgattttatgtatttgtgtgctttctcaaatcctttttggaagaaggcagcgtacaactaaataaatccattaaacatagtcagtattggtatgcatgaagttgaagtgcatataagtggtcttcaaaaagtttgtggaatatgtgtattatgaaaaaaactatgcatagatttcaaaattattttttaacaaacttatactaactttttatgacatgtctgaataggattcaatttgaggcactatcagagcaaaatgaattctgctgaaattgaagcaaggggaaacattaaatttacagtgaagcttgggttgaaaaatgctgaagtaattgatgctttaaaaaaagcttgtggggacaatgccttaaggaaatcagaagtttacaaatagataactcattctgagaaaggacaagataatgttgataatgaagcccacagtggcagaccatccacatcaagttttgagaaaaaacaaactaaccaaccaatcttgtttgtgcctgtattagtctattctcacactgctataaagaaatacctgagattgggtaatttataaagaaaagaggtttaattggctcacagttctacaggctgtacaggaagcaggatgatggcagtctgctcagcttctggggagacctcaggaaacttacaatcatggcagaaggcaaaggggaagtaggcatgtcttacatggctagagcaggaggaagagggatggggagggggagatgctacacacttttaaacaactagattttatgagaactctatcaccatgacagcaccaagggggatggtgttaaaccatgagaaactgcccccgtgacccaatcacctcccaccagtccccttttcaaatattggggattacaattcaacatgagatttggggagggacacagattcaaaccatatcaatggggaagaccagcgattaacagcagaaacaataatcaacgccatagatatctcaattggttcagcttccacatttccaatggaaaaattaaagttcagcaaatattccagtcaatgggtgccaaaactgttgcagccagattagttgaagacaaaagcagaactttcaatggaaattttaaacaagtgaaatatcccaaagcatttatttggagaattgtccctgccaaatctcatgctgaattgtaatccccaatgtcagtggcggggcctggtgggagatgtttgggtcatgggggcgtatccctcatgacttggtgctgtccttggcaatagtgagtgaattctcatgagatctggctgtttaagtgtgtggcacctccctgccaaccctgcactctgtctcagcatgtgaggtgcctgctcccccttcgccttctgccattcttgtaagcttgctgaggccctcgtcggaagccgagcagattctggtgccatgcttcttgtacatcctgcagaaccatgagctaattaaacaacttttctttataaattaaccagtctcagttatttccttatttcaatgcaaaaatggcctaatacacagggggatgaaacactgctttaccaacatgatcctgaagacaaacacaattaaagcagtggctaccaagaggtggaagtggtcaagagccaaggttatggcaatggtttcttgaaatgcttaaggcattttgcttgttgactttctggaggatcaaagaatggtaacttttgtttattttgagagtgttttgataaagttagtcaaaactttgcctagaaatgtctgggaaagtttcgccagagacttcttccccaccacgacaatattcctgctcatttctgtcatcaaacaaaggtgattttgtgagagttttgatgggaaatcattaggtatctaccttatagtcctgatttggctccttctgacttctctttgtttcctgatcttaaataaatttgtaaagggcactcattttttatttttttcagttaataaagattgcattgacatgcttaagtttccaggacccttggttttttagggataaactacatggttgggatcaccactcagaagagtgtcttgaacttgatgaatcttttgttaagaaataaagttcatattttaaatttttatcttttaattccattttacatgaactttttgaagtccccattcacactcgtttttgtgaatataataatctacataaattaacttgtctataaatcaatgatatgagaattcttcatatagcttgcaaatcttatgccagtattcaggttaaatcactgactagctatacgtttttcagaagtctttctaatgtcactttgcctcagaacatcttcaaagaagtgaaaaaaagatggtagttgatggaaatctaagaggattataataaagaaacaactctgtgttttcaaaagaaccccttaaggtcacatttagctgcagcttctgatgagattgaattataaatttaattagaaaaatataaaattactattatttatagtgctggcaaattaaaataatagatttatataatagaagaaaaagagtaagttaataaagtccctgctaaggaaagtaagaacctagaggcaaaattttaatttaattttttggcatccattgattttttttccccacttcttgaatagttcactctaaaacagcaactatatgtaaagaatgaaatctcaacactgattacattacagaaatgttcttgaattatttgtaatgttctttcatcttttctgcctctaggggggagtgtgttttcaacaattctggcctcagaaggtattttattgtgggccacaggcttcacaggggtattctcgaatacaactttagggctggctcaacaagggagaaaaggacctctgaaaatctaggtgggttcttagtttagaggttgcagccaggatgccaagggagaagagttgcagagactgttacagttggtggtggagaaaacttacttctgatagaatttctaatacacttcaaagaatcacatgttagttttcctatattaatgctgtctttcctggtagtgagaaataacatatagacagtaatttcatttcatagagctggaaaataaaccgttgaatactttatagaaaacttgccaccttattgtagtagcttgccaccttattgtagtagctttaaaaaaaaaaaaaaaaaaaacaacccaaacaacaaaacatggtttgtggatattaagtaaaacatttctaaacctcataaaaagtctattagtttctgaaatatcctgtttagagctaacattgtctttctttcaaatggctaattttctttcattttgcagcattttcccataactttcctttggtttcattcaacaactgaagccagaaaggaagcacctagtaaaaaggttaccactcttttgaatgttaaaaaaatacttatttttccccatttcagtgttttacagaattgaaagaaataatatttaaaaattgagtcaaataaataagttatttctattttttccttttgattcatttttgtgattaaagtgctgcaaaaattctattacaaaatgttatttttgggtttattgtgctgtattagcctccaaacttagctatatatatatataaaaatttgatataaagaatgttattacttagagtagaaattaactttgttcctaacactttcacatgatgtaactggtggtccttggtttactttgaatacaatcccatttaaaaatattctcaggggatgaagaggtatttaagtatatcacttatactgtttgggccttaattcatctagagagtaaggggtgtcaggctgggtgacttaagtcttctggcctgaagatttagaactacttatttacacaaactttcagttggttgcaaaaattctaacttgatggaaagtaaacaaacccgtaactttgaaatccatacacttacattacttggtgggtcttcccataatcttgtgactcttttcatttgaaaaggttttttaaaaaccctaattgttgctcactggaattcttaaggggtgttttgagcttcagcaaaagcataacactggctttttttttttttttaattcgttccgctgcttggtttggggtctcttcccttccgcagcttggtcttgttgctgctcttgagtgtgacaaactgcaagtcgagagctcttgtccaaaagctgcggagaggctacgggcactcacccttacttaagcgcactgccctgctgttgaactgcaggcgaggctaggtagcatctgggatgggacaggcgttcacaccggtgccactgaaaccccagactctccgcataaacccacaccacacgcggcagaatcatatcgccattggctggtgttccgcagacacagggcataccgcagagtaataggaaacactggttcctaccactgtggccagtggtaggactgggtctccgaggcaggacctttcttggagtctcggaaccccagcacagtgcctggcaaccagtttcgaaatccattaagacccttggaattcatgatttagttcttgttttgttgttgttctttttctttttttttttttttaatctgtgctgccataaacgcctgcccttctgcaaattcaggaaagatttaattgctgtggagcactaaatctcaatttccagtgtgtgtggattaccctgtttgtggaattaaattttatacagatgtctcttttgctcctggttagtggctctaattaaataaatggaaattctcgcaggaattagaagctcctacttaacagtgaagatttcgggatcacagtgcataatctgaatataaatgacccagaagctgaaacattacccataatcacattgacggttccagaaagagcgataaggagagtgctgttaagggaggcgagcgctgacgccagaagttgccatatccccagaaaccccagtttgccttttcaccgtcgcaagtgagaaccagagcgcgttaaaggcctcggagtaaaaaacgcagcgtctgggactgcggcacccgggttgagtcgggtgcaagtttctgccgaaagagggcgtcggtctgagactaaaagaaatttgtggacacggacgcctagtcaaatgaaagaccattttaacacattttcaatgtatttaaatgtgcgggacttaattgtcagaattctcccgcccagtgtagcccgttcacattgcaaatgacttggctgcagtaggcacagaaggtccagttccattttgacccgccccgccgcgcggcggactcccgcgatgctcctctggtcacggacttctccagagccgcttccctccggtctccaccgctgctgtggctatggccagtgggaggactgggtctccgaggcaggacctttcttggagtcgcggaaccccagcacagtgcctcgagcgctccagagaaggagcggttggatctttgagcactcaggttggaggggagcgtgtgtcgtacccgggggacctaccgggaacgttttgggaaagacagtccctttatttaggtacctggtttagcaaacaaagccccgaggacgctttggggatgctttccaagctttgtgacacctccagaagttgaaccattccctcgcctttgggagcaacaagtttcactttcctgctctcagtgcgctgacagagggtccgtgagctgggacactgtgacctcggcaccgctgcgattccagcgcaaacctgcgtggcccagggggagggggctggcgcggggctgaggaaggcggggtgtaggtgacgcccgggccagccgggcacaccaggtccgcgatggagccatctgcactgggaccttggtccttgttccctgaccttgcgccgagggaccaggaaggtcaggtgctcgccccgcgtcggtgcttcaggagggaatgtggccagaacgagaaaggtgagagcaagcggcacctaaggatttttgcaccgaaaccacaatttctagaaccatccctttcccccagtcctggtttttttttttttttgcacggtgtgtgtgtgtatatgtgtgtgtgtgtgtgtgtgtgtatgtgtgcgtgcgcgcgcgcatttctctactttaaagcacgtttccttttttgaagccaggagctggagagcgtggaaagggagaggcggtgatcgcacaggcacgcggcgtggtgggggctcttgccggtgcagacgtgggcgatttcagctttaaggaaaaggcagagggcctgcggggagtggtggttagggacaggggcgcgatgggtagtgaaggggtgcagggaggagccctgatgtaagaatgttaatgagagactcccccagcccagcccccacatctccccacccccacccaccccacccgctggaaacacaagcccggcctcggcgcgccatgtgtggtaacacgctcagccgctgccacgctatttaaacgcgggctatggatccaggaaccggcgcgaatcaatgagatcaaatgcgagggagatgcaccgtcaattacaaacacttggacaagtctaactttttttttcttctacaaaaacgctttcaaaagcaaccttagcaacgcccaaataagaagccacctctaagcaaaatagtatatgtataaacggagggcgaatatatacaagtatatatatatgtatattacagacgcacaggtttacacccggtgaactttttctttttctttttctttttcttttttttttaagaaaaactagtgacattgcagagaaggacgcttcctctctatcttttggcgcattagtgaagggggtattctattttgttaaagcgcccaagggggcgcagggaccttggagagaagagtggggaggaaagaggaagggtgggtggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagaggtgagcaggggcgcgtcccgggccccgggccctaacccaaccgctctccgcggctctccctgcacactcgtccactctgcagaccccactccccactgcggcgctgaggtcgggtgcgcgcgggcactcgttcaggtatgcgccgtgtggctgcgacaacctttgacgaccgcccatcgcggtgtacgtagagggtcccagggaggtgaaggggttggaggagagggcgtctgtagctcctgcgtgcccaggtccaacaggtgctgtcaaacacttcgatgttttttcttcccagtttccactttgccagcgccgggctggtgattagggggcgcactcccagtgcctggctccatccagggtctgaagcatccgaggcggaaagaacttgttccccagtcctttgccagcgtgcgcccccacttagtgcggaagcgtccgcggacgcctcgcagcgaggcgtcgccacttagctcgcccgctcttggggtttctctgactgttgtttccacagaccccaggtttcttttaaaggcttgttgactcactcttctcattcctttcatttcccttccagccccttataaacgagcttctgtggtttccaccaaaaatgcccctgtgtgtctgaattctggcgacactcacttctcccagagtgttctgcaacgcagtttctaatgcgcccagagctaagctttgcgggagtgccttttgaagaaacgagcgctgaaccttctttccacctgtcccccaagttttctccatgggtctttgggtgttggaataaaacccaaactggacaaagagctcgaggctgaggatggtggctatggcttcggggagcggggggacgcggacgtgtaatcgccagtgtggcccattttacggtagggtagaatctgagggaaggcggactgagatgccggtatagcgccgatccctcctccctctagtcagggattaggagcactgcgatgagggaatcccgtctctgctcccccttggcgctcacgcgcctggaatgtgagtggtgcaatcccggcaaagctccccgagaccccagtgccacgcggatgagaccgaaggggagcggagttgagccaggcgccgggctagtccacaacttggcatggccgagcacctgggcgctggtcgtaggggacagcgcaacctgaggccgaaggccccaggaacaggtgagagtggacagagaagccatcgataatggcgctgctgtcaccgccttgccatcttggccacctcggactcaccctttagagcaaagaggcgagaggtgtttgacagtgggaatgcatggccaaattttgagctctggaactccaggctgtctgtgccgaattcctaccagccaagcaggcggggcgcaggctttgccgattatgaaaaagggcacgtgtgtccaacggctgcggacttgccacgcctgccacgcctcggcaaggaacccacatctacactcccaagtcccagtcgccaggttactgcagcctccacgggggtgtctgcgccccgggctgctaaggctcccggaacctgcttctccagttctcggctttcgagggctaggcgctagaagtcagagacttcccaaggccggctgggactgggggtgtgtccccctatgggcgagatccgcggtttgctgactcgtccgtaatgtcactaccctgtagatcccaatgtcagcggctgccccggcgcacgtggcctgggatacaaaaccaagggcatgtgtgagaccagaggagggcagatcgcggccccggggcccctcgccctcacagtggtggctgaggcctggggctgggcggacagcagtgccctggtgggcctggggactggtgcgccccgggcttctgaggactagggctgcagtcggctgtaagaattattttttaattccaaaagcctcatagacgttccgaagtctctttgctttttttttttttttccaagtttgcattgaggggtgaaagtttgcttaactgacctgtatattttacaagtgataaggttaggattttacaattcttactctaaaaagtatttccaacagtgacctggcagatatttagaaataggaaacaaaacagtttctcctctaatcgtcctccaatcgcctctaatcatccttccaccccgaaattccttacactcgagagaaaaagttacttgataacaaagctctcttaggggaccttttaaaaatacattgaagtaacacagttactttaccgtaagcacttaatgtattaaatagggcttcggtacatgattgcagtgaagtttctggctcagtcaccggctgggggatcttggactgctatgaaacctctgtacctcgagctccttaggtaaagtgggggtagtcagagcacccacgtctttgggaaactgtgagggttacagaagctaacccaggaatgcctgggagcactgccagaagaatatgaagtgctcaataaatgtgcggtttcattgtagttattattttatatatgatgataatcacctttaccccaagggtgaggccatgccatgggaaagaaccctgggctgagatgcagatgcctctggatttggctggcctccttatgtgagttttcttctctgtgaaacaatgtgtggggtgagaatcaggcctcttcaaactgatattctcacccaagtgtgaaaatgcaactgacagtatttttgcttttgaaaattccctattaagtattatgaattaaagtagagagagttcctccctcttttggtgagaacattggtattactttttttttggacttaagtttctctttaaaaccaaatcacaaatgtttgaacaagtaaaaaactgaccgtgccagcatctcaaataataatgcgactaaaatttcacatggcatactgtagaaagaaaaacaggggcatcaattattccttcattttaaggatttaccatctaagtcaataatttaaaatctttttttttcctgtcatgtctttcgctaatgccactaaaataaacagacctgagcctatattatttttaaaaacaattatctttatttaaaatagattcacttacacagccagctactgccctcaatattccacacacttaacaataaatttagttttaaaaagacaggcttagaaataattttttcaagcaatacaagccagtagttgttttgtcgatgcactttatatgatgcagaactagaagtatcctaacgcaaatgtttttatgtgaagaactgtagttttatccttttagttattagtatgtcattaatctgggcctgcataatgactgtacaacattatacagtctgtagagatagagataacagtatttaatcaatacaagaaacatttatttttagaattagtctggggtaaatgaccgagtggtcaatcagcagcatttttaaggaaagaacccatgataagtgtaaaataactaacacagcaggggaaaaaaggagctttgtaggctgcactgtggaaattctaaaggcctttggagtagatggagctttatgaacaacagaaataaagatgcaatctccattttgcaaacaatatccattgctatggagtgtagaaacagccagagagaaatcttttttgaaaaaagttagatttacattttaccaaaatttagttctacagctatagaaagtgagaaaactacacaaggtttatgaggagaaaaaggttcctgtctcctactctccatttttcactctcaattcttgttagctcttcctgtaggtattgaccttcatatctcttaataacatgctacttttttttttttcagttttaggtcttatctgttggaatcccagtggaagaaaattctcttcttgatcattctactgcctgttaaccacacatgcaagctttctttccagtcatctttccaatatggttgtgccaaaatttttctcagtaggctgaggcaggaggattgcttgagtccaagagtttgaggctatggattgccctatttgaatagccactgcattccagcctgggcaacatagctagaccccatctcttacacaatattttttagttagttcagtattcagtataaatattatcattactttctaaatgatatttaaggttaagtcacataggcttctatgttgacatttccttttttccccctacctattttccttggagttaaaacagtctgtttttgtttatttgcttaatttcctatggatttataattaaataatcttctaattctttattttaaatctcctgagtgtttttttattattatactttaagttctagggtacatgtgcacaacgtgcaggtttgatacataggtatacatgtgccatgttggtttgctgtacccatcaagtcatcatttacattgggtatttctcctaatgctatccatcccccaacccccccaccccccaccccctgacaggccccggtgtgtgatgtttcccgccctgtgtccaagtgatctcattgttcagttcccacctatgagtgagaacatgtggtttttggttttctgtccttgcgatagtttgctgagaatgatggtttccagcttcatccatttccctgcaaaggacatgaactcagcctttttgtggctgcatagtattccatgatgtatatgtgccacattttcttaatccagtctgtcactgatggacatttgagttggttccaagtctttcctattgtgaatagtgccgcaataaatatacgtgtgcatgtgtctttatagtagcatgatttataatcctttgggtatatacccagtaatgggattgctgggtcaaatgagaattctagttctagatccttgaggaattgccacactgtcttccacaatggttgaactataatttacactcccaccaacagtgtaaaagtgttcctatttctccacatcctctccagcatctgttgtttcctgactttttaatgattgccattctaactggcatgagatggtatctcattgtgtttttgatttgcatttctctgatgaccagtgatgatgagcattttttcatgtgtctgttggctgcataaatgtcttcctttgagaagtgtctgttcatatcctttgcctactttctgatgggattgtttgtttttttcttgcaaatttgtttgagttctttgtagattctggatattaactctttgtcagatgggtagattgcaaaaattttctcccattctctaggttgcctgttcactctgatggtagtttcttttgctgtgcagaagctctttagtttaattaggtcccatttatctattttggcttttgttgccattgcctttggtgtttcagtcatgaagtccttgcccatgcctacgtcctgaaaggtattgcctaagtcttcttctagggttttttatggttttaggtttaacatttaagtctttaatccatcttgaattaatttttgtataaggtgtaagaaagggatctagtttcagctttctacttatggctagtcaattttcccagcaccatttattaaatagggaattctttccccatttctcatttcatcagatggttgtagatgtgtggcattgtttctgaggcctctgttctgttccattggtctatatatttgttttggtactggtgccatgctgttttggttactgtagccttgtagtatagtttgaagtcaggtagcatgatgcctataactttgttctttatgcttaggattgtcttggcaatgccagctcttttttggttccatatgaactttaaagtagttttttccaattctgtgaagaaagtcatttgtagcttgatggggatggcattgaatctataaattactttgggcaatatggccattttcatgatattgattcttcctatccatgagcatggaatattctttcatttgtttgtgtcctattttattttattttattttcattgagcagtggtttgtagttgctgaagaggtccttcacatcccttgtaagttggattcctaggtattttattctctttgtagaaattgtgaatgggagttcacttatgatttggctctctgtttgtctgttaatgttgtataggaatgcttgtgatttttgcacattgattttgtatcctgagactttgctgaagttgcttatcagcttaaggagattttgggctgagacaatggggttttctaaatatacagtcatgtcatctgcaaacagggacaatttgatttcctcatttcctaattgaataccctttatttctttctcctgcctgattgccctggccagaacttccaacactatgttgaataggagtggtgagagagggcatccttgtcttgtgccagttttcaaagggaaaaactgcttccagtttttgcccattcagtatgctattggctatgggtttgtcataaatagctcttagtattttgagatacattccatcaatacctagtttattgagagtttttagcatgaaaggctgttgaattttatcgaaggccttttctgcatctattgagataatcatgcagtttttgttgttggttctgtttttgtgatcaattacatttattgatttgcgtatgttgaacctgccttgcatcccagttattttctaggtattttgcacaattgccactctgggttcttcaacatcttcctgggacttccatcacctctctgttgagctagatccctgtgtgtttctcttttttcattatgtttttgttttgttggaccacatcctccaagagctttctgagaaaggatgaataaggcctaaattttgagaggttttgtgattgaaaaattttcatcatacctttacacatagttatagtattctaggttggaaataattttccctcgaattgtgacagtattgctttactgtcttctaaattctaacattgctattagaaagctggaatcagtttggattctgaacttatagttcattgctttgctttcctggaaatttttagaatgttctcctcttccctgtgtactcaataggcctcttttatccagaaactcacatcttttaattctgggaatacttcttaagttatttctgtgataattgtatccttttcattttctctatttcctatttctaggtttctttcttatttggatgctagacctcttggattgatcttctacttttcttaccttctatttaccacctatgttgttgttgtttttttttttttgtaattcatcttgtttggatatttccttggccacttttaaagttactgttgagtttttcatttttggtatcacattttcagtgtgcaggacatggcatactctgctttgcttccatgcagtgatatccctcttttccttctaaatttgtaattaactggaagatgggtacagtaaccagatggagaatatgaatatatccttattattgataaaagcagttgaacatggatttagatctatttccaaaagggcctgcttgctattacttcctcccagaattaggcaggaatatctattaaatcacatatagtgccatttagctgcaaatctcccctgctaactcttgaccatgtgacaaaagaagcccatgatgtgtgctttctgcaaacagccacaacccaaagaagagggaagaaaagactgagccagcatactcagttttaggctcaacaatcagacatttcacttcttttcctcttgttgcgggtgaggggagtgtaaatgaaagcacattgagagatgagaaatgttagcacattagaggtttctcccaatgaaaacttgagattttggaaataagtatccccccaattcagggatactacctggaatgtttttgattctctgaattgacttctatagctacctcttcgcatttctctctgctgttcttagagtgattgcaagaacatgatgcaatagtgagaagccatttacagaagtcactgtgggaaccagatgatggagggtggcatggaacattgaaagttctttggcaaggaggaggaaatagagtagaatgaagaaaagtctatacataaagttacagttacaccatcattccctcttttagaattttaacaatgcgacccaaaattaatatttatatattaactatactgagatacaacaaaaactgccttaattaacctccacttatgcaggtcgcaggattagctgatgtcctctgttctctataaatcttatcacctgttggtaggtgctggcagctagtatagttctcctgaatatgctgcacacttctcatacttcttcatatactttctaagagttgtccacaaatttgttgatgctggttgtgcttattatgataaatatgtaatttaattagttattatataaattgatgaaacataagcaggaaaagaaagttattttaattaaaactgttctaaaccttttgattgtataaaggcaagttactaaaaatacttgctgttcaattaggcatgagtgagacaaccctaagagattggggagcatcataaaaatctaggatcatgcactctgactactttgcaagtgtcattaggtgcttgctccagtttgaactggaactggatgataatgtgcattatgtgtttggttcattcaagaaagacagtgctctgctcatgaacttggaaattagggcttccttttgaatcttaaatcacatggccaacacaaaatggataagatctaaaataatcaaaatctgcttagatagacacagtgccactctatgtctcttttgctcagtctaagtggctactaacatttacagaaagaaggtaggctgggcgtggtggctcatgcctgtaatctcagcactttgggaggcccacggtgggccgatcacttagcctggccaacatgacaaaactctatctatacaaaaagaacgaaaattagccgggtgtggtaacatgcacctgtagtctcagttacttgggaggtgctgaggtgggaggatcgcttgagcccaggagatggaggttgcagtgagctaagactgagccactgcactcttgtccgggtgacagagtgagagtctgtctccaaacaaatgaaccagcaaacaaaataacaacagaaaagaaaacaaagaatgtgtccatcagaaggacttggtggtggtggggtatgtcttagtttgttttctgttgctatgacaaaatgccacagactgcataatttgtaaagaaaagaagtttatttagcttatggttctagaggctaggaagtccaagagcatggtgctggcatcttgtgaggaccttcttgctgtgtcataacactatgaaaggcatcacatggtgagagagcaaatgtgtgccagctcaggtctctcttcctcttcttctaaactgccagtcccatcttaggggacccaacctggtgaccttatctaatcataagtatctaccaaaggccccatctccaaataccaccaacaaatgattttgagcattaagttttcaacacatgaaatctgggggacacaaccaaaccatagcaggaagagagagaaggagatgggccgggaatgtaaaaatagaaaaaaaaagtaccacagaagccaatgtttagggaaacttcaggcaaagtttaggaaagcttgtcctctggtccttggaccctggctgtttggtcctggaccagatatatctcttagatggatgcctagggtcatcaagttctggtgcctttgacatctgaatcctctactggcctccctgattctgatttcatccttacttgcatcctactgcttataatttgtctctccagttagcatgctcaggtatagggcatgttgacacaaatatattcataaccatcctggacctcattgaatttaaacagtatgcatttcagattacctatacatatctgagttaggttattggaaacttgcccctaagcaatgactctactctctatatgttgacagaatcaggttctgcatcttgggactgagagccagaccctggactatgatcacttgatcgaaaaatgatgagggctgcttggtggccagtcagccagaacttcccggaacctcctggagacatccactcttggaatccacattcttcaaacttgtccagcctcagtcccttgttgaatgttttatgggacaccctggctctttgttcatttaagaggctagaatcaaatcagaggtgaaacaagggtctaaatcataacaaataattaggagtttctttgaaaactttcttactgaggcatcttggaattgattatttattccaaatgtatacctatactttcaggcagaagcaacacctactcccatacttgtagatctttaatatttgtactgttttaaaaactttttctctagagcttttatgctgtacaccgagcccttttggggtatgaaatgtcagagtcatgatctaacactgaattaacgtgcgcagtaaactaaatatcaacaagaacccaacctccatgcaggttgccaaggccgctttggcatagcctgaagtttgttttatgtctttcagcacccatgcttttacaaagaacatacacatcttggagggctggcatgcatcgtgataatgcggtttatagcacccaggtctctccaggtctctctgcacagtatgtgtgcagcaaaacacagtggtaccggtcatggagacctgggtctatcaacagggatcaaatagactgggtaatggtcaagccctacttcattctaggctgtgtagcccttatgtggtaggcaacaatatccaattcgagaggctctcgagttgtgtgaagcctcttgaatccaacagtgtggatataaactgagagaacatgagagagatacctggaatcttacaaacgatttcttatgtatgttgagacaacctgaaaataatgttttaaaattcaaacagcagaaagcttgtagcaccctctgaatcctctgatttgctaagtgaatgttctctctaaaatcattaagtttgctttttcaggacaatgcatttaccatgctattaagtataaaaagcagttgacaattttcactatcttatatccggcaaatctggtgatttatttgatgcagttttttttaaaagaactttattttgaaataatcttgcacttttggaaaagacgtaagaaagtataaagaactggtctgtaaaagcttcatttagagtttcatcaattgttaatattttgccacatttgatttatgatttcaagtatctccctgtccctctctcctcttctcccctcttctcccctcctctcacctcctctcctctcccctcctctcccttcctttcttctcctcttttctacccatctacctatcatctatcaatcaatcaatatatgtgtacatatacatacacacacagataatacttgttatgaaccatttgaaagtacagaatcatgcttatttacccctaaacattcaactgtgtacttcctaagaacaagaatgtttacttacataaccacagcataattatgaaaagtaagaactttaacacaaacagaattctattatctagtgtatggaacttgttcaaattttccaccagtcatcttcataatgccctttatagcaaaacatttatgtatatatgtatgtatttattttaaggtccagaatccaatccagcatcacacgttgcagtcagttgcctattcctttaagccttgttcagtctagaatgtctcttcagcctgtctttgttgttcataaaattgaccattttaaagagcgtaggccgattttctacagaccatcccccaagttgggtttgtggctgccaccttctgattagatgtaggctgcctatctggacatttttggtcctcaaagtgttattccaggtgtctcatgagtctgtgttcccatggttggtgatgttggcttccatctcttggttatggaggcgtctgctaggttcctccatggtccatttgtagttaacaagtgattgtgaggagatacttcaggaccatataagtatcccgttccttgtcagatgtcccttactggtgtcagcatgctcgaagtgctctgcaaaggggtgcctcatgtgtgttgtttgttcctcccctagtggtgatcatgtgtgcgagcagtgacaccatccggagcatcatgctggtggcgcacaggcatggcatgaccagtggagactacgccttcttcaacattgagctcttcaacagctcttcctatggtaactctgcttccactttcccctcctctgctagggttccaagagaggttgtcagatgcccatgaatggtgggttggataaataatatgtggtacataaacaccatggaatactatgcagctttataaaacaatggaatcatgtcttttgcagcaacattaatggagctggaggccatgatccaaacaaattaatgcaggaacagaaaatcaaacactgcatgctctcacttacaagtgggagctaaacattgagcaaatacggacataaacatgggaacaatagacactggggacttctaggggtggtgggggtgggttaaaaaaccctgttgggtactacgttcaccacctgggtgatgggatccatactccaaaccccagcatcacgcaatattcccatgtaacaaatctgcacatgtacccgttgtatctagagtaaaagttaaaataaaaaacaagagggttgtgagaaagattcagaaatttgagttatgtccataaatgtgatttccataaatgcaattttggaaatttgtgactctgaacactcctacagcttctcaaaaatttcttgaatttgcttcatctccaacaattcaattggagcaaaaagatatcatgtacctatgatgtcaagacacctgtctgggtatgagcgtagcccactcctgcactccaaatggtcataaatccaggccccaaagacctcttgtccagtgcttttccaactgcacattgcaatcatcatgataccatcatgatcagaataatttcagtgagatttgggcagaatttttaatagaatggaatagactagaacataacactactgaataggtgaagtgtgtcacacttagcatgtgtattgttttagaaagcttttactttagtaatattattgcacatttgtgtgtatatgtgcatgttacacctatgtttacagtgggtcacagtgtgaaataaaataactgttactgcaaattgaggtacaaatcatttgaaagccactgctcccagtcccctctttcttccagattactgcaccttaaacctctcctatacagaagttgtgaaccaccaatgtatagagttgaaagcatttaattccctataatgaatctggggaactttgcagggttcctgtcatggagggtgtttaaggagatcataaagataacaggtacaagacatttctcccccaaatgtggttagggctctctctgaagcagacagcatcgggctacagaacattttctcaaacgctgcatgctggctgctcagagcggagcagttgtaggggaagtgtaagtgtgtatatcacaaatggcatgtttatactgagcttcacttcccagttcttgctgatgagatatagttggacaggatctaaaccttaaaacatactccccggtttcctgccctgatatcctggcttactggagcagtacatcattgtgcatatacagataataaaacacgcttatcatggagataaagaaaagttgatgaaacaaaagtagccactgcttcctgtagtggataaaattagagatttgaggcttgcaagataaacaccctagtttgccctccttcctgccatgatggtcttttcccctctgttttacacaagcagagtggtgctttcacttcttcactcaagatcagaatgtagttttactatgggctgcagggttgagttcattgaaatggtggtagaaactggtgaaaatgaaaaacatgtatgctgagttttgcaagttggcaactacaaatacagagtttagaggcagtgcatgtgaatttagaggcatgaggtctggcaagtacctgatataaatgttaggtactagaattcctcttatccacagataaagcttttattacttttccctgttaattacaatacatgagtattgtagacaatttagaaaacatagaaaagcacaggaaagaaaacaagttaccataattctgccacacagacaaaagtacactgataatttttggaagtatgtacatcctgcctattttataaatacatgttttacaaaaatattcttcaatatattgatcatactatttatggtatggctacatgttcttttataatgttgatagtcatcttttataagtcttatttctcaatattgatgttgttcccagctttttgctattaagaacaatgctgtgttgagtgtacatacgcacatacactttctctctcacatatttatacatatatattatctgtaaaataaatttctagaagtggaattgttggctcaaaggttatgtgcatttaatgttttgttttctttttttgagacaggatctcaccctgttgcccaggctggagtacagaggcgtgatcttggctcactgtagcctcaacaccatgggctcaagtgatccttctacctcagcctcctgagtagctgggactacaggcatgtgccaccatgcctggttactttctcttattttctttagagacagggtttcatcttgttgcccaggctgggctcgaactcctgggctcaagtgatctgcctgcctcagcctcccaaaatccaaagggactacaagcatgagctaccatgctgcctgccatttaggttttgatagatattgtccatttttacttttgcagcaaagtatgtgattatctgttttcctgtagccttgtcaagcctgtataatcttttaccttattttatttaattgaatttctttttatgtttataagcaaagttttgcagttttctcatttatattgtgcattattcttgctgagtttgttcttagtattttatgttttttggttgttattatgatcatgatcttttcctgttgtattttggaatggtatttatgtagagaagcaatgagttcttgtttatttattttgcaagaattctacttattaaatcctctgctctaatagtttttatatcatttcaaataacaatgacagtttttttctctgttttgatagttgaacatcctatttcttattcttttcttattgcattggcaagaacttccagaataatatcatataacaggggtgatactttaaattttgacttctgtcatgaagtagatggtaaagtatccttttattcctagtttatcaagtctgatttttaaaatcagaaatgaatattgaataatatcaaatgcatttgacctgttctcttaatacattttaaaatattgggccaccatggcattcttggaatcaagtgtactttgtcatgatgatttttcaaaagatatattgttgagtttaagtttttagtgttttatttagggttttgggtctatattcatgagtgagattcaagagcagtttttagctggactgcggtggctcatgcctttaatgctagcactttgggaggctgaggcagatggattacctgaggtcaggagttcaagaccagcctggccaacatggtgaaatcccgtctctactaaaaatacaaaaattagctgggcatggtggtgtgtgcctataatcccagctacttgggaggctgaggcacgagaattgcttgaacctgggaggtggaggttgcagtgagctgagatcttgccactgcactccagcctgggcaacaagagtgaaactctatctcagaaaaaaaaaaaaaaaagagtctttttcttgggatagtgttgccagattttaatatcaggttcttattagctttatagaattaattgagatactttccattgttttccatgctctataacaattttgataccataggaatattccttgaaataagaaaacagctcaactctgtatttgcacctaacttctttctggaggtaatttttggacaactttaaaagacccttctataatggaataatttcagatataaaaaacttgcaaaaaatataagttgaaaatcaattatttgaaatttcttggtattaacgtgcttcagattccaagcttttatttggattttggaatatttgtgtgtgtgtgtgtgtgtgtatatatatatatatatatatgtaaaatgagacatcttggagatgggacccaagtctaaacatgaaatccatttatgttccatataccttataaacatagcctaaagataattttatttttttccctgaggatgctgaataatattgtgtgcctgtgtgtttttttttttttttttgttttgtttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagtcggggtttcaccgttttagcccggatggtctcgatctcctgacctcgtgatccgcccacctcggcctcccaaagtgctgggattacaggcgtgagccaccgagcccggcctgcctgtgttttgacctatcacatgaagtcaggtgtggaatttttccacttgtggtgttatgttgttatgttgatgctcaaaaagttttggattttggaacattttggatttcccacttttggattaggaagcttaatctgtatagagacttcgtgtacagttatgtgttgcttaatgatgaagatacattctgagaaatgagtggttaggcagtttcatcattgtatgaacaccataggttttcatacaaacctaaatggcagatagcttactacacacctatgctacatggtatagcttattgctcctaggctataaacctatacagcaagttactgtactgagtactgtaggcaattatagcatgatggtatttgggtatctaaacatagattctatctaagtatagaaaaggtatagtaaaaatacagttttataatattctgagactgctgtcatatatgttgtttgtcattgactgaaatgttatatggggcatgactgtacatattttaccaagcttcctctaatgttaccaaataaccatagtacaattatcaaaacagggaaattaacattggcacaatattactaactaaactacaggcctatttgaaatttaccacttctcctcctaatgttctttttctgttccaggatccaatccaggatctcacactgccatttagttgttgtgtctcctttatctcctccactatgtgatagttcctcagtctttccttgtctttcatgactttgacacttaaaaaaaaagttttcactatgaccaagcggggtttatcccagggatgcaaagttggttgtatatttgaaaagcaatcaacttaatccatcaaattaaggaagttaaaaaaaaaaggtcacatgatcatatcaatagatacagaacaagcttttaacaaaattcaacactcattcatgattttaaaaataaaaaataaaaaattataaaaccaggaacataggggaacctgcttaggttgacaaagaacacctacaaaaacctcgcagctgatatcacaattaatggtgaaagactgaatgcttttcccataatacaggaaactaagcaaggatgttcactttcattactcattcaatttgccactgggggttctagccagataaacagggcaagaaatgaaaataaaaagcatacagtttggaaaagaagaaaaaatctgctgttttgtgcagatgtcatggctgtctatgtagagaatcccaaataatctagaaaaattccttaaagctaattaatgagtttagcaaggtcccaccatacaggttcaacatacaaaaatcacttgtgtttctatattctagcaatgaacatgtagatgccaaaatcaacaatataatatcatttagtcaaaaaagaaatacttaaaaaatgtaaattaaaaaatgtctaagtttttttgctgaaaactacaaaacactgatgaaaccactaatgaaagaaataaaaaaatctgtattaatgagagacataccttgttcatgaattggaagactcaacatggtaaagaagacaattttttcttacattgaggttaaataaatatcttacaaaaatttcaacaagattttttttagatgtaaggaagattattctaactttgacacttttcatgagcccattattttgcagaatgtctttcaatttggatttatctggtatttttccacaatgagattgagtttatgtattttggtgagaatactgcaggcgtgatgttgtgtccctctcattgcataataccagtgcgtaagaagccatactatatgacttattgctggtgatgtttggacaactttttaacacttcctttcctatgagtttaatttttctgcttcttgaaaattctactacacagagttatacagaatgctcttatacaacttacaaagtatacttggggtttctgattagatcctttatattttaccttttacgccatatttgctcagactttgtgctttggtgtttttctgcctgagaggctctgccatgaactagctgttaactctaagaggtaagggttaagagatggttaagagcttaatccttaaccctggcaaagtaacataactctgccctcccctgcaagccttagtttcttcaatgagaataataatacttatcttatggcatcagactcagtaataaatgaggtgacgtatataaaataccttgcaaacttcttggaataactatttaataaatgttagctatattttattagtcctagtttacttttaccattatacctaatacttaaaaaattatgttaagtttatacattttttctgtggtgttaggtttatagatagatttaaggtcacacattctgttatcaggttagccaatgttaatataatatatcccaaggacctcggtgcattaggaattgcatcttcatgcacctaaccaagacgtccagttgtagtgattttaaacaaatgtagagatttattctcttacctgaagcacatccaggggtgggaagttgagggcagggatgatgacttcctaatgtcatcaggagtccaagctggttctgttttcctgctactctcaatcttagtgcataaaatccattctcggccgggcgcggtggctcacgcctgtaatcccagcactttgggaggccaaggcgggtggatcatgaggtcaggagatcgagaccatcctggctaacaaggtgaaaccccgtctctactaaaaatacagaaaattagccgggcacggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaatccattctcaagatcaaagatggtggctagagctccagggatcgtgtgttaattctaggcaagacaaagagacaacacaacaggtaaaaagagaccctcctggttgacatggttctctgtgaaaggctttcctggaagccccactcattaacttctgcttacatttcactgactagctctagtgacaggggatatcagggaatgtgtgcttttaattggactcactgctatcctacatcaatttaggaatctgttactgaggaagaagagagcatggatgtaggaaggcaactgtccatcttccacagactctgaagcacccttttccttggggtagaagcagtcaacagaatcacatggtgggcagagtgacctagaccaaggttctgctatacatcagtagtaaagggccttgtttgaaactttgtgccctaataatcagatatatatgttcatgaaaagttgttcaacatctacctctccctgggcctcttcacaccaaaccctatgcttgttctaggaaaagacctctattttattttattatttattactattttattttattttatttcatttttttgagacagagttttgctcttgtcacccaggctgaattgcagtggcatgatctcagctcactgcaacctctgcctcctatgttcaagcaattcttctgcctcagcctcccgactagctgggattacaggcatgtgccaccacgccggcttaatttttgtatttttagtagagatggggtttcaccatattggctaggctggtctcgaactcctgacctcagatgatccgcctgcctcggcctcccaaagtgctgggattacagacgtgagccaccgtgcccggccaaggcatctaattttagtcactacttacttgatgttggattgaaaaaaaaacatattgatagtgcgtccattattactaattactagattgtttggtcttggtgagcactcaaaaaaagattctcagatttgcccaaattatgtgattacaggagttcaatgggtaacatattatgggataattcaagtgattgaaaataagacttaaaacataggtttaaaaaagtctagaaagaagataatatatattgccccatagagtttttaaaggcaccgattgacatttttgtccattggcattacctacttagaaggtgagttaggtggtaacttatctgggcgatcctgtctagaactgctattattgtagagcttccctatcttcctgagaactcagagagcactaattaagatgagaacagaagtatagtagagattggtgatgggcaaaaattaaattatttgactggctaaaaatggaaaaataacagaaaaaccagggagagattagaattatgttttgccataaaagtgatacatgtacattaaagtcaatttggaacatagaaaaaagaaaaagaattctcacataattcatcaatcataacagctgctaaacagcttttggcacttccccttttgatattttttcctcttctacatttgtttttaacgtttttgtcaatcaccgcatatgcagttttaaatcttagaacacccaaactctgatgaaatgaatgtaggttaggtggggtgttggtatctggagtctggcttgcatttggatattgttcctatcatttattagctaaacgacttggggcatgttaatctccttgagcctcaatttcctcatctgtaaaatagggattatacttaaatctttttcaaagagttgttaggagaattaaagaaagaaatactgcaggtcgaacagccatatggagctgtgcacagtggtatcccccattaaggggtgctgttattaacaatgggtgtaattggaccagcctagccatggcaagcatgtgacagtgggtcgtttggagagggtgggggtaagccaaggaaggcagatattttctctccttaaatgaccaccagagctgaagagccacagtactgtggggccaggccaggtgaatgcttagcattcattttttggacacattctgtgatgtctcagccactcattcaggtgatatatattgaaaatttactatgtgctaggtccttggtaagtactgggaactacaggatggcacagttaccccaacatgggtaccccttattggctgcagctcttcaccacaggatcgctgggcacagggcttggtgctgagcagactaccttcctctttcataaatattctgtacccagtgcaagcttgggtgttcaatacagcattagaatccaccactcccctgcaagtgctttcctcaaggtcaccagtgagcttctcattaccaaatccattagccttacctaagaccatgcttcatgcctccaaagctgtgccacccaatggaactttctgcaatgatggctatgttctagtctgtgcagcccaatgtggtagccactagccacatgtggcattgagcactttaaatatgacaagtgtgactgaagagctgaatttttaattttaattacatttaaatagtcacacatgtggctagtggctcctctgtgagacagcaccgctctagagcattcgatcttgttgccatccatccctttctggtaaccctgtgctcttagctttggtgacacagcattcttctggttctctgttagctcctctctgtttcctcttactcctcttgcccactaaaaatagcatccccccaaagtgtctgtgctctgcccttctccctctgctttctgcactgtatttcatgtctggcgaggcagcccctggtttctaatttggagccgtgtggaaatgacacccagcacggtctctagtcctcactcctctttttggcttcggagtagcatttccacctctagcctggtggtcacttgggcattctgcagtcgccttggatttaccatacccctaactgaaataatcatttccatgtccttctaacccctcctcctccatctggctctgctgcttctttactgttaacctgttttccttttctctttggcgtcatctgtgacatgcctccctctgtgttgtccctcactcccttactgttgtacagtcttgagattcctcacgcacagtgctctgcctttgttctcaagggctctatctcttttttttataataaaagtcaatgcttattgttgaaaatttactatattcagaaaaataccaaaaaaaaaaaaaaaggaaaagaaaacttgctcataattgtaacatcccaagaaccatttttagcttttttggtgtgacttcccacatataaccttccctaacctcttgcctggattactgcggctgtgaacgcttggtgtctcccccaccctaatccactgctatttcccaaggctgattctcatcatatcactcttctgttctgctcataaatctctagaggcacccagttgtctactgcattaagtttgtccccactgatggggcgtcatgccaagccgacctctgctttcctaatgctcaacagccctgatatgggaaatgttactgacacaccacagttagaaatgcccacaaaagcaagaagtcgtagtatcagttatggttgggaatagatacctatttagcttggcttaaatttaataagcactactatttccttcattttttctaggaagcaaaactccaggctgagctcggtggctcacgcctgtaatcccaacactttgggaggccgaggcaggtggatcacttgaggtcaggagtttgaaaccagcctggccaacatagtgaaaccctgtccctactaaaaatacaaaaattagccgggtgtggtggcgcatgtctgtaaccccagctactcgggaggctgaggcgggagaattgcttgaaccctggaggcaaaggttgcagtgagctgagatcatgccactgccctccagcctgggtgacagagagacactctgtctcaaaaaaaaaaaaaaaaaagaaaaaaaaaaggaaaacaaaactccaaagccgttaccttttagattgtggtagacagatttattgtattggattttacttctttgcaaattaaaaaaagtttttgtccatttcggtccgtgagatagttgcagtttctagtcctatgtgtgttttctaattacataacatacaagtctgtagagttaagcatttcccttcccctggagagaacttttttccagagctgagaaactcacaccctctttgcctaagacatcacctctactgagtcttgatactttgagtcaattaaaaatgaatcaataactatttattgcatgcctgcaagcaatgggctcctccattggacaaagatgtcctgagcattcttagaatttggggtcttcctggcaatggacttggccccttaacaaaggccatgctgtatcttggtgatggagcatccagctggtttttgcctgcctggtggctcactggcccgagcaggggtatggctctgctcacactgtggcctcctcagtgtctgggaggtttcgtgggagaggaggaggactttgtcaagttttgctcggtggcctgaaatttaatcttatgctcattgagcacagatttagttcctaatgaattctgtcctcagctgtgtcttatttgtcttttaacagctccctggcacatgtaagcaattaataaatggttgctattattaggattatgattatacagatgcctctgcaaacattttctttgtctctgccttttctcgggctctagactaagtgcccagctgcctcctggctgtcaggcacatttgcacctttgcctgtgctgtgatgtaggctcagccaagcatgccttccaccctcctcccctcctattaaaatcgtgttcacacagttaggacctttctaatgcctcttcctcacatgcagccttccccgggttagagctcattgcatcttcctctctactctgtgttgtttctttgtaccccccatagtaagctgtggtcctacctgtgataacttcaactgtttacatgtcacaccctcagcctctctcttgaatgtggtggagactgtatttacaatgctcaccctgccaatctcaggaccttgcatagttcatagatgtttgtctgattcacactgtcatagaaattccaaagccaccaggtctttgttaaacttcttcaggaagagtagagtgagtgccacaaagtcctggccgtatatcccagagacattctcactgcttagctgttgggttcaaggcctctaccaaggatgagggggcttggggtaaacaaatgactttggcactggactccagcaggtggagttccttgtattttcagagctctccaggaatcataacaatacttcgtagaaaaaatagctcattgtcaaaagttagaggtccaccttgccttttggggccctgtaagccacgttttcttgaaaataaaataacgaagagaaaaataattattcttattcatgtaattttttgcttttgtaaaagagagacctgtgaaacactgggatacctagcttctcaatgcatcagttttcttatctgtaaaataaagaggctcatagtacccatatcacggggtcttctgaggagtaaatgtttttacgcatataaagtgctcaacaaatagagcttttattattattattattataatatatgtgcttaataaatgttagcaatttttatctcattaccactaatgcactaatggacattgtctaataaataatttctatgatgttgctagcatgagagagacacaaatctttgagttcacctaagctactgttcaccctgaaaagattcaagaaatatcaataatctcaaacttttattttaatagcactaactttctttttttaaattatactttaagttctgggatatatgtacagaatgtgcaggtttgttacataggtatacacatgccatggtggtttgctgcacccatcaacccgtcatctacattagatatttctcctaatgctatcccttcccctgccccccaccccctgataggccctggtgtgtgatgttcccctccctgtgtctatgtgttctcattgttcaactcccacttatgagtaacatcactaactgtctaatagttgtgcatatccattgtcatgcgtcactgtgacctgccgtcccacacacacataacatcaggtttattataccacactagccacttgattcacctccacagttgattgtaggtattaaaaaagaagtatgaatggcaaggaataaaaactgagttctttctcttacagtgctgcaattttgggggtggggcagggctgaaaattgcagttacatggttattacaaggcaattacctcaacagtactcttctttctcgctcacatttcaaaggaacacatgtccaaagggccttcttctcctttaatggtcttgacgttgtcccatcatacctaagtgcaaaactatgacaatacttctcttcctggttgccaaaagtaacatgcgggggcgcctcacagttgtgaagggagaatggcctctttatggtggctggcttggaattataaatatttttatttcttccataggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgtaagtgcctgattatgagcctagacctttagcatcctgaaaactgtcttctaattaaatcagagatgacagagtgtcccattctgagccattcaaaaattcctaggttcaggtctgaatgtcactgttgccttctgtgtgtgtgtgtgtgtgttttttttttttcctttctgggtggttttcctccttccctcctcagtatacccactatcatctctacccttcacttacactttttcagctgctgcaggaaggacagacaattgctttttcatgggcacttgtggtggtgctgagtagaatgtctgtagacttccatcacgtatttgactaagagggttttgggggagaaggaggatgaaggggtgccaaagatttgcatgcctaattttttcaaagcttggtggcagctgatatttggggttttaggatacattttcttttggcagcctggcttagcgttctggctagtctgcttgtggatggtgttgttgcctctttctgctgtaagttgcttcctactcacatattgtagggcttcacattccattagtgctgttgttactagtgcatttcaagagtggacaagagtcagaacctcatttcagactgaggattaaacagagggattcatctaagagctggcaccgcaggcagctgaccacacctcatttggcatcattgttttgactgcctctgacatgctttgctacatggccaacatgccactcctgtaaatcctttcttagaacaggatgagtgatgggcaccttgggctagttgagtaggtgtgctggtcttcaaaactaatcactctacagcatcccaaattgaaaaggagcaccttcttcctcctcttcttttttttgagtcaacattttgctctgtctcccaggttggagtgcagtggcgcgatcacggctcactgcagcctcaaactcctgggctcaagcgatcctccaagttcagccccctgagtagctggtaccaaaggtacacaccaccatgcccagctaattagaagcaccttcttaatgataggcatatggcctggatagtctctgcccaagttggataatgatcaacttcataagagatggccacttccaaacaggatttctcctagtttctctacttgaggtaccacagagtactggcattggcctcagagctgccttctgagtctagatctagcacttctgagctgtgggatcttggaaaaattgctcagtttccccgattcaaattactttttcctgttgggaggattttggattatttacctgaagcatttaacgctatccctgtcagaaagttagaaaaaaataaactgtacctcttttgtaccattgttgcaagattatacctgtctttataggaatttgttatcaaatgacatacaaaggttcttataaacattttattaatgttttaaatgttacatatactatattcacatcatttaaaataccttttgactttttaaatcagtgctgtctggtagttatacaatgtgacccaaaaaagtgagccacatatagaatttaaaattttctagttgacatatttgaaaaagtgaaaaaaaaaaccccaggtgaaattaattttaataatatattccaattaacacaatataaacatatttcaacatttaatcaattaaaaattattaatgagattttaatgtatttcttgtactatgtcttggaaatccagtgtgattttacacttacagtgtgcagaggccttgttcgagtgctcaatgggccacacatgactagtggctaccgtattggacagcgtgttctgaattatgaaagaagtagggtttctgcaacagagcctacgtttaaggaaacatgtgatagtgttgtcatcatccaaatcctttgtctcagaaatatgaaagaacacaaagggtactgaacttccttcagtagtgctgctaaatgtagcctgggtcattattgaaaacatcaaactcttttacatatgccactgtatattgttttactttattaggttcatattaattttatggtttaaagactcaacagtggtgccatgttgtctggtttcctctcactgggcaaaagttagtatcccagccaggagtggtggctgacgtctgtaatcccagcactttgggagcctgaggcaggcaattgcttgagctcaggagttgaagaccagcttgggcaacatggtaaaacctcatctctacaaaaaatacaaaaattagccaggcatggtggcatgcacttgtagtcccagctacttgagaagctgaggtaggaggatcacctgaacccagggagctcaaggctgcagtgatccgtgattgcaccactgtgctccagcctgggtggcagagtaagaccctgtctcaaagaaaaagttggcatcccactactgggtaattcttcttgattatctgttattctgtgttcataatattaaatcttattttaatggtagtctaagcaaaatctcactggaaaggtatacctactacaaagatttatagtacattccaaacctgataagagcactttagagattatttgcagccctagattaccatactgcttccctctgatggtgggcctattaaaactgactttataaataaataaaaattagaattttaagtagaagttagagctaactataataacttattttagttctgaagatgtgtccatcttttgtatgtatgtaggttttagtggggctttttctttttttttttgagatgaggcctccctgtgttgctctggctgctcctgggctcaagggatcctcctgccttcgactctggagtaggtgggattacaggtgcacaccaccacgcctggctgagttgggctgttgtgaacaccagctgcagatgtttatcaagttaggttagacgagtgatcctggtaagtatcatgggaaggaactatgggagccaaagagccagcacctggtgtggctgggttcgcagagactagtctttgatctagtgtggtgcgggagcctgtaggagtctggggtcttctctctagactcagtctttttgcttctcttatttgtgctaatgagttgtctcatctgcttacttagaactccagttcatgatgcccatcatgagctcttcgttctctgctatccgtcttgaattcagtgactttggtggactctctcatttgttctaaaatttaccatgcattttccaaagaatcacatgacctaggaatagtgacagttttgtttcttttaaattcttctacttttaagtatgcttaattgaaagtgtacttaagaagctgggcacagtggtacacgcctgtaatcccaggtacttgggaagctgaggtgggagaattgcttaagtccaggactttgagcccagactggataacatatcaagacctcacctctaaaaaaataagtaaataaggtaattttttaaaaatataattaagtatatgtatgcttaattgaattttagtattaaatatattgaattaaaattaagtataattaattaaattaaaactttaaatggccttgggtgggatcccaatatgtattaaacagaagcagtgatagtgggcatcttaactttaatgtaaagagcatataacagaattcatatctgttcacatcaccacttaagcatgatgtttgctgtggggttcgggggacactctttattagactgtggcagttcccttttctctcttgttagtgaagtttttttctttggcaaaattattccttctaatacgataactgaaacaaaaatagcacatcaagcatcaaggtttgtataatgtaggttaaggaaaatctttggacatagatttttttactttaggcgttatgtattgtatgataccactgactctatttcttatatgttagtattgcattcatcgtattaccatgttgtcagcatctttaaaaaggttatggtcttctgaaaatgaaaaatttgaaactttaaaatatttacagactatactgaagcattgagaggatagagtaacaatgatgtttttagtaaaattaatgtttcatatttataatttaccaaattttgatggattaatgccattttgttttggtaaaattgatctcttctctcctctatccatctcttgccctctctctttttaattgactttttagtagaggtaattgcacacttacatgcagttttaagatgcaatacagagagattccttgtatacgtttcccagtttcccgcaatggtaacattttggaaaattataagatcacaactaggatattgacacggatgcaatgcagtcattatgctcagatttcccagttttacctatactctttgtatgtgtgtgtgtgtgtgtattaagttctatgcaattttattctgtgtagatttgagtgtttgaattttatcaaatgcgtattcttacacatattgtgatactcagtttttctttattctgttataaagttgtgatgtgagttgcattagtagatgtttctgattgtaaccatttctgcactcctagaataactcaggaccatctcaacctcaagactgaatcgttctatttcccagttcatattttggagaatatacttatggttgaacctacacatgcctgcctaggtggagattttcaggctgggttgtctcaaatgctattagcagcctgtaaattagcttccctgagtccagtgttcactcctgtttccctcagcttgggtgctacatgtgtgtggtgtgatagaaaatagggttgtttagggctagtctatcactggggctgtaagtgttgcatatgctataattgtctagttattagtacatgtatcttatgacagtgtccccactattcctatgggtactataatattaaaaaaatgcatttgttcttttactagtgaaccaaggggaaatctattccattctgatgcattttttttttttttttttttttttgagacagagtcttgctctgtcgccaggctggaatgcagtggcataatcctggctcactgcaacccctgcctcccgggttcaggtgattctcctgcctcagcctcccaagtagctgagattacaggcacgtgccgccacgcctggctaatttttgtatttttagtagagatggggtttcactatgttggccaagatggtctcgatctcttgaccttgtcatctgcctgcctcagcctcccaaagtgctgggattacaggcgtgagccatctcgcccagcctgcatcatgttttaatgaggctcagtgaccaccactggaggcagtgcagcccagtggttaaatacgcaggcttgggatttcatagacctggctgcctcttacaattcttatcttgggcacctttctgagacttagttcgttagtttactggctattaaatgggaataacaatttttgactgaaaaagttgttcaaataactcaagaattgtataaaaataatattcaccacaatgccaggcattcattggatggtaagcattcatcggtgcttaccaatgatgaatacttaccgtgatgaatacttggtaagcattcatcggatggtagctatcatttctcttacttttgtttcttgtattccaggctgatacatatgacactcttttgtgcctaccgcatgcagtactcttactcatccttcagattgtaactcaaacatcacttcctcaggacagtctttcctgacaccccagactatgtcatggtgctcggttcctctgcatcgcagcacacctcttgggttgtaattacacaccgatgtgtgggattttctgattaacctttgtctcttctactgtaaactctacaaaagcaggaactactcttgtttctgcccactcttgcattcccctactgtgtacatggcacataggaaatggccaaagtacctattattattatggttattatttttgttattattgaatagaaagtacgtcaaatcaaacacacttcctctacagtggtggaaactgaggctgagaaaggtggggtggcctttccaaatgtaactagtatattgcaggcagtacagtgatgttggctggtggtggagtcttatgcttagaccttattgggtacacaaagcgaagtattcagtttcaattataccatgggaaatagtgtggggatagtaatggggtttcacagtgggggttctgaggaccatctggaggtcccctgaaatctaaagtgagaagtaaagccctactgcagaggctctcaactgtcagtggggctctaggtatggctcagacaagtttttgccaagtacccgcctggccttttctggtggtttctattgggttgcccatatgtacagtggccctcactcaagggcatcttaatggtggtgcttggcctctgcccatgagcagttccaattccagagcactggtatttggttttagaatgcactgtgtggtggccaagccaagattagttgcatcccctgactcctgcctgggtcagtgactttctttttccactacatcagtctgacccttttaacaacaatgtaccccataagggggcaaacccatgacctgaagattatgtgtctcaggctctacacgtgagcctggcagcaacacaggctgaagtatttccttcctttccctgcaccccacctgcccaaatacacacttgtaagataccgatttctctttcctctttcagacacttggcaaagtctggctaggacttcatctcctcttcatcctcagtgacctggttttcctatttttttctgaagtataaaccatcattcctttgataatcagatgctgtttattgagtgctccagaaatatgaatgtgagtctgatcctggaaaatgagtggtcccatttggggtgggatcctcaccccctaaaaatacttgagcaggtacataaatatccatgactgtgagctctgggggcccatgagagctgcattcttatgccagcatgcacaaaaaacaacatataccttagtgtaaagcactctgacacgctggtgataatcacaggagtctggacagtttattttgtagcagatcacatgtggcatatgtgtgaaaatatccatgtttccagagaatcgaaattaaacagtgagttcactttgttctttagtaagaggtacctttcaaattcattcatgttttcatgagctcgttaggtggatgttttcttgacctaggctgtgttaacactttataattatgtacaaaatgttgtgtgtaagtgcacgtgtgtatacttttggagagaagggtcagcatccatcatctgattcttaatgggggtcagtgtagcaaaaagtagaaaattattgaattagaccatggcttgtcagtattccattcacccagttactgtcctgaaccctgtttattcacatggatagggtacgacaacatcgtgtatgtcaggttgcactgaaaaatcactcccttggaagaaactgaacaaagacctaaatgcttaaatgctaccttatcttacatgataaaaaccattagttttatttctgaaatgaaagatatattcattttttcattctggactagggagacagttcactcttttcaattcccagtgtttttgcattatgcttttaagagtagacttaaatttgtccctgctactatttctcatgttagactgagtcagtgtgggagacagattttcctctcagtcagcttatttggcttttctggcctgtaaatttcacttttgacttgacccactctcctgatttgtgtttggcacttttgagacccattcactgactgtccctttaacagttggttctgtctttgggtgaagttcacattccttccctcatattgttgttgtttaagtcaaaataatacacaactttctagatcgaaagggcccaatataatgaattaaatgatacacaacaaattaaatgataaataatacacaactttctagattgaaagggcccaatataatgaattaaaaatacattcatagtactaaagagttatagataaacatgaatcttcttttctgccattctctacttctaactcccatttccctagagacaatcatcattaatgttttatctgcttttctgctgtttctctccacatttctaaaattgattatccatattgctgtttttgatagtaaaaattttgatattatctcttgacttcctaaagtggaaaaagatttagctagctcttttatgtactctttctctgccagttcttccttttccttctaccttcctaatactttataacatagtttctggttaaaaatacattcataaaataaaatgtgaagaaaagctaaaaaaattcagagcttttattattatgaccatataaatatttatagtagaaccatatagtattctacaattacatatcctttccagtatagctttttgtttctctggccttactaattgccttagttttttatttgcttctgtgcctatgtagttcttactgtttcattttcactttctctgccaaacattttagataatgctgatttttttaaaaccctttatcttcctgctctaatctagagcaatttatttctccaataccacctggaaatgtccttcagttctctcttatatctcttttctcaggtatcagatctccttttttcttaaatttccccgtggttttgaagaagaaaggaggcatgcattttttttttttttttgagatggggtctcactctgtcacccaggctggagtgcagtggtgccatctcagctcactgcaacctccacctcctgtgcttaatagatccttccacctcaacctcctgtgtagctaggactataggcgtgcttccatgcccagcttattttcgtatttttagtagagacagggtttcatcatgttgcccaagctggtcttgaattgctgtgctcaagcaatcctcctacctcagcctcccacagttctgggattacaggtatgagccatcatgcccggcaggaaaatcttttgagactttgagtatcagaaaacattttgttttagtcttacatttaattgacagtttgctgggtataaaattttctttgaatactaattttcctcaaaattttgatgctattactctgctgttttgtagcttttggtgttaccattctgattatttatatttttcatgctttctttttctccatctctagaagcttttagtattttctctgtattgttgattgtatcagtaaggatctagtcaggaaaatagagcctatgccaggtgattcaacagggatttaatatgaggaattacctttaagatgtagaaagaactgagatgccaaatgcaagaataatgcaagccagagattagcaacagcagaaagcattaccacctgtagagctggaaggaccaaggaagaggtagttttcctaagactccaaaggtagggttgccctgggagataaaaggataaatgcaggttcttctagagatgctgcccgaggcaaagggaaagtgggagaaatatcctggcttttttcttctttctggtgctagtctcccaccagtgcttcttcttggctgaaccaactagatgtcagctgacagggaaagggacctggaggagtaattttcatatgatatagggcagagcaaagcagatgaagggaggggaatgaattggaggggaatgaaataggcagacaactgtactcactggtgttctgaaatttcacaataatatgagtgtttttacatccttgttatgagcactttttgcttgctttttctggaactttaaaatgggatgtggctcttctcagttgattctctaattttctctcctattttccaactcttcttttttcttttactttctgagaaattgactcaactttaccttccagcctatttattgaatttttaatttttgctgtcatatttttaatttccaagagctctctcttgttttctgtgccccccttttaaaagatagcaccttgacttgtttcctgtatacaatattttatctttctgagtgcatgctttcatcagttgtagaatacacttttaaaaaatattttaacttatccaaaattgagattcattttataattggtgggctgttataatttaataagtagaatttttttctttctaagggcaacttagaaaaaaaggtgcttcttacaattgcaggtatattacatttgttgagataaggttttttcctctgagaactaaatcagaaggaaaaaagattttttaaaaaaaattttcttttactttctgcatagtgtttgcctttcaagttcatttttttctattaattttgatctctttctcttttatattataaacttttcctaaacttttggtaatccttagctgtttatatttaagggtgagccactatggagctttccagaagctctgtgtgtatgagtggaacttgttatagtggtgaactttactatagggtaataatgtatcaagcttgttattcaacggattatcccaaatatgaatatctggaagttgcttatcttaggttgttcagtttcactacaaaattcccctccaaattccttcttgagggtcataaggctgccctatattcttggggcccagggagtgaaagtctcacctttaggactgcagacttattacttaaacccaattttcagttttatgcttcacccaatcttcagctatgcctggtaccttcctgttcagatcttcttggcttcaacatcttcagacaataaaactaacgccttttgcctggatgggacgggcactttcttctctgtataaggttagggaggagatccgactcaatttaaggttgaaaaatgggatatttacataaaaataattatgagagctccttatacagactttcaactaatcttgctattttcagtgccactgcatcccccacctccagaggtgacagtgactccaattctagagcctctgaactggactggctttgcttcttgttggagttccctgccacccttctgtgtacactttggttgtagtttttcagttctattgagtcagttaccttttccgaacttccaacattttgttgatatttctcactctgtcacccaggctggagtgcggtggcgcgatctcggctcactgcaacctccgcttcccagggtcaagcaattctcctgcttcagcctcccgtgtagctgggactacacgcgccggctaccacgcatggctaatggctaatttttggatttttagtagagacagggtttcaccatgtcggtcaggcttgtctccaactcccgacctcaggtgatccgcccacctcagccttccaaagtgctgggattacaaacgggagccacccctcccggcttgtcgatatttcttatctgctatttcctttctgtactctttagacttgtaggtttatgtcttaaaacatttatttatttcattttggtggggattttagaaagaatctgtgtttatatggctgtgatttacctgaaatctcttctgtagtaccatgcaagtgttcaaagatggtggtgccattttttgtggggtggaggtggggtggggaataatcttatcaaagcaggggaaagagagacaggatgtatttgagagagcgagtgaacatatgttttggtccaaaatgccctagctcctttagaaattcccatttggttatagtttccttctaagggctgcttttcttcatttactaactcagtgcattcttttacccttgtggacatacctgacttctgtggttctttaaaagcaactacagacaagcaaaacacacgaataataatgcataccaattgctttgccaggtaacaacaaaaagggtggtgtcttgcaggtttgtcatcttggtatatgaagactgttgattttactttatgtctggagctgtttcctctaacatagctctttgttggcttttaaaaatgcgtctttcctacatggacaggaacatcatttagggatcctgttcccagtgtaaggagacttttaggttttaaagtagattttaaaaaattgaggtgactcaattttaaggtaaaaacagggatatttacataaaaaataattggagatatttgtgtcctggcaggttatttgtagtttatcacagcataatgtagcaattttataccctttctacaatctgttaaaactcttttgttgtaaaatgagagagaaaaaggtgaaaaatatttgaggatataaacttgttgaaagggccgcagttaccttccattgtacccttagagagcagagaccatctcctctgaaatgaatccactctgtagcaatctccattgttgcagacagcatccttctagtgccaaaggagggaaggcagggtcctgactgtggccaagccttgttcttgtttttggggtagaatttggtaaatgctgtttttatttctaaccaggtattctgagcagggggtgattttataaccttggatatttgctcgtttgaggttagcaggccacccgtagcttgttttttctccttatttagatgaaaatttaactaattaaacaaataccccagtagtaaccaatgcacagcagtattgataggggggtgggatgtgtgtttgggcattccctctctcccaggtctccctctgacactcaaatatgaaacaagaggttgaggagcaggtggtttatctagccaaggtgtttgaaagggactggatttaaaaagtaattgtttagaatagcccagacgtcacatgttggaaagtctaaaatgttgaaaaacaatgctctaatttccttatatgagggagaagtgtcagcattaaagctgtttaaaccaacttggggctgggtgtggtggctcactcctgtaatcccagcactttgggaggccaagccaggtggatcacctgaggtcgggagttcaagaccagcctggccaacatagtgaaaccccgtctctactaaaaatacaaaaaagttagctgagtgtggtggtgggtgcctgtaattccagctactcgggaggctgaggcaggagaatcacttgaacccaggaggtggaggttgcagtgagccaagatcataccattgcaatccagcctgggcaacaagagcgagactcctccacctccaaaaacaaaaacaaaaacaaaaacaaaaacaaaaacaaaaacagaaaaccaacttggattttgatactagttttgcacagaagcagtatgggaggtgacgttatttgaaaagttatcagatcatcaataaaatcttggccagacacttcctgccctcttgccttgtacaatatcatttaattggaattgtatactcctagagaaaaaattttaagctaatgggagaagctaatgggagaaataaaatgaagctgtatttgccgcccttccagcgagactgcaaggctgggctcttctgctggagctgcatctggatagaaggaggctttctcctcccctccttcgccctcactccctttctttaaagtcagctagggaataatttgtccatataaaaaggtcctttcaggcactggagggctttgctaattgtatttgagagaataaaggtaaactacaagttggcttttaacaacagaaaaataatgagttcgcatggcaacatgtttaataagattagttttattaggaaaatgtaatcaagtggactgaggtgttgcaggaggaatggctgattaaaagccattcattttctctagctaaagaactatcagttggctttcagaactcatttaaataaagaggtattaaaatctaaaaaatatacattactcccattttcttggactaaaagggaaacttgtttattcctctaatctttacttagctttagttgtgctaaagtagaatatttgaagaacttgggaatctcctgattagagtgttttttgtttgatcgtaaataagtatttgcttgcaattggcacatattggcaggtatggatttattaatttcaaaaatactattgaagtggtacaatctgaaaatgtgaagagccacaatacctgtgaaaaaggtcttttccaagcaatgagcttcattttgtccttctgaaaggtagtcactgttttttttccattatgtgtggtaatgtaattaatttcagttagaaagatgttttgcaataatggtgacaatatacttaaatatgcatgactaaaatagcaatgcagcgtgggaatatgttttataattgaaatgctatgctattttctttttttttttttcctgtatgaaggagaacagcacttcagttaatttggccagcttcttcacaattgaaacacaatttaaattcttgttggaatagtccgatcacttaaaatatggactatagacacattaccagttcagcctgtagaaagaacatgtatcagctccagcagttatacccatcagtgtaactgaaggagtctgaggcaaaactgtagaggataaaagctcagaattccttttttttttctgcctttctcaccccttccaatgcctctgagcacctcagggtctcagcatccttttttttttttttttttttttttaacttggtgaggacctctaatgcacaaaacattagaggttcagtagagtagctttaccaggacattgcatttaaaggaggaacctggaaaaggaaggcttaaagtaaacaaatttaaaggtgatattttgctgtcagtcacaggagatgagagtgttcctcaaatgccaggatttactcctttgataagagagccctgctcatgagacatgtcttcagtcaggccacttgatggccacattcacaacttaaactcccttgcatgaagttttgcattgcactagtaaagtggaagcaatattactctgcactttagatcatttgacaggacccagaaaggcatgctcatgtagtcagccttccagcttggaagaagagagactgacaggccactgccagcttccttggccactgtactaaccaaggactctggtgtttgatgctgacagcagccacagttttttaaagtcttagagcagagttctggttcataaggcctggccattgatgctgctatccatgtgggtggatgtggtggaggagcccaaggtagtggttcaataaatattaattgatgggtattaaaacaatcgatgacccaagggcatgccacctcgtgtgccagagactttaatttgttaaatgaagtaaaccacactgagttgctcttggaagttatgaaaaatgattgtaaagggttttttttttctttttttaagctcaagcactttgagtgatagtagccaaagacaatagtcccagcagccgagtgtagaacctccccatggccctgcaagcagtgtgtatgtagtaacagttttaagtgatatcctttctggggtccagccaattgttaagagagaggaactagaataatatattgctggggattcagccctcttactgatcataaaatttcaaaggagctcaagctgtaggaaattagtttggattagtatttatcttctgattttttttctcctctggggtgaacttgcttcttgtataaagatcttaaaaaatctggccccacagactgtggggaggggggtgcagagaggattattttttgtataataaacaatatgactattggcctgaatttgaagacctttattaattatttcttctacccagatatctctatgtggaataattactaaatcactggtgttggaaagctgtgtttataccctatcttaaagagatttaatttctttttttcttttgagacggagtcttgttctgtagcccaggctggagggcagtggcgtgatctccgcccactgcaagctccgcttcccaggttcacgccattctcctgcctcagcctcctgagtagctgggactacaggcgcccgccaccacgccccgctaattttttgtatttttagtagagatggggtttcaccatgttagccaggatgttctcgatctcctgacctcgtgatccgtctgcctcagcctcccaaagtgccgggattacaggcgtgagccaccgcgcccggccaagagatttaatttctttgttagtcaacaattctgtgtgagattgacataccaattttcccactgttgccacacatattatattcatttcgatcttaggttatttttccttttctgtgctcagtggtgacatatatttatggtaactgtatgttcaagaattccttggattaaacagatttcagatgtggtttatttgacctctcagtgcacatatatttttgttaaccacttgactctccctatcagcacacatatagttaagcctgaagatggttggtgattgaacccatatatgcaccctccagcactccgtgagctccttctctgggtaaggtattgtactatgtgctgtgaggacaatttagcacctgtgttggggttccctggtgggtcaaaatagatgagtagatatgagcctcttaagtgaggcaaatacagggaatccaagcttagaactagagacgcattagacacatttaagaaatagtgaaataaccctgcttgaatggatggatttcttagaagagtggtttggaaagatctgtgtctttttgaaatttgttccttccttgactgccaaaacaccatcatctccaagttctatacctacattgccgcatccttctttgtcttctttgatgacaaagtgttctcattgttcaattcccacctatgagtgagaacatgcggtgtttggttttttgttcttgcgatagtttgctgagaatgatggtttccaacttcatccatgtccctacaaaggacatgaactcatcattttttatggctgcatagtattccatggtgtatatgtgccacattttcttaatccagtctatcattgatggacatttgggttggttccaagtctttgctatgtgaatagtgctgcaataaacatatgtgtgcatgtgcctttatagcagcatgatttataatctttgggtatatacccagtaatgggatggctgggtcaaatggtatttctagttctagatccttgaggaatcactaaactgtcttccacgaatggttgaactagtttacagtcccaccaacagtgtaaaagtgttccagtttctccacatcctctccagcacctgttgtttcctgactttttaatgatcaccattctaactggtgtgagatggtatctcattgtggttttgatttgcatttctctgatggccagtgatgatgagcattttttcatgtgtctgttgactgcataaatgtcttcttttgagaagtgtctgttcatatcctttgcctactttttgatggggttgtttgtttttttcctgtaaatttgtttgagttctttgtagattccggatattagccctttgtcagatgagtagattgcaaaaattttctcccattctgtaggttgcctgtttactctgacggtagtttcttttgctgtgcagaagctctttagtttaatgagatcccatttgtcaattttggcttttgttgccattgcttttggtgttttagacatgaactccttgcccatgcctatgtcctgaatggtattgcctaggttttcttatagggtttttatggttttaggtctaacatttaagtctttaatccctcttgaattaatttttgtataaggtgtaaggaagtgatccagtttcagctttctacatatggctagccagttttcccagcaccatttattaaatagggaatcctttccccatttcttgtttttgtcagggttgtcaaagatcagatggctgtagatatgtggtattatttctgagggctctgttctgttccattggtctatatctctgttttggtagcagtaccatgctgttttggttactgtagccttgtagtatagtttgaagtcaggtagcatgatgcctccagctttgttcttttggcttaggattgtgttggcaatgccagcttttttctggttccatatgaactttaaagtagttttttccaattctgtgatgaaagtcattggtagcttgatggggaaggcattgaatctataaatgaccttgggcagtgtggccattttcacgatattgattcttcctatccatgagcatggaatgttcttccatttgtttgtatcctcttttatttcattgagcagtggtttgtagttttccttgaagaggtccttcacatcccttgtaagttggattcctaggtattttattctctttgaagcaattgtgaatgggagttcactcatgatttggctatttgtctgttattggtgtataagaatgcttgtgatttttgtacattgattttgtatcctgagactttgctgaagttgcttatcaacttaaggagattttgggctgagatgatgggtttttctaaatatacagtcatgtcatctgcaaacagggacagtttgacttcctcttttcctaattgaataccctttatttctttctcctgcctgattgccctggccaggacttccaacactacgttgaataggagtggtgagagagggcatccctgtcttgtgctagttttgaaagggaatgcttccagtttttgtccattcagtatgatattggctgtgggtttgtcataaatagctcttattattttgagatatgtcccatcaatacctaatttattgagcgtttttagcatgaagggctattgaattttgtcaaaggccttttctgcatgtattgagataatcatgtggtttttgtctttggttctctttatatgatggattacgtttattgatttgcgtatgttgaaccagtcttgcatcccagggatgaagcccacttgatcatggtggataagctttttgatgtgctgctggattcggtttgccagtattttattgaggacttttgcatcgatgttcagcagggatattggtctaaaattctctttttttgttgtgcttctgccaggctttggtatcaggatgatgctggcctcgtaaaatgagttagggaggattccctctttttctattgattggaatagtttcagaaggaatggtaccagttcctccttgtacctctggtagaattcggctgtgaatccatctggtcctggactttttttggttggtagcctattaattattgcctcaatttcagaacctgttattggtctattcagggattcaaattcttcctggtgtagtcttcggagggtgtatgtgtccaggaatttatccatttcttctagattttctagtttatttgcatagaggtgtttatagtattctctgatggtagtttgtatttctgtgtgatcggtggtgatatcccctttataattttttattgcgtctatttgattcttctgtcttttcttctttattagtcttgctagtggtctatcaattttgttgatcttgtcaaaaaactagctcctggatgcattgatttttttgaagggttttttgtgtctctgtctccttcagttcttctctgatcttagttatttcttgccttctgctagcttttgaatgtgtttgctcttgcttctctagttcttttaattgtgatgttagggtgtcaattttagatctttcctgctttctctcgtgggctttcagtgctataaatttccctctacacagtgctttaaatgtgtcccaaagattctggtatgttgtgtctttgttctcattggtttcaaagaacatctttatttctgccttcatttcgttatgtacccagtagtcattcaggagcaggttgttcagtttccatgtagttgagcagttttgagtgagattcttaatcctgagttctagtttgattgcactgtggtccgagagacagtttgttataatttctgttcttttacattttctgaggaatgctttacttccaactatgtggtcaattttggaataggtgtggtgtggtgctgagaagaatgcatattctgttgatttggggtggagagttctgtagatgtctattaggtccgcttggtgcagagctgagttcaagtcctggatatccttgttaactttctgtctcgttgatctgtctaatgttgacagtggggtgttaaagtttcccattattattgtgtgggagtctaagtctctttgtagatctctaaggacttgctttatgaatctgggtgttcctgtattgagtgcatatatatttaagataattagctcttcttgttgaattgatccctttaccattatgtaatggccttttttttctcttttgatctttgttggtttaaagtctgttttatcagagactaggattgcaacccctgcctttttttgtttttcatttgcttgccagatcttcctccatccctttattttgagcgtatgtgtgtctctgcacatgagatgggtctcctgaatacagcacactgatgggtcttgactctttatccaatttgccagtctgtgtcttttaattggagtattcagcccatttacatttaaagttagtatagttatgtgtgaatttgattctgtcattattatgttagctggttattttgctcgttagttgatggcagtttcttcctagcatcagtggtccttacaatttggcatgtttttgcagtggctggtagcagttgttcctttccatgtttagtgcttccttcaggagctcttgtaaggcaggcctggtggtgacaaaatctctccgcatttgcttgtctgtaaagtattttatttctccttcacttatgaagcttagtttggttggatatgaaattctgggttgaaaattcttttctttaagaatgttgaatattggcccccactctcttctggcttgtagcgtttctgctgagagattcgctgttagtctgatgggcttccctttgtgggttacccgacttttctctgtggctgcccttagtagttcattctttttcaaaaagttgctgagtaatactatgttgtttaaatacgccatgatttgtttatctattcttctgttgatggatgtttttttttttccagtttggaactattgtgaccgaagctgcaatgagcattcttgaatacgtttttttgcggacccatgctttcatttctgttgagtaaacatccaggaatggaattgctgagtcatagcatagatgcaagtttaactttataagaagctgtcaaagtagtatcattttacattccaaccagcaatgtatggagttacagttgttctacaacctcatttacacttggtggtgtcaggtttttaattttagctattctgatggatgtaaaatgctaccttgctgtagtttaaattatattctgatgactagtggttttgagctacttttcatgtgcttgttggctacttcacttttgtgaccggtctgctgaaatactttgcttatttaaaaattagcctgtctttttattgttgtttgaaagatttcttttttatatattctggatataagtcagatatctgtatagtgaatatgttctctgtctttcacctgcattttaatattttaactgcgctttttgatgagcagtggtttttttttttttaaatttagatgtagtcagtttttttaatgttctgcttttttggtatcatctttaataaaaatctgccaaccctaaagtcacaaagatattttctggttttctttcagagcttcatgaaagttttggcttttatatttaggtctgtgatctgtctcaagtgaatttttgtatttgctgtgaggtaggaatcaagttttagttttttcccatctttttctgttctgccacaatgcattgaaaatgctttgtttctcccattgtcttgctcaggtgccttcgtcaaaactcaagtgactattttaagtgcggttcttagactctttattctgttccatttatctatttgtctattcttacaccagttctacactgtcttgaaaactgtagctttgtagcaaatattcaaatctggcaatgtgagccccctaatttgtccttctctttgaaaaaattttgcctactgtaagttttttcctttttatatataaatcaacttgtcaatttgatttaagaatcaacttgttagtttctaaaaaaaaaaatcctggatttttgatttggattgtattgatctgtacaccaatttgggggaaaactgacatcttaaatatactgagtctttcaatccatgaacatgagatactcctccatttatttgggtcttctttatctcagcaatgtttatagttttctgtgtaaagatcctgcacatttctgatttttaaaaaaaataattttttgtcttttgctgctattggacacagaataaaacaaccatttccaattgttcattgctagtatatagaaatacagttgatttttatatactggtgtttgtttctgttctttagattgagatattttctattgttatttcttcaagatcacggactcttctgctgtctctaatctgcttttaagcctgtctagtgactatttcctttttcaatattgtacttttcagttctataatttctatttttttttaatatagctttcatttctctgctgagattactcatatggtaactctctttggctatctttttacttttatttttattttatttttaaatttagttttattttttatttctttaactcaaaaatataattttttttttcattatactttaagttctgggatacatatgcagaatgtgcaggtttgttacataggtatacacgtgccatggtgatttgctgcactcatcaacctgtcatctacattaggtatttctcctaatgctatccttcacctagcttccaatcccccaacaggccccggtgtgtgatattcccctccctgtgtccatgtgttctaattcttcaactcccacttatgagtgagaacatgtggtgtttggttttctgttcctgtgttagtttgctgagaatgatgcttcccagcttcatccatgtcctggcaaaggacatgaactcatcctttttttacagctgcatagtattccatagtttacatgtgccacattttctttatccagtctaccagagatgggcatttgggttggttccaagtctttgctgttgtgaacagtgctgcaataaacatacatgtgcatgtgtctttatagcagaataatttataatcctctgggtatatacccagtagtgggattgctaggtcaaatggtatttctggttctagatccttgaggaatcaccacactgtcttccacaatggttgaactaatttacactcccaccgacagtgtaaaggcattcctatttctccacatcctctccagcatctgttgtttcctgattttttaatgatcaccattctaactggcgtgaggtggtatctcattgtggttttgatttgcatttctctaatgaccagtgatgatgagcttttattcatgtttgtcagccacataaatgtcttcttttgaagtgtctgttcatatccttctgtcatatccttctgtttttaagtgtctgttcatatccttcacctactttttcatggggttgtttgtttttttcttgtaaatttgtttacgttctttgtagattctgaatattagccctttgtcagatggatagattgcaaaatttttctcccattctgtaggttgcctgttcactctgatgatagtttcttttgctgtgcagaaggtcttcagtttgattagatccgatttgtcaattttggcttttgttgccattgcttttggtgtttttgtcatgaagtctttgcccatgcctatgtcctgaatggtattgcctaggttttcttctagggtttttatagttttaggtcttacatttaagtctttaatccatcttgagttaatttttgtataaggtataaggaaggggtcaagtttcagttttctgcatatggctagccagtttttccaacaccatttattaactagggaatcctttccccattgcttgtttttgtcaggtttgtcaaagatcagctgcttgtagatgtgtggtgttatttctgaggcctctgttctgttccattggtctatatatctgttttggtaccagtaccatgctgttttggttactgtagccttgtagtatagtttgaagtcaggtagagtgatgcctccagctttgttctttgcccatcttttattttttatttatatttatttatttactttttgagacagaatcttgctctgttgcccaggctagagtgcagtggcagtgcagagctgcagtgcagctcactgcaacctctgcctcctgggttcaaacaactttcctgcttcattctccctagtagcaatggccacctcgctcagctaatttttttttttttttttttaagagtcagggtttgatcatgttggtcaggctcatcttgaatttctgatctcaagtgacctgcccaccttggcctcccaaagtgctgggattacagacctgagccattgtgcccagcctctttggccatctttttgaaaagtctctaaacatatttataatagctgctttaaaactcatgtctgctaattccaacatttatatcatctccaggtcactttctactcacgatatttttcttgagtgtaggtcacctctccagcccccgcatgtccagtatgttttgattttatactggatgttgtggatattatgttataaagattgtattcagagtatttatttgaagtcttaatttttgttctagcaggtaattaaattactgactgacgtccttgaacttttggaaacttggttttggtctttcttagggttgctctgttttggttttgcttttagtcttagaatgaattgttagtctttggacatagtcttgactcctaacctgtggtccttttgtagggttttcatggaaagtctgaggcattccccagtttcctctagcttggtggggttcaaactccaaactctcttccgcacagagggcagcagttcagatgttcctcagcttctcagcctaccctctttctactggactcctgatgtctccttcgtgcatgtgcagtttagggatttaccatggacagcagaagtttatgaaagacttgggtgctcctttctctgtggctctgttcttcccaggaattacccccttgatatcagctctcacctatctcttctgatctttaaagccaagaagcttgtgaccttctgcttgagtgccagctgccccctgcttctggggccagggggtaccctcaagggaaaagccctgtcaatttagtttccaaatagtgttgtctcttcttttgagggtcaaatctctgctagctaccgtctgcatttggtcaatttctagtgctttcaagtagttcttcaaaaaaagaatttggccgggcacggtggctcctgtctgtaatcccagcactttgggaggccgaggcgggtggatcacctgaggtcaaaggtttgagattagcctggccaacatcgtgaaaccctgtctctaccaaaaatacaaaagttagccgggcgtggtggcgggtgcctgtagtcccagctacttgggaggctgaggcaggagaattgcttgaacccaggaggtggaggttgcagtgagccgagatcacgccactccattccagcctgggtgacaagagtgagggtccatctcaaaaaaaaaaaaaaaaaaaaaaaaaaaagaatttgtccaggatatagaattatttttggagagagttaatctgatacaaactatgccaccactactggaatgctctttttaaaacataacaataattctactaatcacaccaaaaagttgccaatgattccttaattttacccaaatgcagggaattaagtttcttgtgagggagataatatttagtttagcttttttcttttttttatagcaaagttgatagaaaagctttcaaaaaaatgagtttactcattccctggctgagaagcatattgttactaggttggtgcattaaaagtaatggtaagtaccgcaattgctaatagttatagcgtgagcatccctgtcttggtgttaaagcctggaagtcttccccttggcagcagctgctgagccagttttatggtaatctcaggtattcaagacatggtcaagagcaaagaagtatgtgacaaaggcctctgagcagctaaaatagacatataatcaattaatttcatcacaggggaatctttcaaatcctcacttggaacctatttaccccaattttaagtacagctataacaagccttgtgatttcttcccctagcttatagaacattagtgggagtgagtgagagaggggatgatggcatgctatgggcaggcacgatgacagtggcaggaagtgactggtgacagcagcattaactccagtgagtgcagtttctgtatttgacgcagggctaggtcccagtgtaacaaagatacctgaggtttggcttgtgcatcagggagcttgtgcagtatcgggaacacagatgcgcaaaagtgcaaaatggactggtgagtgaaacaataacaaattttcactgagtgcagttatggaaggaaggaggaattggatggttcagagacgacttcagtgagaagaagttcgctggctcacataaggttgatctctgtgtccgtaggggtctttggaggatacagatgacacattgaaagggaatcaaacggaatctataaataaaggcactatttacaaagctatgtttaggaaaacctacaaaggatggttaagaaccccagggcctgtgaacatggtgggaagctgtgaccttccctagaccagaaggagcaagaggaggaaaagttaccagagcctgcaaggcctgtggcagtaggggttgcggggggaactgcctgtggcatctggtctgggagagcagcccctggcatcccacctttatctcctctgccctctcacctcctgctaatccaaccggaagccagaggatggcgggggtgcccattggtgctgtgggtatatatcagcacagagctggctggagaagggcgggaagtggactggaggagtaacctgagaatatccagcaaagttgagtagaattttgtactctagaggtccctagcaggaaggggaccagcagccaaggggagaaagcatggcaggaaagagtgagggtcatcagctcatgttccactagtgtggacgaaaaaataatatctgaaaaacacaagtctggtgtcagcattgtatagacagcagaatcccaacctcaatagtggtggaggcaactggactgctcatgattgtagcattacatatgacagtcagcatgtttctgttaccaagacagcaatgtctgcggttcattttaggagcatttccaatcaaaggtctttagattatataaaaagttttgatacttagagaaatgacattaaggaacctggaaaatttgcttatttgtaacatctctttttcctaatgagactgggtaaatgaagttttactacatttattattattattattgttatttatcaaggttattactgtaattatcactccagaacaaagacccttcaaaaccaaagtcatcttatttcatagtgagtgctagttggaaaacatttaatcagtagatcttttattacctggtggagctgctgatgtgtttagctgctatgtgaggtaggacgctcatccttcacgtctggcttatttagagatatctttggtgagttcacaacttagcagaaatcctgattcacttgacctgagtcaagctgttgttagctgttggtttaaagaccaggttgagatgagggacaattagcttgttgtcttacgtactgttttgtcctttctcttccatcttctgccctctcattccctctccaggtgcagtttctgttcctccctcaccctgatgatgggttggaggtcaactcagtcacagcaactgaaggacattgtcagtcttagtcttgtgtcatttgtctctcacagcatacatgctcacttgtagagccacccaagtattggccaattaaaaacacaaactggagcacaaaactgttttatcatatttgctggctgaacaaatgtgtcaataggataaatgttataactgggcaagccagctttagactcttaaaaacttgcccactcaacgttttcttgagttttgaccccatccactgaccaagatctctttttcctgttcggaggttggtcagactctctgtcataggataataacagtacccatctatgaatgttttgtaaggtgcaacagaactcaagctatgtttacataactcctagcatatagtaggtgttcaataaaagttggctattacaattattgcccagcagtgaagagaactgcttgactttgtttaatttagcattttgtaaacctgcttaaccaaaatacttctatttctagaaccattcattaacatttcaaggaaggctactgttctgtggaatacagcttgggaaactctaaattaagaattggacaaaattaaactgttggagttggggttctggatcttagcttagtcctcaccacaccttgaaattgcttaaataaaaacagggaagtttcattttagggtataaagcagaaatgaaaaaaaaaagccatccatataaaaacctgtatttttgttcatctcttctttgtaaacacatctctaggtgactcaaaaagttcaagggaagctgtccgaagttctcaggacaagtttaagagggtatcatgaagtcagagaaattagaattacatgctccttctgattttggacgatcagaagtaatgaggccagaaattgggcccctcctctttccctgcctccacctccgtttgacctgatcacccctcttcctgtttgtattgctgcccggcacagttgcagggtgagtgggatgcctgctcctgatcctgctcctcttcccgcccttctcctgttgggttttggtttatgcctttgcctacctcaacttcgtgccttgacaggacacagacctcagggaagagaggcctgcatgtgtcccgagcagtcttgtgggggttgggtcaccagcctttcagaggcatgtctggctggcactggtgaatcatcagggcctaggacaaacatcactcacttggtcatctgaaggccaggaacgattgtgtcattatgtatgtgcatttctcaactaagccttcaagagggtgatgggacgagaagcatctgtatatgacgcatgtgtgacacatccaaagggcaaatatatcatatgaccatattccctgcatgagccttgggagaattttcaaaagtcattctcacttacttgtgctccatacccaccaattccaaaaactgatgcctacagagatctccttgttgcttcccatgaacaagaccagctttccttgctgaggtgtgcttatgcctctggattccgtgtgccagctgtgtgaccctctgttgtccctgtcattacaggaggtgaatgagggccctaactctacctaatgatcttcctaagactgcttttgtttaatgatccagtctgttctaggtcatgagagagaaaacagtctgcaggcagccacacctcaggaaggtccaagttaatttgccagcccagtgcattgctaccagttcagagctgagtccacgatggggacagttatttggaaaacttaggtcagatcccaccctaagtaagttctaacttcagtcgggggagcaagaagtatgccagagggttcagagatgcttccactatgcacagagttgtagatgaagaccccagctctctccctgtggtgcttcctgtcagtcacctgccctttgcattttcccagagttccactgggataaaggcgcagattttcagcttaactttcctcaaggctaaaatacgtcatcaagtgaccaagtgagaattccatgaagacaggcccactatagaacaggaattggggtctctgtcagtaagaaagagacctccctctgtttggtgctgaggaggctgtgaggctacttggtttatggcagttgctgctgtgaccctaaattgtacacttattttaatgatttaaaaggaaattgaacaaaaatcgatattctatttttaaagtctaggtactgtattatatttgtaaagtgttcatcaaatgcagaatgtcctttaaccctcgtgctatgcacacagcactcccagactacttccttctgctatctaccacctccagtggtccaggagggctggaccagtttcaattcaggtcagagaaggtggtccagccattgttcactatgatgagggacaagcctatgatgggcccatctcttctcttacctactttccatccaaatttccctttctctcatctccccttcaaccaaaatgggtggttagaaggcatgtcttttgcaagagagtcttgagaaatgctgcctggcacccttagtttccctcctttgcactgggaaccactggtctgtggtagggaaggtagaactactgtgtgctatgcttgtgttcccgtgaacaccaaaggcaaagctccaggacagcctagctaagcattgaactcggtcactttcttccagcagcctctatctgagagcttgacaggatttgtcagttatccagcaaccccaagagctagaccactctcactttacagaacagctgaggccggcagcgttctatgctgacttgtttggaacacaggcattgagggattcatctaactatgaatttgtgtctccagaaagaagtgagagcgacgtggctcgctgccacggttgggagccaggctgtgagcaccaactctttgtgatcagttagaagataaacagcagcaacaacaggatttctattcagctctccccatgatagaggatctaaaaaaacactaataaatcaatgtggctggcaggtgctatcagagaggaaggccggggcaaaacagtgttcttccattctggccagctgcaaaggacagaagcaagagaatggagatgacaggcctggtacagtggctcatgcctgtgatcccagcactttgggaggctaaggtgggcgggtcacttgagctctggtttgagatcagcctgggcaacatggtgaaaccacatctctacaaaaaatacaaaaattaaccgggcatggtggtgcacacctgtaatcccagctacttgtggggttgaggcaggaggaacacttgaactgggtaggtcaaggctgtagtgagctgagattgcaccactgcactccagcctaggtgacaaagtgagactctgtttcaaaaaaaaaaagaaaaagaaaaaggaatagaaagaaaatagaaatgaaaggaacgagagttagcgccctcttgtcatgctaccttgttttggcaagaatgagtggaagatggtgaatgattttcatctcgttgaaaggccactttatttgataaacagcaccaataatgattaccctggagcttggctttcagcgaggcccatgtcataacttcgtaacttgcatgcacagagcccatctacctgtttgtaggtagcagtggtgctgtttggtggagattggaaactgcattgttctcttctcccagttttctgagcatctagcagaggaaatggctgcatgtaggaacttaattaagacttatggctgatgatagtaaggaaagcttcctggcaataaaggatgctaattactagaacagattgctccgtggggaaatcccagttgtttacctgtgataggtaacaacagcataacgacagcatgacctgtgttagtcaggacttggactttgaggttcaagggttgttctgtccagaggcaggggacataccagctgaccttgttcctttcagcctggagggccaataggaagtgttcttaagctaacttcatacatggttttttttttttctcccttatttttttcttaatttgcacgtcgaattttcagtgtctacaatgtgctaatgggctttcttcccactaaaaatcgcgtgtagatgtgagaatgttcttctcaagaaaagccggtctctggggctttgcttctggcttgaggtcctgtggggtaggtgttatgaaacctcccccgcagtgggcggggtgccagcaaacctcagcagggtcagcagctctcctgctaattttggcaggagagggagacactcagccaccctgagaagagagaaggtaaattttgcgatccatttgcaaatcaagctagaatgtattttcagacctgggtgtgtattcagggcccgtctatttccttctaccattaaacctgcgaggacgaaagtaactcaagttcattgttctccaccacgtaatctttcttcctatcctggattgtagcgggggcagctcagagggcatgtcaagaaggaaggaaggggaagggctatacaggatatggtgctggggcacacagtcagtgctttgggtgatcaacatcaacgtggtggtcctgggttaggattttgaggatgggatggaaggaggaggacgagaaggggatgggtgatgcccggtggctggtgcttcacaatttaaacgaggcctgtcttaggaaccccaggaacaagtagcttgcagggcacaacccttgtacaataagaacagaatgcgggaagactgaggagagcaatgaatgctctttgggtcctcaaagtaagaagggaatttgatcagagctttccgagggcacctggcatctcccataggccatgactctgtgattctctgacttccctctgtagctggctggcttctgtaaaattatcaaagagaagatagacctcaaacttaaaaaaaaaaagtgaactgagaatgaaattacaccgctacagttcacttattaaaattcatcagcatgaagactttctcaagccataatgacttcatggcctaagtggaaatttcatattcctttggaaaatcaaattggcatagccaaatgagcagaaattatctttgactggtagatgttatttctacattatttttctttgcctgagaaaataatcactctgacacttaagcttgacagctaagaataagagccagaatctatcagtttcttccacggtcccaggaactgtttgggtgttttacatgcactagttcatttaatcctcagaagagctctctgaagtgagatggtactaaacctccacttaacagatgaggaaactgaagattagagagattaagtaacctgtcagcgccaggactggactgtgggtccagccagctaactccaaactctcctgcaaatcagcactctttcccaccctccacctcttgcagagggtcagcagatgaccacttgaactgcacttgtcatactgggatggaattaagagcttggtgttgtggaataaagagaactgtctagggcacaaacaacatgaacagtaggcttctctcctactgagtgtaaaatgggccaataacatacatgatacctgtaagaaaatcacttttattttgaatactggtgttaataatttgaaactaagcaggatctctaggttaataattctccatctctagacaattacagcaacaaaagctaacagtgaatgctgattctgccagacactatttgaagtcttctacatttattaatttttttaaacctaatgacatccccacgaaataggtactgttaatttttctcattttccagatgaggaaaccagaacacaactaggaagtggcagaactggaaagggggggcgaggatttttaaccattattctaaactgcttctcagcactagcttttggcaaacacgaaatatctgcttccaggatgcaaacaggagtccccatcctagctaggggtgggataaggttaagtagatccagtcacagaaccgtatcttgtgaatgtttgtgtatctgaaccaggtgatgcagaaggtcagttgcagctctcttcccacgaggtttccttctagagatggggtgggtagcaggttttccccactaagccatgccaggtggtcatctacagaatgcccagttcattctgcatcattggcatttcatcactgacacttttttctgaaatgagaaggcttggattttttgtactttttgtacagagtttttttgtaaacctcttggtgtttcaagattcaatttgctcatttcatatccaataaatgttataatgggtttaaatgtggtattagaatttaccaaaggttgcttttaatgtaggtaaggggtgaactaaagtgattagatgcctactgaagacagtccaagttcctcagtgtggtctccagattctcgatgatctgactctccttacctctccatcttggtgtgaccctgtttctcctgctcccagccgagcaaaacatttgcacttcccaaaatacaccaggctgtgagaatgtgccctgactgtgtgtttttgccctcacttgagaaacatcccttcatcttcataactcagttcgactttttttcactgctgttaagcccctcttgcccgcccttctccaacccatcagattgaccactccctttttggtatttgtactgtattctgaacagacttcgaacacagcacagactccaacactttaaagcccacataatatcatgatagcattggcttctatttgttgagaaattgatatgtgccaggcatgataataccaaacattttatttaatagaattcttgcaattccctcttgaagcaggcactagtctcatggtcaatatacagatgaaaagaacaaagctcaaagagatgaagtgacttccccaagtccacatgaccagtgtttatgtttatgaaactttaagtttcctgagggcaagggctagcttacttgagtcagggctcaactgggatataccaacagtccaagcctgttttccattcctgtcattggagcttggcagggagtagggatagggagtggttagatgtactcaaaacacaaattggaaagagagactaagacattattactaatgggagagaggacacaaatgctaggcagacaggcagaagttgcaacatctactcttctttgtacccatagcaccagcactctagtagatatcaacagttgctaaatataagtgaatggatctctactgttctttagttatgttccatgttcagagcatgaagagatcgtggggctgttgaaggtggagaagacctcaagggggaagctgaattcacataagcttgagatagaggcagatgtggggaaggaggaggggacttgtccaaaagggaccattggcaaaggtgggcacacttgaaatacttgacctggtcaacaggtacagttttcttgacttctgtacgaggctttccaaattccccaactggggaagggttttcccctctgagccatgccaggaaagtcatggcgtgattcttgtcagtaccccttctgcccacctctgccatggctaacagacctgaagtctaacttgttaacgctttggattgctcatcttattcctggcatgagtcacttggtgttttggttcacccatctggggttttcttttcaggttaacatgtttgttgaaggattccacgatgccatcctcctctacgtcttggctctacatgaagtactcagagctggttacagcaaaaaggatggagggaaaattatacagcagacttggaacagaacatttgaaggtggggattccatctataaggcaattacatggggccaaatgagctgctgcttttctggttctgtatttctcagttgcagctgtggggcctttccagcttcttgcttttctcagctctaaagcagcccatctcataggcttgttgtaccaattaaatgagataatacacgtgaaagtgctttgaacaagccccactgaaagaggaaaggccttgtctcctgattatttaggtaatagctctatgcttcttaatattgcattgaacacaagcctcatgcatgacaggacagtttgtgaagagttctgtgatgagttttaaaaccagtattaatcccagatatacattcatgtgttcagactatgttggtttttgtgaaacacagaaaacattagctgtcacagttaaacctggtggtttgagatgattagcaggttcaattgaggcctctgcattttttttttttttttgagacggagtttttgctcttgttgcccaggctggagttcagtggcacgatctcggctcactgcaacttctgcctactaggtttaaatgatttacctgcctcagtgtcctgagtagcagggattacaggcgcctgccaccacacctggctaatttttgtattgtttagtagagacggggttttaccatgttggccaggttgatctctaactcttgacctcaggtgatccacccatctcagccttccaaagtgcttttattttacttttaaaatagtgactgttagtttttgctttctttttttttgagatggagtctcgctcttgtcgcccaggctgggatgcaatggagcaatctcagctcactgcaacctccacctcctgggttcaagtgattctcgtacctcagcctcctgagtagctgggattacaagcgtgtgccatcacgcctggctaatttttgtgtttttagtagagatggagtttcaccatgttggtcaagctggtctcaaactcctgactgcaggtgatccacccaccttggcctcccaagctttcttaataacagggaactataggaaaacaacaaaaaatgacccattatctcatctcaagcaacttctgttggcactgaaaaattgtacaagataagactatgcttggctaggaaatttaaacagtacaaaaatgtgcaaattgaaagctgaaaactttccttcccaacctagtcccctctccccactgtgtatcactattaatgatttcctatgattctgtgtataaatattttaagccttctgccagcacatatgcatttgtatatcttatcttaaaatttgtatgaaaggggtgatagtatgaatgctatttttcatcttaggttttttacttgtatgtcaagttaaagaattttccatatgagaactcatagatccaatgcagttttaaatgacagttacatatttttctactgtatggctgtataggaatttctttaaccaatctcctattgatggtcacttgtaaaattttttttgcaatttttgctattatgcaatatgctatcacaagcctcttgcacatcttgaagaatttttgtgagtccttccaacagggaacattgctacttgtgggatttctgggtccaaaagtatgttggtgctttttaaagtgcattagaaattgccaaaaacttccagaaagttctgctaatctatattcttgctaacagtgtatataagagtgctagtttcctctcacctcaccaacactcaatgaaaatgaacatgaaactcaatatggaagtgatctcactgcaggagccttgcagatatcaactctatattaatttattcattcaacaaatgttcattgagcacctactatgtgccaggtgctgttcaaggtgctgaggattcagcagtgaactaaagacattttatgcaatcatttgagcttacatgccagtggggggatgaggcaacaaacaatgaatacagtatatctttcagagctataaaataaggtaggatagggagctagaaaatgccaggcaaggaggagtagggctgctagtttagagtggtcagggaaggtctctgagagtgaagttgagtagagacccgagggaagtgagggaagctctgtagatgtttaggagagatcactccagagggaatggcaaacgtggagatcctgagtgcatctgggagactgtggagtgtccccagagagagcaagatggctaatgtggctgacaccaagtttgacaggcagtgtgataggtgccaaagcccgagaggtaatggggccagatcatgcggacctgcaagccttgctgaggtctttgggctccacctgggtgagacagaaagtcacctgaggcttttgagtgacatgatctgccttgcctgtttaaaaggggtccttatggctgctatgtggaaaataaactatatatgcttatgggtatcacttgacaaccggtaacataaggtacaaattgctgaaccagggttcagtgcatcctagccactaactagtaaccttgtcctctgagcttctctttcttcacctgtataataaggaggttggtctagttaatgactgacaagagctctttcggttttacattgtgcttgctcttcctcctttgagccctttaatgcactggggtatgcctatatctatttgtaatccaactagtgacatttttcaatggcaggagcaaatattgacaagtttagatttggggctcatattttttcagttgggactcctgtcccttagtttgtcctcagttcttagaaagggcaggacaggacagtagggagaggttgagctccagctagagttgtctgggcagtatctatggtggcaattggtagatttcatttctctctagtggatgccatgtcttactcaaaaccagagtgagatctcccttagcattagacagattgtagttcatgggtgagtagacctccaggattatcttgttttacctctgactgcttcagttgaggagctagaatccaataggataattcagggggcatattaggacagagccaaatttcccagaagttttgcacaatacactgagaacctggcatctgtggacacaaccttggtcggccacatcccattcttagctattactcactacatggtgtggtcatttgttcttggtcttctgacagagggacaggagccagagttgggggatgctggagggcgccactgagggagggtgtgaaggggagggtaggtgccaatgatggctggaatgtattttggttagagccagggcatgggttaaattttcccataggccatcttgatgtctctattctagggccaggtctacacaggcaatatgaaatgagtcctgaaacaatcaactgtgtagttcagtctacaattagaatctcatttgtttaaatgtaaagataattgaagccaagctaagtttttggcttgaattgcttggagagcccattttatttgctaaacaatggtccatttgagggtaggcctaaaaaggtctctaaggtatctgtatgaagaaaaactcaaaccttcctaaaattgaaaacaattttaacttgaatggtcaccattaagtgaccattaagttgtcaagggaaaaatactctgactgtgatttgacaaatttggcttttattgccatgaaacctgtgatcaactctcatttcaataaatggcctgggaagaagctggatttcctctgtgtgagaggtcagagtgacaaggtaaataggactgtggcttaaactttgagctccactacagccaaacagaaatagggtggaaagtctcattacttatgtacaggaaaattctactgtaagcctggaaatctcaccttatgtacgatactctcaggtgaagtctcactttgctaattggccacgctgaggattcttaccccatttcttggcagaattgcaatagcttaaaggtataatgaggtcttaaattactagggccacctcatcttataaaatactctgcaaaatgcttagcaggacacaacatcacaaacatctctcaatagaatgacaaatggttttggatagccaatatacaaatatattttaagcctatttatcacttaagagttttataggctgtcaaggatacacaagtttatggtaggtgtaccctttgtaaccagtctattttaagaagacaaaaaaatcaaagtgaatggtagcttccattctgtttctggtaaagtagaccaaagtctggaaaaatcaatgggccttcaaaccacaacccaaaggacagtaaacccacatacatgccctctccaagccacactagaggttggaactttcccttgggatcctttttcccagacattcattttacttgaggagtcagtacctccagagagaaccaaatcagagaaccaaatcaatagaaatgccaattaagaattacactgaactctccccagttgaaaagggaatagctttagttaattaaaatggggctgatgtacgcattctcttatttagtgaatgaaaattatgacatagacatacttaatatcagccgatgatatatttgcttttattgattagttgctctgagccaccattataggccaaagcaagtggatacccaaggccctccgttctctggccaccccgttccagccttacgtgtcactgactccctttgtccacatgggccatcttcccagaaatctcacaattcttctggtctctttgggcctctgtgccttggcagatacacctaggccagcctttcagcctctctcccacttcttgattactgcttgcccaatcttagacttcctccaacatccctataaaattcccactctttcactgagtcctccctgattctccaacttgttgtgctggctcctcctctgagtgatgtgggtacagttgggtcttctctaccaagaacaattataaaataaatagtagtaataatagtgacagtaataacgacagtagatgaaaacaattaacttcccttaaatgtgctgaaagtgctttatttgttttgtctcatttaatcttctccaaagcctcttggtagggaggtactattatgcccattttacagttgtggagactgaggcttagagggctaagttccttgtccaaggtcatggagctatgtaaatgtaaaaactgggattttaatgcaagtggttagattctgatgtgaacaagctaaatccccagtccaggctgcccctctctagagcagagaatgtgttcaatttatctttgcctcagctgcagcactaattcagtactaagcgtccagagaatgtttggataaacaattagcgaagaactcaaccaagataaagaagaatagttcttcttagctattggctccagtgacccacaaagcaggcctgctgctctcctgtgtattaaagcagcctggagaaaagcacattcactgagtcctgggctggaatgatttttctattataatgttcatccaatgataacgcaaacccatgacaaatctataaatgtaccccacctccacttctaactctgcgattaaaaaaaattaatacaaaactctgggataagcatgctgctttcaggattagccttaatcttttttcaaacatatcccccaaagaagatcatttatttctttttcttttcatttttaaatggagaaatgttaagaatttaggaatgcagacgcagatgaaattacaatgtctttccaaaatgccaacaaaaatgctcagagtctgatgagattccctgtggcatgagtttgtttaaaaaatcctgccaattcattttcttgtttttgttggcagacagaggtattttaagtaaccaacgttgagttcttcgcttctggtcctgtaggtatcgccgggcaggtgtccatagatgccaacggagaccgatatggggatttctctgtgattgccatgactgatgtggaggcgggcacccaggaggtgagcacgtgagacctctgcaccagttgctccttctgctcgtggggactctgaggaatgcatttgttctggtggccaaagagctgtctccaatgcagcttccaaataaaaatgagttgaaaaacctcaacttttgattgagggttcaaggaagacttcaggaaatggttccttgtttattctaaatgaggaaatcctacccttcaagtggccaagaatcacaccttagtcttgtggatgagggtcatcgggtaaaatcagtaaagtgaaactttatttcctcccttaagatttgagcttttctgagggggagtgggagggtgggtggttacaaactcaatgtgtgttaacatttccaaagatgatgtagtttcaggataacatcatgaagggaaaagagggccctggacacaaagatgagtcttccgtgcttgggagtgtgaactctctgcctcagtttcctcagctgtaacatggaaatcatcatgtcttcctggctgatgtcacatgattattgttaaggggaacagatcaaatgaaacctagaaaagtactatctacattttaaattataaatatacatatacaattatacaaatatgcagttcttcagcaaagaatgccacttcctctgtttccttgatcgctggctcccagggcattgctccggtgcccttcatgggacctggcatatgggacttgctgttttcctctttgtatgtatcaggttggtgcaaaagtaatgtggcttttgccattatttttaattatttatttttaatgaccaaaacctcaattacttttgcaccaacctaatagatgcctggctcttgtgggaagttctgaagcagcaggagtcaccctcgctatgtttaatgaatgattgttttgcccactgagtggtctgggtctcatctgtatttctggttccccctgggaaaggtgggtagcgacagttcatcagagtccattgtgaggttgcaggggtggaggtgtataaagcccttggcaagtgctcagtacacgccagtgattgttatattttggtggcgatctagacttcctctagacctgacatggcctgtgagaacctgctgtacctctgtcaggagaaggggagatgtcaccagccactcgagagccatgcgcttgttttcagacaaaagagaaatgacttccaagaacctgggtgggaaggcacttctagactggggcttagggagctgatcaaacaatcattttaaccagaaactgagggatgaccatggaattaaaccataacagaataatgattttccaggggccagaggagccaattaagagaaacagaattctgcctggaaatgggggtgcacatagggtgggttcatcagagaggagagtgcaactcttgaagaaatagtctggcaaccggaagtggtgaaacaggaggttcctgaaagacgctctttaattatatgttgaacaattgagggctgtgaggctgggtacctgtcatatgcttaaatcgggtatacggtggaccctggctgtccttcacatgtccctgaaagtaacttgggccttacaattggctgacggggtgggctgctctgggacagatgggtgggatagtgccttatccgatgaacaaagcaaaagccgggaattccgagattattccttttccacgagggggtagtgactgaagaatcctaggggcagcactgacagggctgggccttcagtgagtgcagagcccaggggacaccactctcaccgcttcccacatcctgctctggcacgaccgctcttaatgctctcttgagagcaccatcagcgacttcaaatcttgacttgtgaagtccccagaacacaccatgaccatcagtgtggacaaccgaggaacgtgcccaatgtaccacgcttttctgaagcacttgctgtccttgccctggagacggtgatttgatgaaatgcccagaggcagccagtttagatcaggctgtacattttggggaatagctgtggaaggctgcgagctttgtgcctcctttgactttttggtttgtctatttgttttttgcctctatataggttattggtgattattttggaaaagaaggtcgttttgaaatgcggccgaatgtcaaatatccttggggccctttaaaactgagaatagatgaaaaccgaattgtagagcatacaaacagctctccctgcaaatcatgtaagtctggagacttaatttgctatgtatgtcatcacctctaacctcagtgtaatgtaagtttaaaacccaagtgtttctagggccttacattttggaattttacatttctttctctgatgtggtaaaacgcatgggaacagttcacaaactggcatctttcaggtcttccttcccttccagtcttctcttccacaatggtagaatgtttcttcctatttttacatctcttactataatctcttggctaggtcatgtttccacttttagagaaaatcaaaatatcaattagtaaatatcactcccttattcatctgtcacagcaagtctcgttctgatttttcaagtttgtggttactttccagctcctcagaaccaaagagataacatcctttaaacatctgaacatttacacattggcaaataagtgtaagatgtattacttatgagcagctttgtatataagtagagaagcaattggatgttctcataagtagcttacaaataggaaagctgttagaaataattgttttagagaataaggtagtgagggagaacaaagtgaatataggtccttcaggaggccagttgatcattttaggctaatatatgtgtgcttttgaaaatatcttttaaactgttaggtatttatgtctatgcaataattatgggaaggaattaaggaggaagtgttttaagaacacactggggagactgggcctgtatttgacatcccactgttgttacttgctggttttgtgaccctaggagtcttccttcagctttttaagcctcagttttccaatgtgtgaagagaaagaaatgtgcccacctaagcgttttgagggctgttttgaggattacacaagataacacattgaagggccgcgtactaaactctagatacaagttagctatttatcacttttatataactgggatactactgaacttgattgtttcaaattgttatccacattttccaaagctatgtaggacattttgacatgaaacgctggctttggtgagagaacatctaaaaacagaacattgacccaatgaatttttcatcaaatcttctagcactttgaagtgtcaccatccatctgtgaaaataagaagccctgggtcagtgccctggtccatctggttgtcttctttgactttatttatttattttgagatagtcttgctgtctcacccagactcatgtgcagtggtgtgatcctggctcgttgcaacctccaccttccaggttcaagtgattctcttgcctcagcctcctgagtagctgggattacaggtgcctgccaccacacccagctgatttttgtatttttagtagagatagggtttcaccatgttgaccaggctggtctcaaactcctgacctcaggtgatccacccaccttggcctcccaattctttgactttaaactcaaaagagagtggctatatctgaaatcttcagttccagttttcctctgattcttgaattttcttctgttctcactgtgtccactctcttaatagtgtttttgtttatctggcactttctcaagtggttcttaagctttgcactgggcaaaaacaaacaaacaaaaacataaaacaaaaaacaagtgtagggtcccttagaaaatatttctgaaaaaggaaaagttgcctccaatgggaaatcgaggaacttcttgcaatgaatgaaactcgaggcatttctaactgtatctccaaatgaaccctgattatccatgcttctttttcaagcaggtggcctagaagaatcggcagtgacaggaattgtcgtgggggctttactaggagctggcttgctaatggccttctactttttcaggtgaggacggtttgtaaaggtacaattcactctcttctgctgtctttgtcatttgattttacatgattctctttgtgatttgtccacatccctctttcacccaggaagcacggtggttaaaaaatctcagccattcttttggcaggaccccaggtttggtgtggtcagtggtttagcatactgggtgccagggtcatgggttttgactacatctcacagtgggacagagagctgctgctgccctttgatcacagattttttttttttttttttttttttttttgagacggagtctcagtccccctgttacccaggctggagtgcagtggcacgatctctgttcactgcaacctccacctcctgggttcaagcaattctgcctcagcctcacgaggagctgggactacaggtgcagaccaccatggctggctaattttttgtatgtttattagagatggggtttcaccatgttggccaggttggtcttgaactcctgacctccagtgatccatctacctcgacctcccaaagtgctgggattacaggtgtgagccactgtgtctagccctttgatcacagatattctgacaagaattcctaccacccaccaagtgaagcagtggggagggaatctggataaagggggaaatcaacttcccccttctcaggctttctccaattcagaaatagatgcctgggctcaccttaaagaggaggagggagctttgcgtagcccatgctctcaggctgatctgtgctcagtatctggagagcccacatgctcatttgccactgtggttaagctccaaggcttgcaaaattgtaataatgtacgtgtgtgcactggtactgattgttctgccccgtgagggtggcccattcctttgtaatctttggtggttgagtttgtggtttattcataagtcattagagcaaggtttctttatttctgcatgggattgtaactaggcatatgtgaccctttgtgggaacaattgtattcctgttcctttggccacagtacatgtaatttgatctttatcaagggcatatcctgggaatcagggagaacttctgtagcctaatagacaagacctaacccccaaggcacccagggaagaaggggaaggcttgttctgtggtatttgggaaagcatgccaattttctctcttgaataagggcaccatgcctgggggcacactactttaatctctgaccagggtttcatattctgtcacttctcatttatcaactgaaacccagatgtcccttgagggcactctttgtaagagaaaccatggtattttgtagccaagttttattaccacattcactttccctttacccaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaacagaaggggcgttcttgaagaattcataattttaagcagttagtaatttcattttaaaatttctgtagaagctcaggaattatgattaatcaccatctgcctccaggcctttcatctcatgacaaacaaatataataatgatatcgtgtcactctgttaaatgttcatactgtttcaagcccatatgattagatttatgtttttaaaatctgttgtctccatatcttgatggcttttgggagcatttcacacaaggatataaaatgcggttttcttaaatgaaatgttttgtagctagaataaaatcatttttacaagtacagcattcttggaaagaatttaacacccaaaaaggggaaaatgtaatgaaaaatctcaaggttggaaatacagccttactctctctagagctggaggacaggtttgtggttgaggacttctctgtccgatgtctacattcaggttctgacttcatatcttgaaaaaggatttcctccctgtctttttcagtgtctcataaacgctactctggattgttgtaaatattagtgagatgggaggatttacagaagaaaagcaagtcaaaaatatttcctttttgatgtaaaaaaaaaaagccctatttcgcactaacattttattttacaagtattttaatcttatattttggtattagaaaaatttgtctattttttcattttgaagattaaatgttgcttacattttaaaagcatgggtgaagtgtacaacaaaccaataatgataaaaaatacttctctttttctccctgtttccctttttcccttggccacagccaaatgctaattgctgctttaattacagagatgtgtaaatgtattcagattacaaactctacaggaatacatcaacattttaactcttttgcgtttttactgtttaactgttttaaatgcaagttattttagggtgacactccttccagttctggccagatcatgagtttcaagatcaagagtaaaaagttattagaattaaacagttttataaagggaggcagcccttttccctcaagaacaactttgttgagagttactacttgacagcaagcacagaaatgacaaatttaaaacttttacacatggcatttaccaaaattcccagtgattattttgtttaaaagagggaacctaaatatctactctattccctttcagttaactccacagaactttgtaggcatccatgaatacctgtaatagtgggttaggtgtggagataaggaatttggacaaagttgagtaagtttttactgggtatctgctttgcacccagtagtctgcaacatgagtttaaactcaggttactactttcacttatactttatggagaagatagacagtgagggaggaatgggaagctgtcatgagagtgcaccgtcttggaattacataactggggtctttcctcaataacattttgagcatctgaaaaatagtttaaaaaattgtcttaatatctattaaaaggcatgtctagtgaggaaacaggagagtctgagcaatcccttggtggcgatgaaggtggtagttcacacaagtaacagtggaggcaaaggtaagcgcaagctgcctgtcccagatgctggcccatgtgtgagtgcttccctggagaagtctgcttctgttgctcccacctgagtcacagttaacagattatttctgtgtgaggcacatttcccttctgttgtttaagaaatgggagctgggaggcagctgagagggcgtgataaaagaattaagtgtgatcaactgaaacaactatgttgtagttctccatgctggatgcaaaggaaaaagtgtcgaattccaaaaaggatggaagaagaaggcaagaagggcaaactccagaagttctagtgcaggaagagagtttgagaagtaaaatccaggcaagcaaagcgttgtaccacttgggactccccaaagtgaaacagcaaggaaggattgtgtccatcttacttacttgaattggagagcttgtttctctctcatttttatttttcaatgatgttttctttatattttagagatattcattttctcttatcttgtgcttgtaaaaagcatttacatttcaagtctatgtgcttattacaggggaaaaataatctacctggttgcagtctttgagtataaacatttctaacctttttaaaacttctatagcagcccattaacactaacatttttagagcaaatatattctattttaacttcaggtagaggaatagtcctaaacttaatatgatagctctagataagatcttagagataagtgagcatttagtattctaaaagtggcagaacaaatcatgaggtttctggatgctataccaatttaaaatcaattcttatgttaatattgattgcttatttacatgtcagtcatctactttttttctttgaaatctgcatatgggttacaaaaactctgttaggttttgaaaattccattaagttggaaaccttggttaaaaatgtaggtgcctggcccatggttaccctggattcaggtctctcatgattatatttggggatttacgttcctaactgctaagcaacatctttgacaactagtaattcatactctactagtagtcacatgtcatatagtaaaataaatagggctttagttcttaagtaattctataggattttaccctgaaatccagggtgttcagatttcaaaaaggataatttatcagtattttctcatccagtcaaacttcagctgacattgatacaggtcaaaatgcgtagatgctttttggtgttggaaataagtgtctgtcttatggtcatcattgtcttcttagatttttgggtaggggggccaggtagggggagactcagaaataaaagcgttccccagataacttcaatctggaaagaattttttgtatagagtccatctctccctcaagactgaccacaggtttcatgagaaggtccctgaaaacatcacatttctctgaagaaccatcaacttgtcttttcttgaaccacaggaatggttctacagaccctactataattcttcacatttcagaacccatgtttaatggagggaagagagaaatgcatgggaaaagaacacctccttttctcctttctcttaaattcaaagacgtttgctttggaatgccctcacttctccctattcacaggcttctaaaatcattaatttactcaaggcacatgtgccttctttgccccaaatgcatcactttccttttagttatggctgattttgggtgtgtgtgtgtaagacatgcagtcaacaacgagatgaaggccattgcatagatctcatgcagatagtgatggattcagaaagtaggttccagtggcgtcactaccttcttgtaagccagtatacactggctatttgtggaaatctctttgggagatcaaatagagtattatgccactgtgagtgtttataaactggaaggaacaagtacctgtgtttcttgggacacaaagcactcagatcctgagtggatgcagacatgagagtaaatgtcagcccaaattaggcccctcgacctacagacatttcatgggttttatttaatcacaccccatggtttggggctacatgaggaagttggtaatgagctgaatttcttattcagtggaaaaaactgaaactgtctaaaaacacgggatatattttagaggcaattgtggaagcggagagaatgagatgatggtgttcagagggaccagcttctttttcagttgtctttagaactcaagaataatcaataatttagtgccccttcaacagccatactcagcaagaagcatggaacatgctgagcaagaagaatcagaagcttgatcctctaacagaaatagaagagggtagctttgcccattgccactgtctttactgccccttctgcccctccacccacatccacattcagcatcactccaaggatgtgtcagcatcttgcccatgcaggtagaaatttgtgagtaggcctccatacttcctcgggggaagaaagagaaactagtgctggttttaagaatgtagctggcttttcatcagaacccttatgctaacctgaccacacttgctctcggggaagttcaagcctgtgatgtgcataaactccaacaagcctggctttggtgttcagcatgcacattccataaatatctcttgcaggcataccccacagctagactgcaggattaaaataacttccaaaaggtgctggattggagtttgttcaaatttctcattaaccactaatgttaattcataccaaatgcaaagtattctaaaccagctgatgctgtcagtgttcaagttttaagtgacttcaaacacaatggaagtgtttcaatgggagccagatctcatgagtaaaaatccattttataatagctctgtgatatatcagtgggagatgattcataggggagagatttgaacaagcagaattaagtgttagcaaaaatgctgcattgctttgattcatgtttaaagacctaaatttctatgcacaaggaataaagggcctacttaccaagtgtaaatcacaacataggctaccaaaatatttcttatttgctaggagaacaaagctgtcacggtgcatgatagttggacagagatggctaaaaaagaggcaaattcagatttggaaacagggtggcctcttcattatttattgccaagatctgaaaatcttcaacatcttataagacaacaatgaagtagcccctgaacagcatggagttgctgtgagtttgttcgttgcagacctttgtgttgggtcctgggaatctgagctttgttccctgtgcatggtggataattgaaaccaagaggacatgggatagaccttgtgacagaccaattctgtgacccctgtcttctgggtcacattattcattgttgatttaaatacaggactaccaaacagtacaaatctatcatgagtctggtagaaaagtaaaagtaaaagctgcacacgttacatactgtttattgttctaatgtacaactaactatttgcatataatgtgatttaatttattgctgttttgtgtagaaaaggagaactaatgactgtggatataacccatgttttgtataatatattttatttcttgtgcgaactggtcatttaaaatatctacttcatttgatgtttggatataaatgtgtatgtgtccttgtaaatgtttctatcaagcaagaatgccacgtactcagagtataacaatgtgttctcattaaaaaatacatcccacggaaacctcttcctgtttataattcaaccagcatgcactgcacatatccatattctttgagggcttttgttctcctgggacttgtttaagtcaaagagcaataggtgggtccgatgaattgtaatatttgaatgatacccatgaaaaaacccaagaatttctgcctagcaaaggcaaatcgacagaattttaaaatgaggggcaaaccttgaatcagctggtaagggaaagaatcttcatgaagaataaccgtcatcttgagtcactacagctcgagagcacttcatggttgacttcatcgactcatgttattaagtcctttgccactttaaagaggtcctaagtcaattttgtcactttaaagacctccccatgttccagcatactaagcagattaaccagtctccagcatctccagttgcctctgggttgtagaaagctgcttcaccatctgggaagttactaatgatttattttaagcccaagaaacatatagcaattcgcatggttggagcaatgttcccctgatcctgctgctgctgccaccaccaatgaggtccccaggtgacaccacaaataccactcaaactccccatgtttgaggagattctgctgactcggggtggggtggggtagggcatgggggcatggcaggaatgaagggtagagacagaaaagttctggaaaacaagatttcccactgtgacttttccatctccgttttgggaaacatggcctccttgaatctttccaccatattcctacctccccagtcccctctgaatttcatttcatgcatacccaacatcccatgatgggctaaagatgcctcatgactggctcttggggctgtgcccactgaagaggccctagggagctccaaacaccattgatttagagctctgccctaatcctaaatcaggggcatctggcattgacttaaatagcaactactatagtgggagataccaatggccatgtgtctttaaaaaaaaaatacttttttttttttttagatggagtctagctctgtcgcccagactggagtgcaacggcgcgatctcggctcactgcaactctgcctcctgggttcaagtgattctcctgcctcagtcccctgagtagctgggattacaggtgtgtgccaccacgcctggctaatttttgtatttttagtagagatggggtttcgctatgttggtcaggctggtcttaaactcctgacatcaggtgatacacccgtcttggcctcccaaagtgctgagattataggcatgagccaccacgcctggccaaaaaatagcacttttataaaccatccattagcatcaaactagagtcaagaaaaaaattccctttgcaggcctgtgcaaccctgatgatcattagctgctgaagttcttgaggagtggagaggaggaggaagatgagcagggcatgatgggctatgtggtttgtattaatccgtcatgccattttctcacatgctgccccttctgtcatttccatttcatagatggcgactctctggagccagactcccggagtttcatagcctggctccgatccttgtgtgaaaatgaggataataccaattccaacctcatggggctactgtgagaactttacgcttaggattctgcctggcaggtagtgaaagattcagtggaattactattatactctcctgtctccttggataaggagacaaacctctcagttggtaatttttgaggcctttaaggcaaaaggaatttctactgttgaaagccgggcagcccacatttctttcttttcaatttggcttgatgacaagttgcctcgacctcttggaggatgagatgaaaggcaagaggtcccttttctgtacaccgcccctctctaaagggtcccgataagggccgagaaagggacagtgatagccacattgcctctgaagctttcagagggcctgcgcagctttactcaaatctgggttccctccttagagtgtaggcgccaatcctggagcagtaggccatacatgctgtacctgccttccaccccctgctttctcccctggctgagatgggtctggggactgctctttggagttcatcacctcactgctgtgattggtcagagcagttcctgccatgacatagaggactcgtgtgtcctaaagaagagcctcccacctcggtgccctcagccccaggtctttcccgataatgctggcattttgtcctaaatgcaagagtagcacctcattaagggtgttggtgggcaggggatttcctagtgtagacaaaggaggtttttattccactgctactccaatggctcaagagagaccaggcatcacacaggctggcagagaatgctgcattaaagtgacctttatggactagaggacatgaggttcctggtacccacaagatcctcctactcccagtgctagcagctacagagaccagaatagagatgacatccgctcttctggaagggcctctgacagttcagttcagaatgaggatggaataaagcagatctgggaggcttactctaggctgtgtcaccccctccatcccttgcacagtgatccctgctaggctccctctggtggtgcatagactggttctgtggaatgcttgagaaggactagcagtgcatgaagagataggtgttcccccagtgggaacctcttggtgatatcaaagatacactttcaggcaaacatccagcaagaggctgactctcagtagaatttgccacctgtcattttaaccatatactactttatgactattctcagcattttattcagaaggaaaatgaagacagcagaatgtatgccattctcaatttgatgacactagctatttattgagaacattccacatggcaaagtggggcttaggcaccttagatatgtgcaggttttgcactctcacagcacccctatgagctaggactgtggttatcctattcatcttagaaatgtgtaaactaggttgcaggcaagatggccaaataggaagatctttggtctgcagctcccagcaagatcaacacagaaggggggtgacttctgcatttccaactgaggtacccagtttatctcattgggacttgttggacagtgggtgcagctcacagagggtgagcagaagcagggtggggtgtcgcctcacctggaaagagcaaggggtctgggaactccctcccctagccaaaggaagctgtgagggactgtgccatgaggaatggtgcattccactccagatactacgcttttcccacagtctttgcaacccacagaccaggagagtccctcgggtgcctatgccatcaagaccctgggtttcaagcacaaaactgggcggccatttgggcagacaccaagctagctgcaggatttttttttttaataccccagtggcacctggaatgccagcaagacaaaactgttcactcccctggaaagggggctgaagccagggggccaagtgatctagctcagaggatcccacccccacagagcccagcaaggtaagatccactggcttaaaattctctctgccagcatagcagtctaaagttgacctgggatgctcgagcttggtgggggaagaggtgtccaccattactgaggcttgagggtggttttcccctcacagtgtaaacaaagccacctggaagttcaaactgggtggagcccatggcagctctgcaaagccactgcagcctgactgcctctctagattcctcctctctgggcagggcatctctgaaagaaaagcagcagctccagttaggggcttatagataaaactcccatctccctgggacaaagcacctgggggatggggcagctgttggtgtagcttcagcagaattaaacattcggcctgctggctctgaagagagcagtggatctcccagcacagtgctcaagctctcctaagggacagattgcttcctgaagtgggtccctgacgcccatgcctcctgactgggagacacctcccagtaggtattgacagacacctcatacaggagagctctggcaggcatctggtgggtgcccctcagggatgaagcttccagaggaaggaagaggcagcaatctttgctgttctgcagcctctgctggtgatacccaggaaaacagggtctggagtggacctccagcaaactccagcagacctgtagcagaggggcctgttagaaggaaaactaacaaacagaaaggaattgcatcatcgtcaacaaaaaggacatctacacagaaaccccatccaaaggtcaccaacaccaaagaccaaagatagataaatccatgaagatgaggaaaaaccagtgccaaaaggctgaaaatttaaaaaaaaaccacacatctcctcctccaaagggttacaactcctcaccagcaagggaacaaaactggacagagaatgagtttgatgaattgacagaagtaggcttcagaaggtgggtaataacaaactcctccaagctaaaggagcatgttttaactcagtgcaaggaagctaagaaccttgaaaaaaggttagaggaattgctaactagaataaccagtttagagaagaacataaatgacctgatggagctgaaaaacacagcacgagaccttcgtgaagcatacacaagtatcaatagccaaatccatcaagtaaaagaaaggatatcagagattgaagattaacttaatgaaataaagcgtgaatacaagattagaggaaaaagtacaagagggaacgaacaaaggcctccaagaaatatgggactatgtgaaaagaccaagcttacatttgattggtgtacctgaaagtgatgaggagaatggaaccaagttggaatgcactcttcaggatattatccaggagaacttctccaacctagcaagactggccaacattcaaattcaggaaatacagagaatgccacaaagatactcctcgagaagagcaactccaagacatataaccgtcagattcaccaaggttgaaatgaaggaaaaaaaaatgtcaagggcagccatagagaaaggccgggttacccacaaagggaagcccatcagactaagagtggatctctctgcagaaagcttataagccagaaagagagtgggggccaatattcaacattcttaaagaaaagaattttcaacccagaatttcatatccagccaaactaagcttcataagcaaaggagaaataaaattctttacagacaagatgagagattttatcaccaccaggcctgccttccaagagttcctgaaggaagtactaaatatggaaaggaaaaccttgtaccagccactgcaaaaaataccaaattgtaaagaccatcgatgctatgaagaaagtgcatgaagtaatgggcaaaataaccagctagcatcataaagacaggatcaaattcacacataacaatattaaccttaaatgtaaataggctaaatgccccagttaaaagacacagactggcaaattggataaagagttgagatccatcagtgtgctgtattcagaagaccc

SEQ ID NO: 1793 - DNA, 626 bp, Homo sapiens
tggtgatcatgtgtgcgagcagtgacaccatccggagcatcatgctggtggcgcacaggcatggcatgaccagtggagactacgccttcttcaacattgagctcttcaacagctcttcctatggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtgtgtccatagatgccaacggagaccgatatggggatttctctgtgattgccatgactgatgtggaggcgggcacccaggagaggttattggtgattattttggaaaagaaggtcgttttgaaatgcggccgaatgtcaaatatccttggggccctttaaaactgagaatagatgaaaaccgaattgtagagcatacaaacagctctccctgcaaatcat

SEQ ID NO: 1794 - protein, 185 aa, Homo sapiens
MCASSDTIRSIMLVAHRHGMTSGDYAFFNIELFNSSSYGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGVSIDANGDRYGDFSVIAMTDVEAGTQERLLVIILEKKVVLKCGRMSNILGAL

SEQ ID NO: 1795 - DNA, 46244 bp, Mus musculus
  misc_feature (1)...(46244): n = A,T,C or G
tccagtgccagggtcaggcacgtggcatgatgccctgctctcactgtggcttgctttggtgccacctggcatccccgtcctgtgctttgctgctctcccttcttgaggcaggaggcccatgctagatgcatcgaaggagcatattgtagccattgtgtgtgtcctggtcagctccataaacttgtacagggcacttttgtgttttgtgattccttgcccatttttgttctgttacttgagatagaggatccaggctgtctcaaacacttggcgccaggtgcttctccggtcctagcctctccttgtcctgggttacaggtagaggtggctgccttttaaactatgatctcccacccccacccctgagatagggccttactctacagctctgggcgtctaaagagctgggattacaggtgtaaatgactacatatgttgcccatacaatcttttgttaggattttcaggcttttccagaatgtaagcaaagcagatagccaggcccctggaagcctccaaataggaaaggttcagtctccctcgtcacaggccacctgctgccagcagggtgctcccatgaggcacctcgggtctgaaagagcctgggcgcaggaactctgggaaatgtcagtcctccatgctggaattgcagctacacaatcttggcattgcccttgaaagacgagcaggtttcaaacgttggtgaatggatgaggtgccctcctcaacatggagagagtctcacacttctggctcatgaaggagctgtctgttggaatgtgggggacaaatctgtctggtaatcctgtggtgtgttttggaaaaaagaataaaagggtaggaatgctattatgtgtgtcttctatttaatttattaattttaattgtgtgggtgtgtgctgtgaaagatgcagttttcacctgctgagcatcttccctgccgggcaaggtggtgattttcaaatgcttttaagtttgtgatggccaagcagctgaactcttgagccagcgtgacccactgtcccccagtccagcctctccgtagacaagcacatggatgccctctctcagtctggctctggattttagccacagggacgacagcaaatgtgatgcaatcagaggcttcaagagtgcgcatgaattgaacttcctctctgctatccttgggctccctgctgtcactgccacactgaaaagcctacaaagctaagggttgggaatgtattcccttagaacctcccagtgaggggctgggggtgtggctcagtggtagagctcctgcctagaatcccccagtgaggggatgggggcgtggctcagtggtagagcccctgcctagaattccccagtgaggggctgggggcgtggctctgtggtagagcccctgcctagaatcccccagtgaggggctgggggcgtggcccagtggtagagcacctgcctagcatattcaaggctctaggtctatccccactactgacacaaaattgacggaagctttcggtatgtagtctgggattcatcctcctccggcctcagcctcccaagcactgggtttgcaggtgtactctaccacattctgctacaatcttaaactctgagccaagcgatggtagtgtactcaggaggcagaggcgggtggatctctcgtctacagagtgagttccaggacagccatagctacacagagaacccatgcctcaaaaaacaaacaaacaaaaataaaaaaccaccaccaacaacaaaacaaccccccgttacatttgagctgtgcaatcttcaaattgatacatgcccccccaagccccagcctttgcctcaagactcatctcaagaacataaatgctactgagtgcctgtcgccaccatcgagcagacaaaatgagaggcagcctctcacaggccaaggtgctcacacttgctgtttctgaaattgcccagctctctgccttccgactgggagagaaacctactcctggttaggtatggctatgtgactagctctgtccctggagctgagagtgttgagtcacttctgggtcacacagtggttaatcacacaggtgaggcatttctaggcacttccctttggcaaaggcattggctgatccatacctggaatgagcagaaacccgctttggattatgctgaacttgtagagcaaaggcaagcaccagccttttatgaatgggtgctcattcagcaaacacacccgctctcccggtgaaactcccatgctgatgttggctttggcctggtgactcaccttagtcaatggaatgttaccagctctaaccccatcaacaacaataacaaaaaccctaaatgcacttgactttcctgcagtgccagggatctgctggaaggaggatatgtggaagtccagcggggagctagttgtggatcaaaccagctaggagagctatggtaggcaagctacaggcccttagaaacaagattgcgggctggtgagatggctcagtgggtaagagcaccgactgctcttccgaaggtccagagttcaaatcccagcaaccacatggtggctcacaaccatccacaacaagatcctcttctggagtgtctgaaaacagctacagtgtacttacacatattaataaataaatctttaaaaaaaaaagaaacaagattgcttgttgtcttaaatctcagtgtggggattgtttgttacatggcattattgttgcaagagctgactcatacaaagttgttactgtagcataatgtagccagctcagattggtgtcaacattagcacctgcccgctaatggcccttctgtaagtggcagctgtcacgatgattaattagtatttactgagacagactctctgaagaaccatcattttttttttttaaggtagcacccactgctctcatatctgctttcaaaggaggtttttcatcacacagttctgaagttctcactgttaatagccacatgttaccaacatggacatggagatgaggcaggagatgtgaccagaactcacatcaggattctcaccatcctagctgtttgacttaaggcctcagtttgtccacttgtaacgtggaataatatcaatttcatctgggcggggctgttcacagccataatcccaaccttccagatggtgaggcagagagctcacctcgagtttgaggctggactggactacactacataatgaggccatctcaaaggacgacagcagagcagcaaatcaatttcatggagctgtgatcaggaaatgactagaaagtataaaacacttagcagggtgcctcttactataaagcgggggctacttgattttctttttccctttgctttataaaagggcaggagtcaggatgacagccctgcctctgtccctccatttctctctctctcttctgcactgagtctcactgtgtgactctggctggccttgaactaacaaagatccacctgcccctgcctcccgagtgctgggattaaaaacatacaccatcacacctgatgcatactgggatgaaggcaagagctattatatcgggtttttttttttcttttttctttttcttttctttttttcttttggttggctgttctggaactcactctgcagaccagattggcctcgaactcagaaatctgcctgcctctgcctcccaagtgcttggattaaaggcgtgcgccaccacccggccttcctgtttgtttttgagacagggtctgcctatgcagcctcagttcaggccagtcctgtgctcatgatcctcctacctcagcctcagtccatgctgccacatagggaccctctcctctttgaatcaggaaaagggctccgaaaagaacactgagacctgtactgtttacaacccaccttcccaagatgcatctgtcacaaggaatgaggtttgtactgtcgatctgttttaatttacaggcagctggaaagctgcagggctcctcaagttacatacttctcggttcttcactctcccctgccaggagggtaaggggctggaaggcagtctgcccggcgcaggaagtagagatagaaggctgaagggacctcagcccctgccttggtgtggcaggcgctctctgtagcacagcccctcgtggcaaatttcgtgtggataatacctgtgacgacatttcagaatggagtcgacttctgtgtgacccaggagtctaacacacacatacatcccattaacacacacacacaccaccaccaccaccaccaccaccaccaccaccaccaccaccatcatccagtactacggaacttcctcatcacctgtaatggggaaagtgtggatctctatttctgagacacaccccctcccccaatcaaagcaccactcaccagcctgcacattgccagcaaaatagatgcagtgtgtttcccggcccacgcagcgagctgcctgggttcctggacaggtctcctggaagggcgcaatgcaggagggacacatcaggccattctctgtccgattgttcaagggagctgtgaagaaagacgttgcataaagcaggctggaaggcttgctaccccaacaccctctgaaccctgggaaacagaagttagttggtagagtttgcaggtaaggaaacggaggcctggaagtagtcaagggtggtgtgccagatgtcacaggacaggcacactgttcttgaatggtacttacggggcacagagccactgttgcaaccgtcactttgacagcagtgggcgttggacaccatgtagtcactgggagtcatggtggttgatacgaagcctgagtagcagtctttgtacttcatgcaggccttgaaggtgttcactgactttcggccctctgcagagtagggggcaggagtggagggatggcagtgctgtcaatcacttcttcctcacccctccccatccctctccagatcaccatggcatctgcactcatatgtgcatacaaacacatatgcatattcacgtatacatacattaaaataaacctttgagacagggtctcactatgtagctctgacctacaactcactgtagaccaggctggccttgaactcacagagatcctcctgcctctgcctccagggtgttggcattaaaggtgtgtgctaccacacttggctaaaataagtaaaaaaaaaaaattttttttttttttttttttttttnnnnnnnnnnnnnnnnnnnncctgtaggtataccagtatccttagtctcatggccgtcttgagtaagtagctgaatcagtagactgaccttccaccactttcagagaacctcaaaggatcgggccccctcaagcctttactgtgtgaactcatacaactcaacaagttcaaacatttattcattagaccctggggctcagagacctgaggataaatagcagtgtcaaggtcccctcagtccaagaccccaatcttactgtctcatagcggcctcccctttgaatgggatttctgatcttttgtgagactgtgacaacgtccacataactggagtccctttggagctggagagacagatggcccagtgaattagtgcttgctgctcttagagaagactgtggttgcattctggccctgttgatgaagagctcctaaccacctgtaacactagctgcaggggatcccacacctgcagccatgcacacataaataaataaataaataaataaataaataaataaataaatttttttttttttttttttttttttttttggtttttcgagacagggtttctctgtggtgtgtggtgtgtggtggcgcacgcctttgatcccaacacttgggaggcagaggcaggtggatttctgagttcgaggccagcctggtctacagagtgagttccaggacagccaaggctagacagagaaaccctgtctcaaaaaaacaaaaacaaaaacaaaaacaaaaacagaagagcattgggtgagagaaacgactcgccaggatgtcattaaagaagttggaaaaatcatttacgtggtacacctcgaagctgaggataaagcccttgagcaagagctcagcttgctgaatgggttaaaggacatcatggggcggggtggggggtgcgggagagaaggttcagtggttaagagcactggctgttcttcctagacgaccagatttaacaactgtctgtatgtaactccagttacaggggatctgacaccaatgtacataaaattattaaaaaagagaggtgaccttcaggactgcacacacacacacatacacacacacgtttaatgttaaaaaggccatgacagaagccacggccttcctttgttacagccttccgcccgtccgtctctcagctggaatcactgtcctataactaaggctctctcttaccattgaaaatgaacatccaacccaatcgtccttatttccccatcatctctgaggtctggggtgctctctttgatttaggctagcctctcccaatgtacttctgggcctccccatttccatcctctccctccttcctcctcttaccccacccctccacacctctcccttgccttctttgctctctctcatcccccttcctctcccttcccctccctcaccctccctttccctttcttccttcagccttccttcttcctccctccacctctccctctccagatctttccccttcctctctcccccttcttccccttcctcctccttccttccttcnnnnnnnnnnnnnnnnnnnntcctcctcctcctcctcctcctctgccatctgtacctcccactttcttctgtgcttgtttttaagtcagggtcttgctgtacagctcaggctggtttcagacctgtgactatcctcttgctcatcaccctatcccggcacctctactttctctagatttatttgctccattcctcagggtctttctctcatcaggcagctcctttctgttctctcctgaccctaacaccatctcctcttcctttgcgcccaacagatttgcttaagagcacaaactgctggaggctggagaggtggctcagtggttaagagcactggctgctcttctagaggtcctgagttcaattcccagcaaccatatggtggctcacagacatctgtaacaggatctgatgccctcttctggtgtgtctgatgacagctacagtgtattcatataaatgaataaaccttaaaaaatcaaatattaaaaaaaaaaaaaaaagcaccaactgcacttgcagaagatccaaactcagctcgtctcaccggtgtctcgaaactgcctgaaacgtttgctccaagggatctttctcctccaggccccataaacactgtgctttcttgcatagccccccccccccacacacacaaataattaattacaaatagaatttttcttaaaaacaaaaagaaaaaccagtttccctcctgctactttcttgtgtcctctcatagttacctcaccaagctcctcatattttatgtgcatgagtatatatatgtaagtgctttacaagtgtgcaataccagtggtaaccagaagagggcataaaatcccccgagattttagttacagaccattgtgagccaccatgttggtactgggaattgaactctggtccagtgaaattgactggcgctttatctcttccttcttccatttcaaccctcccctgattttcttcctacatttcactgtgactatcccccacctacagttagaggtccctcccaatcccttccgctgaagccacaccctcctacttgtgctggactcgctcactaggaccacgcatgcgtctttgccgtcttcacaggtcttcatcttcccgctgcatgtgtgccccgagcctttgcacacctcacaagttagagggcaccctgcagcaaggagagtggagaacagggtatatggtcatggttaaagaaggtcttcagaccgtgacttgggctttggagaggtgacttttggggagggaccgggctctttctagttttccatgggtgggacattgagaactgtccagggaactggctatagagtcaaggaagccgtggcgatgccagtgaagtggcgtccagggcaggaaatgactctaccacagagcctgttttacttaataattacaaggcttggggactttggatgccagggtcccctgagcaagctcagacgcagggatagtggcagaggtgctatggagcttttgcaaaatttcaggtccagctggttcttggggtgtggaacttccctcccttaggaaggtaccacggaagtctggcagctcaggcagaggtacctgactctgaggtctgggtcctacatttgaaagggagactgaggcccagaggtatcgctggcatcagttccttggtcctgacagaggaggaacctagccatttgggtcacagggacagtgaagctggcttggagtactgtgtctaagtaaaagagtaagatgaggtcctgaatccctctaggtccagagagaaaggccatctctctccttattactaattttaaagtttgcctttgatggccaagctctctcatctgctttcctagaattcagatgtcatgttctgaggcccttcctagaggacagaccatgcagggcccatcaagccttctcagaccccaggttttcacctctttattctcctaaatctcatttctcaggctatccctctcttgaggacattgcccaatgccctctgaggtactggggaagaggaccaggtccctttgtcacttaccgagacccaggagggtacagagcagtgtgaaggccagcaggaaggtcctgtgtcttctaaacagaatcatggtgtgtgaacctgtagtcccaggtcctcagcccttataagaagctggggaagggcgggtctggtcccaccttcaccctggggtgagaaatagctgagctcagaacccatgggagtcttccacagcctccgggtcagagccacggaaccagcatccacaagaaaactgaaccacttggacccagcccttttctgcacctgggcccaaatttcttccacctggacccagaagctcagttatgtatccaagcacctttttttaattgttgttgttcacaaatcttaaggtaggagtgggtcatctgattccctgagggtgcagagcaactttggagactggcatccatcctcttctcctttcccaaggaggcgcccagcgtaggttgggtcctaaccggggagcgcccagcatgtctagacccgtcctgcgggggccgggcgccttgtggcctttcctttctctttcgtgtgcctgcctcaccttcatgcttctgtattcgagctgtgtccagctccaaccccacccagggatgtgcccctgggtcttgaggggactgaacaaaagaggtcctgtcagcagacagagacgggcaaagttggagacaaatgcttacaaggcattggggaaccaaggtatttgtggacgcacgcaagtatattgtgcacaatttgtattaagatctttctccctctcttttggtgttaggtcatgagctaagagaggtctgagatctttgtcggccatctgtctgtcgatgttcgtctctgtgtgtccatccgtccgtccgtctgtttgtctgcatttggagagagaaggggaacagagcgtgtccgcaacaacaggtgccagagatcttatttcaaacaggattcaggcttcaggaaactctcagcttcagcgtttctgagcaaggctctggtttggttggtgacctcacggtccaatgaccagggcaaattacacgtaggacccaatcactgaggccgctcttgttgctaggttcccaggaagccgagtctccacgttatcaggcggctaggccggagagtggtggaacctgagagaggcggggccggagggggaatgcctgttgctaagggaacccggcgcctcgctcgcggagaggcccaaccgagcatgcgcagtgttgacgtgtgcgccggcgcgccgcggtttgaaaggcccgagccttgcgcgcttgcgcactgagtcccgtgcagggcgcgcgcgctcccccaaccttctccgggggccccccggagctgcaacccttcttcttcattccctggacggtcgggcgtccacgggcgtggacatgccggagatcagcctccgccacgtcgtgtcctgcagcagccaggactcggtgaggggctgacgtgggagcagcggggagacaggggcttcctgagggatgctgaggactttggaagcgcaaaggggggggggatcttggcgggattctgagcggggctccgggtggggtttccagaggctggacgtgcattccgagagagacgggcagttagggaagtttggggccactgtggagagtaaggaaaaagaggggcctgggaagttctaactgtgaagaaaaactcggtgaaaggaaaactcgaggcaggggtgtgtgtatgcgtgtgtgtgtgtgtgtgtgtgtgtgtgtggtgggactggcgtgaagtcaagtgtggagagtcggctagctcttgggagtttaaacattcaaaaataatcttatttttaaaagtcagctttatttaaagaacttccacctttccacccttgcctgcagacccattgtgccgaaaatcttctcaaggcggacacttaccggaagtggcgggcagccaaggcaggagagaagaccatctctgtggtcctacaggtgatgctgccatctcccacctcctcattcccggggcagtgagacccccgctcacattccactgccagctggctggaggttgagtcgtttcctttctgtagtagagagcttgctcggctaacttgcctggaaaatgggcttagaaatccctgtgcctccaggaatccttgggtaaccctgagtaggttgactctacttctgggcctcagtttcatcagctgggacagtgtcagccattactgttaactgtgtcccccggggccagaaggtggccaagaagagtatctccataaatcagtttcattgtaaagacgaccgacatggaagggtggatggctcaggcctgtaatcctggttgcttgggaagttgagataggataacaagttcaaggccagcctgcacaacttagaacctgtctggaaatgagaaataactaccctcacgaggactattaacataggattaggcagatagctcggctgttcagggcttgcctggagcatgtcagaccctttccttggttccatccctagtacctcagagagtaaaggaatgaaacgtgtagggaagggaagttttgtttgattggttttattgttttgtttgtgagatagagtctctctacggagccctggttgtcctggaactcactctatagaccatgctggcctccaacttacagagatcctcctgcctctgctttcagagtgctgggattaaaagcatgtaccaccccaccctattctccttttaaaatttttcttaaattgaagctagtcttgaactcctgatccttgtctgtctatctggggcagaggagttccaagtgtataccatcatgcctagcatctgtcagtttgcctttccttcatttagcttacaacacacacacacacacacactcagtactgtgcaggctaggcaagaggttactaattgagccatgtccctatctttctgactttgactacttttaaatttattttaagctgggcagtggtcatggcacacctttaatcccagcagttgggaggcagaagcaggtggatctctgagtttgaggccaacctggtctacagagtgagttccgggacagccagagctacatagagaagctcccatggggagttagggagttgtttctgacaggtacagaaacttgaggaaggggctagagagatggctcagtgggtaagagtgccaaccggtctcccagaggactgagttcagttcttagcacctgtgtctgatggcatacagcaacagcctgtaagcctagccccagaggctctcatacctctggtctctggggcttcatccccctttcatacacatattaaaaacaataaaaatgtatctcagggctggagagatggctcagcggttaagagcactggctgctcttccagaggtcctgagttcaattcccagcaaccacatggtggctcacaaccatctgtaatggaatccgatgtcctcttctcgtgtgtctgaagacagctacagtgtactaatatacataaaataaatgaataaattaaaaaaatgtatcttaaagaaaaatcagtgggagaaggaaattagatgcttttaagcacctgcccactgccagttgggtgttgaccccgtgattctctgagtgtcctactgtaaggggcttggttaccactcacaaacggcagtgccaagactcagtccacactaagagtgtgggtgctttggacagcttcgtcagcctgttgtattcatatgcaccactgagctgcaatccccagccgccaccgccaccattatctcttcctcctccccggagtgcttcggtccccagtatgggtcactgcccagctcacacactgactttccttgatgttagccacatccctcagttctgagtggagaaggactttagtggggacaaagttgacctgactattcctatacttaacacactcttggcctttttcttgctgagtagttttgggttacaggatgttttgaggattatagagatgttttcagaaaagaaccataacattttctggccaatctgaggtatttatgcctttttaaatccctaatcagagactggtaatgaaaactaacattgttccccattgtaacctgccagtcagcaaccatcatgcctcacatggcttgattcattccctccttgtaaagtcctgtgacccacagactgtcattatccccattttacagataaggaaaccgaggcccagagaaattatgaaacccagcacctgtcttttaaactgtgtgagaaccagattgcttagcatttagtttggggatctggattcaaatcctagctcttactcactctgacctcaggcaaatgtttttaatttctctaaacatacccattgaaaatatagacacccaaggctggggtggtggttaaaacctggtgacataatgtctgcagaagtactctgtctacatgtgggggctgggataaagggaggggttggtgatttcattatgggatgttgattcttcaggccttcatcaggtgaccccccccgcttcccccctcccccgatacccctacatatactgtgggaaataatgttcagctctataagagtggtgagaacagaatgcagcatccagggtcctgaggaggctcagcggggagggtcctcgtggccaagcctgacagcttgagttccctcgttggactccattttaagagaattgccccacagagcttgtcctctgcttccacatgcacgctcatccccacctgtgtacatcagaataaatgtccggctggagagatgctgtgggtaagagcactggctgctccttcagagaacctgggtttgattcccagcatccacatggtggtttgtaaccttttgtaactacaaatccaagggatcaggtgtcctttctagcctctgagaggcaaaatacccatatgcataagaataaaaattttaagtcgttaagaaaacatgggagacaactagaggtcatatgcaagctacagacagtggtgtagaaggtggtacttggaggggttcacatgtcacgttttagctttgtggcaaaggtcaagagtcttagtagcatcatttgttccctcattcatttattccacaagtgtgctctaagctcttgctctacgtggacactctgtgctcccgggtctgtacagctgtgtgcagtcggtgatgaacatgctcacacctggaggatgggggtgttgctggactagaggaggcttgcctagcataccccaggccctgggtttgaaccccaacacccccaaaattggaagcagtagtgacttcggtctgcaattctggtactcaggagcagcaggatcagaaactcaaggtcatctgctacatagcaagcttgaggtcagctggggttgcatgagaccccagcatggaaagctgacaggcttggtgaagtgaccctgtattggatgatgagccatgagtgctgtggaggaagtggggcagggtgagtgagtggtgcatccagccggagatggtgttgtcaggtttttatttaaatatgaggactaatctctcttttgaaaactattcttagttgagtatggtggtgcatgcctttaatttcagcacgggggaggcagaggcaggtggatatctgtgaattcaagaccagcctagtccacagagtaaagccttaacagccaggactacatagtgagactctgtctcaaaccatgccctgtccccattataaagaagatttattttatgcatgtatatcatgacgtgcatgcctggtgctttcgaggtcagacaagggcattggatcccctgaaagtggagttaggaatgttggcatgagccatgtagatgctgggagccaaaccccagtcctctacaagagcaagcagtaagtgcccactggtgactttttaaagctctgtttgtttgtttgtttggtggtggtggtttttgagacagtctctctgcagagccctcggtggaacttgcaatgaagaccaggctggtctcgaactcaaagagatccacttgcctgcttctgagtgctagggttaaagttgtgaaactttttttaaactacatttagcatttagagtgtgtgtgtgtgtgtgtgtgtgtgtgtgtgtgtctttagaggtcagagggcactcgcaggagtcactctgcctccactctgagtttctaggccagcatctttgctcctcgagccgtctctgcagcctggagtctggtgacagaagtctggtgacagagtctggtgacagaagtctggtgaccctgaacagaagagaagttcattcccagggaagggacagaggtcagctgtgtccgtctggcacgtgagaggtcggtcaaggaggccagagagcaaggtagggccagggcttcgccagggcttctgcataggaaagataggacccttcttgttcccgttgagaataaacagagcccatcctgtcagacccctgggacaatccgattgcacttgacactggctaatttatgggcaactgagttcgaccagggttagctttggtttcttttcagtgacaacaagggagagatttctggacaccaagacagtagactcttgtgtgctcacctatttccctgtgtgctctctaaacactgttacacaacattggtattgccaaacagggctcagccctctgcttgtgtcagctccacacacctctttgtcagccgtggctactctgtgcccagctggtcacctgcttccagacagggagttaaatctttgccagcccctcctggcctggaggggatgctgggataggtccaactggaacactgctgtatcacctgagtgtcagccgtacaatggaacacatcatacctgctttgttattgctgtttgagacagggtctcattgtatgatacagcccaggctggctccaactctgatcccctgcatatcacatgtgttgggatgtcaggtatgagccactgtagttggtgtgatttttttttccatgttttttcttatttttaaagatttatgtatgcacatctgcacaccaaaagagggcactggatgccatggagctacgtttacagacagttgtgagctaccatgtgggtgctgggaattgaacttgggacctctggaagaagtctgcactggaagctagtactcttaaccattgagccatctctctgccccccccctcccctcccctgttttgagtcacggtcctactttgtaactatggccagtttagaactcactgtgtagaccaggctggtcttggatgcacacagattttcctgcctctgttttctgaatgctaggattaaaggcgtacaccaccagacctggcagatatttgttttatgtgtatgagtgtttgtctgcatgtatgtttgtacatatgcctagtcgctgaagaggccagaggagggcatcaaatcccctggaactggagttacagatggttgtgaggtgctatgtgggtgctgggcatcaagcctgggtcctctggaagaccttgtgctttcacctgctgagctatatcccagccccctcactgggggattcgaggcaggggctctaccactgagccacgcccccagccctcactgggggattctaggcaggggctctaccactgagccacgcccccagcacctcactgagggattctaggcaggggctctatcactgagccacgcccccagccctcactgggggattctaggcagaggctctaccactgagccatgtccccagcccctcactgggggattctaggcaggggctctaccactgagccacaccccagcccctcactgggggattctaggcaggagctctttcactgggccacgcccccagaccttcagtgttttgagagagacattcactgtgtgtgtagctcagactggccttgccttgtgatcctccagcttcctctgtagtgctgaggttgctggtgtgtgctgctgttctgctctttgttactagtatcattttgagacagggtcttactctgtacctcaggttggcctggaattccttgtgacctcctgcccctgcctcctacattccagtccatcactctccttacggagccttttttccagcccctctctctcttttttaagtcttgcatacaggacagctttcaactagccgactctcagagctttgcctagtttctgtgtctgatcagtatcatgtaccatgtgtgcatagaaaaattaaaaaaatacaaacaaatgtgcaagtatagaataccaggttggggctgtttgtgctgcccacttggtatgttgcctgcctagcgtacatagtattccgagtttgatccctggcattgcattaacctgggaagagaaggagacaggatccaaagtcgggacattgttggctatatagaaagtttgaggctagcctgggttacatgagacctagtggtgggggagaaatatatatatatatttatatacaagtcgaagccacaggaatggctcagtagtagtggagagagataaatcaggctaaggaatagagggaccccttgtgggagatggcagatgctactttgtttggtctgaggcattgctgtctaaatctaggtcggaaggaaggcttgagcagtgccgaggtctgaggcatgttcccgattctggggtggcagctgcgaaggccctgagcaggaggcctcagcctttactggatataagataggtgatgggagcacacaggacgttgtctgggctcagtatccagaagggtctgtgctgaagcactgtaagctatggctggctctgttctcctgggctttgcctacacagctgtggtgtaaccacctcctgcctgaggctgctcatctaatcgcagcacctgcacttacaccctgctagaagagcagatcttacatctcttccacagttagagatgagagcactcagttttgctttgttttcttttgtggtgctgaatattgaaccaggatcctgtgcaggccagacaagtgctctaccattgtcccacatcccagacccctctctctgagacagtcttgctgagttaactcctgctcttgaacttgccctgtggctcatgcagaccttgacctctgaattctcctgcttttacctaccaagtcgctggggttgcaggctcaactggctgcccttgtgactttgcggcatcttagcttcctgtggagtgaagccactgggactccccttggaaacattaactgtagtttagaaatgtcagggctggatttgaacacagaccactttgttcaagtcaaggttcctttctgccacggtgctgtagtgccctgactggtctgagagggcagaagggaacagcagatggtcccagagcagaggagggccatgggtggaagtacataggcagttaaaaatttgtttttgcagctgggcagtggtgccgaacgcctttaatcccagcacttgagaggcagaggcaggcagatttctgagttcgaggccagcctggtctgcagagtgagttccaggacagccagggctatacagagaaaccctttctgggaaaaaaaaaattgtttttgctacaaaaaaaaaaaaaaaaaagatttatttttaagtatctgtatgaggggtaggtgtgtgttagtgcagaaaccagaagcattggttttctcaggacctagagttacaggatgttatgaacctcttctgagtatgaagagctctaacaactgagccatctctgcagctctgaccttgaacttctgatcctcttgctgttatagctaggctgttctcacttaaggaaaaactatgatgtttttattgaaccccccagactgactacatgtgtaaagaggtgggcctctagctgagagtaagcagggagcttataaagggaaccaccacacgtttggtaggtcccattggtgtagctgggatggctgttaccaagcatgacaggtatgaacttttcgtaagaataaggcacagctgtgccaccatggtatcactcaggcagaacaactggggagctgtggtctctgggaagtgctgtgcatacccgagtgtcaggctgacctcagttttagccagattgagccaggtcaggcttgagcgcacgtgtttttctcatttcactgcgtccacaccaagtgctgaaattacaggtgtgcttcattcagtatgctgattatgcgtgactgggcatcgaactcagggtttcctgcctcctggctccagctgagccagccacatctgaagccaggacatcttcgaaggctgtgatagcgcctcatccgaggaccctgttaaagagccccagactggacgcttagcattgcctgtcctcactgccccacacccacacacctttcagtgtcttcagcctcaggctggagccacaggtgagtggagtcttcataaatagctctttctttcgatgaataatgagcctgtatcagctaatggttcctgttcctgcataatagattcagtaagaagcctggagcttttctaggccagagactgacaaaacaactcctgtcaaagggagacagggacaggcaaagagtctcctgcctgcaattctaaccccctggaaggtgaagccagcaggatccccttaagttcaaggtgtgcctggttattaagtgacacctgacaaaagaaaactccaactaggcatgtgaaaatggagctgagtgtggcggctcatgcttgtaatcccagctgttagattgtgtgtagcagtggccttgtgggtcacaactgtttacagtggccaagtctcaaaaaacgaaatggggtgggggaggctggagagttggctcagcagttataagcacttgttcttatagaggaccagggtttgattcccagcacccacaccgcagctcacaactatcttaactctagttccagaggttctgacactctccccttggcctctgtggggccaggaagcagatgggacggacgtaggcatacgtccaggcaaaatgttcatatgcaaggaataaataaacttaagaaagaaaaggaactacagcctcacgtttggactggatggcagtttcaagctgtctcagagaaatgactccagccctacccggccctcctgtgatgtacaggagagtcactgctgccgcctccaattacagcagcctctgggttctatatagtgtttgtttcttatttaaatggatgctaaaattggtttcactctttttgttcacttatttttagttctaaaatctttagctgaacaacaacaaaaaaatccttaaaactttttttttttcaaatttttattagatattttcttcatttacatttcaaatgctatccggaaagtcccctatacccttcccccttaaaacttctttttttttttttaaagatttatttattattatatgtaagtacactgtagctgtcttcagacacaccagaagagggagtcagatcttgttacggatggttgtgagccaccatgtggttgctgggatttgaactctggaccttcggaagagcagtcgggtgctcttacccactatgtgtatgaatgtgtcttcatgcatgccacatgtgtgcctatgcccagggaggctagaagagcgtgccggatccccgagaaccagagttactggtggttgtgagcagcctgacgtaggtgctggaacggaattcagtccctgtgtaagagcagcctgtgcgcgtgtaacttcgagggtccgtgtctcaggtccctttagtacatttgagtgtgtcttgtgaacaaaaattcctgaaaagaagttgtgtctgcagagactggtagactgattagaatttcagtgttgtggcaagagtggaatcttgtcgcttcagaggccgattactttctcttgggctggttttagcttcaggcagcctttccttgccttactccatctgaactgactcctcgtaataagtaaaaccctctcggaagcttttaatgtagcagaacactagcctccaccaggagagctaagaatatcatcagagagcatcttgggcctataaaaagccccctggtgtacccacatctctggtatacccgtcagtgtattttttaagttgctctaatttgggggcttagtggttaagagcactggctgctctgagttcaattcccagcaaccacatggtggctcacaaccattctgtaatgggatcctttctgtctgatgccctcttctaacatgcaggcatacatgcaaatagagcagtcatatgcataaataaatcttgggaaaagaagcctcaatttatgtctttctttgttctgcgaaactataatacacttaatgaaactgcttccacattggaacatggagtttgtggtaacctaaatctgcgatcctaggccttggtcactcagaatggttcctgaataaactagttccttaaactctttaagatgagtcgggtgtggtggcacgcttttaatcccagcactcgggaggcagaggcaggtggatttctgagttcgaggccagcctggtctacagagtgagttccaggacagccagggctatagagaaaccctgtctcgaaaaaacaaaaacaaacaaacaaaaaaaaaccctctttaagatgagagctgtggttttcacatcgactctgtgtgtgggcacatgtgggcctcctcccaccgtatagatcttggtgcttgaatttaggtagtcaggcttggtggcaggttcctgtaactgctgggtcattgtacaggaccaggaataaaggaatctcaagcctagacatcaacccttgccgcagttagaaatatggcatttctgaatctcagcctggctcagggggcagcgaatgagtaccagagctgggatccccagcacccacaggaaagttgggtgggcatggtagcctgcctgcctgagatcccagtgctcctgaggcagagatggaatccctgaaaataaagtggagagccatcggggaagatgcctgacatcaacctctggcctccacatgcactcagacacagacacgtgaatacacaaacatgcgcactacacataagctctctcgcttgtgcgcacacaccccacttctgtattgttagctatcccttaaagctatcacctgttttgatttcttttttatatttgagacaaggtctcatgtggtcctgactagcctacaatttgctgtgtagctaagggtgacctgaaacttgtgattcttctgccttcacctcccaaatgctgggttatacggtgtcaccaagccccagctttgcctttcttcatctttttcagtgagactaatttagtcacaggagtcaccaacattaaaacaacgcttgctgacagctgctaagtacctactgtgtgccctgaccttcagccatgttgattatgcggtgatccttgatctaatgagggcgcacagctagtgtgtggcagagctgggttcaaatgcagggctccgtggtatgcaaaccagacacccctggcaggcagtagttagttagtccaggaacttctgtagttatgtgtcctctgtatgacaacttgcacataactgtgtctgtgactattggcacccaggagagctccgtgacaagcagtagtagactgatcagtgtgggagtgtggggtgtgtgctggggaagcaggtgtgtagtgagcatccattcagtgaattcttagtgccatgtctgggctgcctgctagaaacagatcactctactcactacttagttccggtccccactgacacaccggtgacatctctttctgccccctgttccaaagcaagcccagggcagaaccaagcactcagcatcctttctctgccccacagttggagaaggaggagcagatccacagtgtggacattggcaatgatggctcggcctttgtggaggtgctagtgggcagctcggctggaggggccacagctggtgaacaggactatgaggtaagcagggttggagaggccgacaccccgtgtctctatcactaacacccccccacctcaccacccccatctccatcacaacacccccccacacctcacccctatgtctccatcactagcccccccaacacacacaccagccgccacatgtgattacattagtgtggagagccacccaccctgcctgtctcctggagggtcctgggtatgccgaggagacagagcaggcatgggggaaagctgggctgcctggattgtggtcaaataaggaacaagaggccctcacttgtaaaattcaattgcagcttaggtagtggcctgggaactggggttccacagtgtcatgactctggtaacctacaaaatacaggccctttatgattgatacttaattttttccttgagatgggtctttccttttgcccaggctggcattgactcctagactcaagcagttctgcctcagcctcccaggaagctgggactactatagtgtgctctgtcaagcctgcctcataggactggcagaggccactgtagctcagagtattagcctactgtttttccagtaaagtgatggcggtgaaaactgcactcaccatgaggcagttgacaagtctgagcctaagccagtgaagaacgaagggtgtgtgcgcgcgtgcgtgcgtgcgtgcgtgcgtgcgtgcgtgcgtgcgtgcgtgcatgtatgtgcgtgtatgtgtatgtgagagagagggcagagccaggtccagccttctgatgttagactaccccagcgttggtctttgttgcacagctgtgcctgttgaaaataaagatgttttgaatgttttgccgcctccccctcccttttgttttttttaaagatagggtctcactgagccctgattggttttgaactcacatgtagccgaagctggtcttaaatccccgatcctcccaccccatctaatctgactaagtgctgccattacagctgtgagcggccttctttcccctctgtcctgccgactggcacctcagggtactgtcaggttcaaggggtgaatgcaggccccttgtcatcttcctggccatagagagaacgttgtgtctttcgctgttaaatatgacgatgactgtagggtgggttcttagctggtgggttgccccaagaccccaagaccatcagaaaacacagatacttacattacaattcaagacaatagtaaaattacagttatgaagtacaatgaaaataattgtatggttgaggtcaccacaacatgaggggccttgggaaggctgagggccactgctgtaggtttttgttttgtttttttaagctgaggaacttcttgtttgttcctagttaatggagttgtttgtttgcttgcttgcttgcttgcttgcttgcttgctttttaaagatagggtcttgctatatagctctggctgtctgggaattccccttgtagaacaggcttgtctcgcactcacagagatcttgctgagtgctggggttgggagctcttttcctgagtgctgtcttggtctgttaggctgggttgccctcctcactcggcccttcctcatcccctgcggccctggatggcagcctgtgccacatgccctcctctctgggttgagctgcttctttcctcacactggaaatgggttgcagggccttctacatgttagagaagactaccacggaggcccgtccccacctgggctccataagatctgtttttgcagaatgaggttgcttgcaccaaaaccacttttattctcaaaattatatgccaagtcagcagattttggtattactccaaaacagttctttgcccagttctgctcactcttaagtgacctgagtcacttgttagcccaggggtcagacagctcacagtcagctgcagccccagcttcaagggatcccacacttctgggttccacagccctgcaggcacctacacgcaaatgcacatgtctgcacatcgacacacatgcacataaatacagtcaaactagagacagctggaagagcaaagaaaggacaaataagcagatcagggggttggccagggttgcctcctcctccaggtcactgcttctgcgaatcagcatgcttcttcccctccatgcagatcacgcaaaggaagactggcttggaggtaattcgagctactctggaagagggagaaggggtttgcaagtcaaggccagtttagggtgctacatagagcacttgaggccagcatgagcaagttggccaaaattttaaaattaaaacaggaagaaaaatggggtgcaagttgaggctggagctccatggtggagtagtgtttgcttagaagtcttcattgtgagccaagggtgtgcctgagcagctctttacatttctgtgtgcatgagcctaaaactcctttgcattcctccttatatacatgctgcctgttcctcatgttccgtgtaaaggagggcacagatactggattggaaataacttgtagactgggaatgtggtctcagaggccacttccttggaaaagctggttggcttttctcctgccactactgcattcccttcttcctctctcttagtcccccattctctctgagtcctacccagcccatcctcagccattggctactgccatctttactgatagattaaattccagctgggagcaaggaccttcagtgtcaatagacacagattcccgatcagagcatcagaaccaccctctacagccctgcctagaatccccctgggaggggctggggatgtggctcagtggtagagctcctgcctagaatccccctgggaggggctgggggcgtggctcagtggtagagcccctgcctagaatccccctgggaggggctgggggcgtggctcagtggtagagcccctgcctagcatttgtgaaaatctagctttcatctccaatacaaaaaattgtataagagagattcactagagttgaaggtagcccagactagagtaaaggttgtctttggaaggaagcagaaaagcaatgtcacaaccagagtggtttttttctttacagtgaataaggcgagacatttggggttccctgccacttagtgacttagtgttggtaacagctcccagctgttggttgtacacacacacacacacacacacacacacacacacgctcaccatgcaaaatccagcccagtagttcacttgagattctggccctttgtaacaagtgcagaagaagccagcgagtggcttctgttctgtatgtttttgttgttgtttctttttcacaaccccagctgagcaccaagaggcatagtgttatattttttaaccatagtaaaaggcttttattttctaattttataaatttttcagtatgtcagttggaaaaagaggtgaaataaatagaataagcctaactgaacattgcttacagcatcagggaacacctgttctgtcctcaggagggaaggctagccccaggcagactcagcactgctctgacagtttgggctgggggaggtagcttgattggtagctttctttcggatttggcccagtggtcagaagtgactgcggttgctctatctcatcagtggcttcggaagcagcaagtacagcaggtggcttgagaaacaccgtggccttggtttgcctccccctcccgtcattcctatttcctcctccatttccctgcatcctctgccccaccctgggatgttttttgaggaaaggtcttatgtagaccaaacttacctgaccttgcatgcttaacctcctgccagcacccccaagtgccagtgacaggcttgcaggatcgggcctcacactggctccccaatcccctgcttcactgacctggaacctagttcttcagttaagggtggccgtgccttctgaccctccgacctccacctcctaaggaattggatttcaagtgtttggcaccatgttccagttatgcttgctgtacagggattgggctccagcttcctgtgtgctaggcaaacgccaactgagccacatcctttccccccactcccttactgtgtagctcagactggccttgaactagtgatcttgcctctgcctcctgagtattagaactataggcccgccccccacccgacccctcttctttgtgttctgattggccagagctgtatcttggtccaactgctggcagaggggtggggcttgcttgcactggtcatgattccattggtttgggcacacagctttttcatggtccagaactatgtggtcagttctgattgtcatctgttccttcatctgcgtcagtatctccatttgttttcttgagctgatcttaagcaggccaattgtgtgtttgagggtgtgagtatatgctgccttcctgagtcagagtgtgtggtttgtgggttctgggacccctatgggccacccactcgttcttacttctgtgatgggcctgccatcacctgcagccagagaatgtgcacattattttgtggactgaatttttttatgtaagaatgtagttaccagctgggcatggtggcgcagccctttaatcccagcactcgggaggcagaggcaggcgaatttctgagttcgaggccagcctggtctacagagtgagttccagagaaaccctgtctcgaaaaaccaaaaaaaaaaaaaaaaagaatgaaagaatgtagttaccaactgttactgtaagcctgggttctgatgaagagaagacagagctgttgtccccactggggtgaggaacagaaagcaggttggaatgatagaaacatctgtcacagtgcggaagggtcacgggggctgagcaggtgtgcccttccctttctactgctggtggccccaagagaggggttagtatggggtgctgaaaactgggttcatccttgcatcaggaggagctggggtgatgctcctgtagatgggcaaggttgcagcgtgcagcctctctagctcctcctgctgacggagcctggtaaggcacagctggccaccagagctgtctccacagagctgccccagcctgagggtgtgggccggaagcatcacttaattcttgatgctgctgtgctccatctttggatttgatcttatttctgacatcctgtaactcctggcctttgagctaactcaaccacgcatgtccatagggcacttgagtactgtacctctcaccaagatgcctctgtgggacagtcccttagggcatgtggtcctctgtactgcctgattttacatgaaaatttgtctggactgcatatggcctggtgacctcactatggagaactgaaatcagcatgtctggggacaaccccacatcatgcaaacagccctgttaaactcagcaaaccttaaccaagacacaaaatcaggagagcttgttgggaagaagaaggggtccccagggagttggagagggtcaaggaagggtgggtgaatatgatcaaaacaaattgcatacatgcatggatagtgtccaagaacaatgcaaaaattgaaaaaaaaaaatctgtcacggcagcagttgttaccgaagttggaggagtaaggcggagagcagtggagaagacacccagcagtcctcccctgcctccacatggtacatgtgcccacacacccatgcccatgcacccagctcctagaggtgtcatcttacactgtcttctacctaggtccttctggtcacctcctctttcatgtccccctctgagagccgaagtggctcaaatcccaaccgtgttcgcatttttggacctgacaagttagtccgggcagcagcggagaagcgctgggaccgtgttaaaattgtgtgcagccagccatacagcaaggtacatggtgtaaaagctgaggcatgcccagggcaaggggaggtctgcggaggcccatcctgagctcgggactgctcaggtcaggtcctcctgggacaggcagcttggttctctggagggggtgagctgaggcccgtcaggctctgtttggtatcactgttactgtcatactggggcccggaactcaggctcctcctacttctgcttctgcatccagacagcggaggagcaaagagcccggggtagttttgcattccagaagtggctccagacagagattgggcacacagaagtggactcgctacctgccattggcagtgagggtcaaagagcggtgcaggttgaggggtgagccctgactttggtccacagttaggggtcagtgaggtttaatgtcagcatcaccaccattgctccctgggcaccagcttcaactgagccataaagggcttccctaagtgaaggggcatgagagcctagctttgtcctattcagacaccctcacacccagccctctgttccaggactcgccatacggcctgagttttgtgaagtttcacagccctcctgacaaagatgaggcagaggctacatctcaggtaagttgtacctggtaccccccagagcctctccctgcctctccacccctgcctgccagcattcttctcacagcactgaccttgtgggaccttagaaggtgacagtgaccaagctcggccagtttcgtgtgaaagaggaggatgacagtgccaactccctgaagccaggggctctcttcttcagtcgtatcaacaagacgtcatcaggtgcctgtgggactcggggtgctagggatggcgttggtggagtgcttacttagcatagagcccaatcctgaaatctccgctcaggggagacaaggcaggagggccagctgtgtaaggtctcctctgctaagtaggaagtcttgagttcagcctaggatgtatgatgcctgagagctgagggcatggccaggtctctaggtctggggaggagggctggggcctggactactgagtcaggggtacaatctaaacttctgggtcacctctggatgtgagagtgacttgatacctgatagatgggagctaaggtgactgtggccctgccctctcaccctcagtccacttgtccttccatagcctctacgagtgacccagcaggacccagctatgcagcagctacactgcaggcctctagtgcagcctcctcagcctctccagtccccaaggttgtgggcagctcttccaaggtgaggtcatcagacgctggggcagtggagaatgaggagagccggaagccaacccatctctacctcctcagcctcaggagcctcccaaagggaagagaaaactggacttgagtctagaagacaggaaacctcccagcaaaccctcggcagggccatccaccctcaagagacccaaatgtaagcaaactggattccttgattctgtagtgaccctggcttgtgtgtcatgagggaagggctgtggtcttgaacctgccatcctaagaagggaggcggaaagcctgacttcctgtaagagctggggctcgatggggcaccaacctaatttctgttcttttctccccagtgtctgtccctagtcgtactccagctgcagctccagcctctaccccagcacagagagccgtcccagggaagccccggggagaaggcacagagcctaggggggctcgcactggaccccaagagcttggcaagatcctgcaaggggtggggtggtggtgctcagtggcttccagaaccccttccgctcagagctccgggacaaggccctggaactgggggccaagtatcggccagactggaccccagacagcacacatctcatgtaggcctctgacctgccacacggttccctgccctgccctgccctaccctgcatgcccccgctagcttcatctgtccctgttctgctatcctccctccctgcttctttgtgccctccagcccccacttctttacccccttagttctcagctttctgcgtccctccctaagctccatctctgttctgtctcagctgtccatcagatcatgtctgacattcctgttttgcatctcccagctgtgcctttgccaacactcccaaatacagccaggtcctgggccttggaggccggattgtgcgtaaagagtgggtgctggactgtcaccacatgcggcgccggctgccctcccggaggtgaggccccacgacctgcctcttaggcagcgcacacacctgcctcttagcccagagcaggcaatgaagagcctggggcctgctgggtagctcaggcgatctcaaaccaacataagccgttttcaaagacgggctgggcctgcagatgggaagtcactagcctgggtgggccactggattttgtaatgacggctgctttgtgcacattgtgggttgtggctgtgcagaggtggaagggagcctcagggctgtatgccattcctcagaactgatcctttggcatcctttgggtgccaggcagagctgtgactgaagtgaggacgctggggttgagccctgtgctcacttcagcgagtgggtcagaagtgttagagcccagctttgaggagctcaggaggggcacagtgatcgcgggatgagaagcatgggtagcagccaggcagagggcatgcagggctgcagagcaagcagggatgggcagcatgagcatccatctcctgacgcagtgggcgggagaagaaccactggctgccaacagcaggagctgtggagctggagagaagccgactccgatcccagtgaggtcgtggcttgagtctgtttaataagcagggctaaccctggcacattcatgtcggggactgtgaggggaggtgggtgggttggtcagttgatctggaagtggtggggactccacatcctgcttggattccacagatccctgggagctagttatctagcttcagtattgtgatcatcctgaacagatgtgcggagggtgtctgtgggcgcctttattctctgaggtgtgtaaggatagttagctagtgtgccacagtagggacttgaatctaggacacacacacacacagtaccaagaatcaaaaatcttaggatggttgaaaatgaagagatggctcagtggttaagagcattggttgttcttttagaagaccttgactcagtttccagcactcacatagcaactctcaaccatctgtaactgcagtctcagagtgattgatgacttctggctgttataggcaccaagcacacacatatgatgcatagacatatgtgcaggcaaagcattcatacgtgtaaaataaaaaagttagtctttaaatatatacaagttgcttatataaaatgctagagtatttacataaaaactgcatagaatcttttcatacatttaaaaaagattattatttaaattatgtgtatgtgtatctgtgcggtggtgcacatgtgtgttcaggtacgtgaggagaccagttgtgtcaaatcccctatagctagagttacaggcagttgtgagcacctgatgtgggtcctggggaaccagatttggatcctttgaacagtataagctctaaacattgagccgtctctccagcctcacgtactgtgagtgtggatgtctaagaactgaacccaaggcttcccacatgctaagccacacccccagcccctcactgggggttctagtcagggctctaccaccgtgctgtatatccctagcctttttggttttgatttggagtgtaggagggtcttactaagttgttcagtctggacttcaattcactctgttcccaggccatcctgcctctcagcctcttgagtagttgagattagagacctgctcactaggccagtgtgctcttacatgtttttgggttttttgttttttgtttttgtttgttttgtttttcgagacagggtttctctgtatagccctggttgtcctggaactcactctgtagactaggctggcctcgaactcagaaatccgcctgcctctgcctcccgagtgctgggattaaaggtgtgcaccaccgcccggcgctcttccatgttttgaatcattctgtggtttgaatccagcactatgtaaatgccatgtaaatctttagggaatgacgagcaaacggagtctgaatgttgagtgcagacacagactttctggtctgtgattggttgggtgtacagatgcagagaccccagatgtggggttccacctgaatttgcatttgagactttcccccattgcttggcattctcctttgatcctcaaagagtagaccccccccccccattgctctttcttgccttaaatggaacagatcttccccatgagggaaagagcctggggtggctgaactgcctggcacgtagtggagcccctctagggctgggaggggtcagagggcagcaggattccttctctatccccacctccctctacttctcagtcctctgcctgaggcccagttcctcccctaggtacctcatggcaggccttggatccagcagtgaggacgaaggggactctcacagtgagagcggcgaagacgaagctcccaagcttccccaaaaggtctgatgcccctatggggccaggagggaatactgggtgccaaccaggtctgctgaatacctcagcttcctgcttctccccgctgctggctgtccagagcctcacactgccccaacctcacctagcccttcttcctcagcggccccagcccaaagccaagacccaggcagcaggacccagctcacccccgaggccaccaaccccaaaagagaccaaagcaccgtcaccaggaccccaggacaatagtgacactgagggggaagagtcaggttagaatctgagggagaggtctacacgctttatgtctgagggaggaggagggctagggccttgagccctgggtttgggggcagggctggtgtctagctttctgggtctgagggggagggctgtatggaggtgaaggagtagaggaggggccactgtgtaccctgaaaactagattgagagggcaactgaagtcaagttcataggccctggctgtactctcgggtgccattctgggaggggtgttactagatgtcccaggaaccaagcctgttgactgggttgctactggcagaaggacgggacaacggggcagaagattctggggacaccgaggatgaactgaggaggtaggattgaagggggtacgtctgcctggccttgggtgtgggtgtctgctccctaagtgtttaccctccactactcttgatcgcccagggtggccaaacagagggaacaaaggcagcccccagccccagaggagaatggcgaggacccgtatgcaggctccacagatgagaacacagacagtgagaccccctcagaggctgacctgccaatcccagagctcccaggttagacatccctgactctgtgacatgtcccctaggtcccctgggtctctgctgtgtcatgcaccacttgctccctttcctgtgactcccactttacccctgctgacagcttcctgctctggcaagcacctgtgtgacattgctgtagtgaccttcccagtgtgagcaacctcatttcctgacttgtgattcaggacttaccatctcgcccctaaacgcagctctgtctgtcatcagctctgctgcccctggacacctgagtgctgggcacagtgtgtttgcactcattactgataacgttaagccagctctgtttgtgcgtgtgctattgagcatgattcttccctgtttggtttttatgagacagggtctcagggagcccaggctagtctgaaacctgtagctttccatctgcctcagcctcccaggttcttagattacacgtgtgccagtacaccctgcctaccagaaagctgctaagaagggtgtctgagccccctggggtggaggagatcctgctgtgggggttcttgcctataatcccagtacttgggatgtcaaggcagaaggatcacaagttcaaagccagccaggctactaagaccctttttaaataaaagaatggagggtcaggagagcaggagagaaaagagcagtcactctcaagcagtgagggtcagggtccctgcaggagccctttccaggcttgtgggcaatgtcaggagagtattgtgaacccccaatgaggggagtgaatccttggacatcgtgtggaaataagaagaaaactagctcagaggccagtgtgggagccagctgaggtgaagtggtggccagcctgggccaaggccataagagccccatggccgtgtgctttagctactgcttagcaccaggcagaggcctgcaggagcttcctggtgacttggatgaatgccttagtcacggccctccctcctgagcaccttatccttggtgcctctgcctcgccctccctctgtgcttctgagtactcaggagcttggtcagtgcctcacttttcccatctctcccgcagacttcttcgagggcaaacacttcttcctgtatggcgagttccctggggatgagaggaggaggctcatccgctacgtgaccgctttcaatgggtgggttgtggggtgggtgggtacagagggtatgggctgcgggaggatggcgaggatggcgtcagggcccagtggcatgaccatagctgcatcgtcctgcacagtcctgctgcccacgatgcttgtcaccctgcagggcccttcccccacccctcctgagggcaaggctgctgcgtggaaggcacaggtctcacaggcagctgcagggggcagaggtcaagctaaaagccaggctcacaaacaagaaagaggaagaaaagagctggagagatggctgctcttccagaggtcctaagttcagttcccagccaccactggtggctcaggaccatctataaaggaatctgatgccctctactggcatgtaggtgtacatgcagacagatgcttaaaaagatacgtggaaataaagaagagaggggttagagaggatggcgcagggttaagagaactgactgctnnnnnnnnnnnnnnnnnnnnccacgtggtggctcacaaccatctgtaatgggctgcagtgctctcttctggcatgcaggtatacaggcagaacactgtgcatagtgaataaatcagaggcggggggtggggatatttgtccagaatgagagccagaaagctactgctgtagccagcagcgtggcccgtccgagtgtgtgggcagctgtagctggcagcgtggccacctgagtgtgcaagcaggctgctcacagctgccccacccttccctttcccccaccagcgagctcgaggactatatgaatgagcgggtccagttcgtcatcacggcccaggagtgggaccccaactttgaggaggtgagccctggaggggcagacatggagaaccccagcccactttggcattccctctgtcttccgattatattcccaagtggacccttttcccgtaggccctgatggaaaacccttccctggccttcgtgcggccccggtggatctacagttgtaatgagaagcagaagttactcccccatcagctctatggggtggtgccccaggcctgagtgtacacctgtgtacgtgcagatgtgcacatgtatgcacaggcctgagtgcacacgtgtgtacacacaagagtttaataaaggagactttgtttgaagcaacggtttctctcttaggagactcaaggttctgctagcctgggttgccccatgttcctgtcccagggtctgggaagagaagagtggggccctccaccagagatctgctaagtagctccccgcacccctctgtagttctgtgctgacaggagccagggagttggaactgtgccactcagtgctgtcccccaaatagatctggtccatcctgtcacacatctatggtcagtgagctggaggcattgatgcttatcacatgtgccagactgaccaggtcccttccctggtgtcaccagcgtcgccagcagggtttgcatccaactcgggaggcaggctgggtgggaggaaggctgttcttaggaagttgcccaaattctggagcccccaaggctcagctgggaatggaacagagctgttagggggccaaagcagagggggatggagtccgggtgggttggggggtggggcagaagccacatggtgggagtagcctgaggctgctcacagcaaggggctctggggcacagtcctcgcgtgctgtccattgtggccaccagtcaggtggccatttcatataaagaaagaaaggcatagggcccagttgttaaaggtggaagcaggaggatctctaagcatttgaggcctgcatgaggcgcattgtgagaccttacccacccccttccctatgaaaagctggaatagggagggagagacggatgcaggcagggaggccaacttcagggccccagtcccacatttcaaaacactccatctctagaaaagttctttggatgccctggagggccgtgaactccaggctgaggggtttggacttcattctggggtgggacctgaagggactttagacagggcaaaggtcagacagagtcagtcatggtgagacctgaccctcgggtaacctcctcttggatgtttcctaactttaaccaaccaagggttaccgagctctcccccaacccccgactgtctcatgacttcacactggccgtttctgggctcagtcagtgggtcagtgactcgtccattccactgcatcgacctttctccctgtcactctccgacactgcagccagatcccacagacttggcacagactgacagtgttctgtctgatgctctccagcaggtctggccggctaagatctggataggctggggtaagactggggtaacaggagctggccttcccgaggcttcaaggaccaatctgctgcctttccagcttctaggggctgcccatggtccctccatttaagggcagctatggctggctgcgtctgtccacattacatcactgtgcccttgacctgccacatcgggtaggtagtgcatgcctgtcatctaggtgctggaaagatagaagcaagagaaccccgagtttaagtttggatggggctgccctggagggttgtgatagcatccttggctacatatagcaagcttgaggctagcctggatgacatgagaccctctcagtgaactttaaaaaaaaaaaaaaaaaaaaagactctggtgacatgatccccactggggctaattattatttttttgtgacagtactgggaatttaatgcaagcccttcgcacatcactccacctctaagcactccccagcgctgcactggtctgtgtaatgaccagtgatccaaaatcgtcgattcctcccacttcattctccctcatcgcatgccataccacattcccaggaccatgaaatgactgtccttggttagccactgttctgtgcagcatgttcctcgcctgtgagacgctggggatgctgagtgatgtcatgggccgtatgtgtctgaaggcacggggagcagctgtgcgatgcagcatgggcagtggcagcgcagtgtgacactctaactgcagaatggcaccactggggcaggacggggttgtttagatggggttataaggaaagaccgctcagaggagttgcagcccctgcggggacctgggacagacacaggagcacctgggagagccatcgcacgccaggaacaggtaggaagtagagcatcaggctgcctagagacccacttccactcacacagccactgccctgttggtcgtgggtaaatcctcgaagtctcactttccctgcctgtacaaggtaagggggaccagaccaacacctttggtttcttttgagacctttgcagtaggcaattaatgttattcaaattgacccagcggtgacagtagtgttccttgctacctgccccaagtgttctggattcccaaatgaaacacacacacacacatgatggctgggccacttccaaacctccacgtggctaacacactctcccctccaacattgctgaattattacttctaaaacctatattccatcctggctgctccagacccaggcttgcagccctcctgggccacaatccctgcctctttcatgttggctgtctttctgtcctacatgtctcagacctggtctttctcctttcccagcacggtggttctaaatcctccatcctctctcagtccccttgcctgtgaatcctaaagtcctgcctctgtctccttgcctagctattggccgccagcagctttatttaccaatcagaagcagctgggagcaaggaccctcagcgtcttacagtcttacacttggattctcgtgcaattttgagaacccggttaacataaagcaagcgttagaccaaatttacaacagagatattctcttagcccagggtggcctcaaactccttatgtagcagaaggtgactttgaactcctgattctcctttccgcgcctcacaagtattggcatgaaatatgagcccctatgcttcacttgggtgagtttgcttttgggcagccattgttgctgtagagttttggaaagactgacagggcaggtggcacagttaagaggcccgactgctgggttggtgcagggaggatctatccctccaaagccttcccagcagcttagagcacaacagcctgctcacttccaatggccacttccagagcattcggatcttagctccaacatcacctcaagacccttcctcacctcctcaggtcccaaggtgcacaaactagcatgttcccagggcaggtctgtgggtgtgactttacacccactctcttcattcatgatttgctcctttttagtttcaaagaatacactgtctctgctttcgaagagaaatctttccacctaaacattttggaatttttagatttgtatcttcacccaggtctagatgcatttagcaggcagactgtgtagacttgatgctagcctgggctacatagtgagctaccatcttgggaaaatatatatataacttaggtgctggagagttgatttagtggttaagaacactggtggctctttcagaggaccctggttccattcccagcacccacatggtggcttagaaccacctttaaccttatgcaggcaaaaacacccatatacataaaatagtaaaatctaaactgaaaaaaaaaaaaacaaacttaggacttatagccagatgtggtggttaatcccagcactcaggaggcaggggcagacagatctcatggatacttatgagttcaaggacggccagggatgcacagagaaaccctgtcttgaaaaaccaaaagaaaaattgagacctagaccccagcacttgctgtgtgagcccaatgacctgtctctgattcccaggagccacataggggcacaagtggagcacagactacacaaaattgtcttctgctctccgcatacataatgtggcacaccctctgtcatgcatacacacatgataataaattaaacttagccaggcatggtggctcacgtcttttatcagcacacagatctctaattttaggccaacttggtctacatacatagtaagttctaggcaagccagaactacatagtgggaccctgtctcaaaaatagatagatagatagatagatagatagatagatagatagatagataataaaggaaaaggcctaggctatctatgtaatggagtttagaccacctaggggtaactgtctcaaaaaacccaaaacagtttttgcttcctaatccaggaagtgtctgagcaggccatgctacaatcctttttttttttttcttttaagaattacttctttttatgtacatgggtacagtgtagttgttttcagacacaccagaagagggcatcatatcccatcacaggtagaggttttgtgagccaccatgtggttgctgggaattgaactcaggacctctggaagagcagtcagtgctgttgaccactgagccgtctctctagcacccatgctacagtctttaacgctcccactgccatggacctaaccgctgactggctcagccatcctactttctacatcactatggctctcaactgctgagccatctctccagccccctcatctcattaaaacaaccaccaccaccagattggccagggagacagctcagtgggtaaaggtgcttgctgccaagcctggcaacctgagttcgatccctgggccactcgtggtgaagacagacagctgattcctgtaagttatctggctccttacaggaaaatcttgccattccaggtgacaggcagggatcggcatatgtctgacaagcccaggactgtgagcttttgagaccacagatgttaccacgtctggaaaggcgcctgccaagcctcttactgttattagacgcgttctcacgaccggccaggaagaacaccacagaccagaatcttctgcggcaaaactttattgcttacatcttcaggagcagagtgcaagaagcaagagagcaagaagcaagagcgagagaaaacgaaaccccgtccctcttaaggagcattctccttcgcctcggacgtgtcactccctgattggctgcagcccatcggccgagttgacgtcacggggaaggcagagcacaagtagtcataagatacccttggcacatgcgcagattatttgtttaccacttagaacacagctgtcagcgccatcttgtaacggcgaatgtgggcgcggctcccaacatctccccctatccttttaataagagcaaataggccacccatattaatgagagtggagatagaggtcaaatccccagtgtgtaggtaaaggagccatgtacaggattagctcttaggctcacaggcttttacccagagcaaccctgacctgttcccgtgtcgttttgcctgggggaagggaactaggacactgaaccttcatgaaagatgacatgtctccctagaataggctcatatatgccgcagagcctttccattgcagtgcttagccttgcaactctctcgggctgctgaagcacactcactccatctcgtgcaatgagtctagcctcgtgagatgtaagagctgagtggccagcgacctattgcctaagcatagataaccatatatcagggggagcaccatgttctagagctgcaagcgcctgggcaataaccaccttgtctctcctagtttgggccttaagcttacagaccaatcaaagaagcaacactaatccacagcaaagtgtatctccaaataatattaatcccacccattttttaaagaaagaaaatgctgaggagatccaattgggtaatcctttggtcagggacaggtccaagcgcgtggagttgacctgaagtctcaattcccgaaggatctgttcaaattcagccatccaattctgtaacatatactgaaaaagactttttgacaaattagctgccctagtaaatttaacatactgaatggaaataacacacaatcccggaaacttttgtttacatcccagctgagttatttgtcataatacatctagttgtatctggacaagatctatgagttgattaaccagcatgagacctctctgtatcttgacattagctgaggcctgtttatctatgactgtagtcactgaggctgacaaagtgttaatggtgtcagtcatctggacctgtccagacagagccaaggctgtctgaattaaggccaaacccagttcctagttagtggtaaaaaagcaggagaatacttgagcattatacatcaccatcattgggagtggaaatgtcgacattatcccccaacgctgctctctttttattattgacgccctggacatcaccaagacgagggacattagtatttccttggtcagtctggatttttcgggtgagtctttctggtaaccaaaatgggttgtcttcattctgtgggaaaacacagatagctcccctggatcttatcaaaataggatccgggccataccatttattatcaaggacatttttccatttaaccatctcattgggcctatctggctctgtacaatgacgttcagccgcagtatggccatgagcatcaatatttaaaaaattgagtgtaaagagtgccatagacaccgacactcttggtgctcggggtacagtctcctcaaaagttccccctcttctgttttataagataggttttgagggtgcgatgcgcacgctcaacaataccctgtccttgagggttgtatggaagtccagtcaggtgggtcacgtccatctgacggcagaactgctggaatttttgagacgtataagctggtccattatcagtcttaaggagtctgggtttcccccaagcactccatgcctcaaggcaatgttgaatcacatgtgaggctttttctctcttttgtaaggcctggttagcagctagagtaagagtcctaggggaggagatatgaggatctccttctaaaataccaaacaaaggccttaactcagcggaaggaatctttaaaaaaggtctgagccaattaatatctcccaacagcttttgaaaatcatttaaggtatggaggtgatctcttcttatctctaccttttggggcacaatcttatctggggacaccacagagcccaagaattgtcctgtatcagaaatttggaccttttctgtggctatctgtaaaccccactgacttaaagttttaagtagaaaaggatatgccttttgtagcatggtaaggtctttatggcacaggaggatgtcatccatgtaaaggagcaaaattaaagaggggaattgttccctcactggcaaaagagcttcttgcacataaagttgacacatagtaggactattggacattccctgtggtaagaccttccattgatacctcttatcaggttccatgtgattaatagaggggatggtaaaggcaaatctgggcctatctcttggacacaaaggtatagaaaagaaacaatctttaatatctataataattaaattccagccacgtggtaaggcggaaagtacagggagacccctctgtactgggccaaataagttcatttgctcattaatggctctgaggtcatggagcagtctccactttcctgactttttcttaattacaaaaattggagtattccaaggtgaggtagatggctcaatatggcctagttttaattgttcctctaccagttgaatcacagcttccagtttttcagaggataggtgccattgaggaacccacactgggtcccctgttttccatggtatgggtcgtgctgccccaatggccgctaaggaaaacccagaccctgtctgtcttggtttccattaggtgagatgggctctattcttccctgttcttgatgtcctaacccttttccttctttataacccatctttgccatgatattttttgctttagttgaataccctcccgatggggcgttttcattggacaaaataaggcccaaatgctgcataatatcccttccccagaggttaaccgggagtgggagcacataaggtatgaatttcccttgctgcccttcagaggatccccacgtcaaggcaacggagcttatagtgggacatgattgatatcctaggccctgtaatgaatgagatgactctgtggtgggccatgctttgggccaccaatgtgtagaaattatacttttatctgctccggtatcaaggatgccttcaaactcttttccattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgagtccctggattatctttgttaactgaccagtggtttcacctgctcgagagagcgccttccaggccctaatagccgtggaagaaatctgggcataagctccccaatggtagtttgtctgatcagcagaataagctccctgacccgttaacaagtcaaaagtccaatctctctgctctggagtcaaagcagctgcgtttgctcgggcctgcgcttgtgcagtttcatgccaaagagctctccattccatatatttgcccatactagggagagcggcttttacaaccgtttgccagtcagcaggagttagtgccatgccggcaagcctgtctaactgcaccaaggtaaaattagcattggttccgtatttacgaaccgactcggcaatttctttaatttgtaagtattctaccggagcgtggacacgcccaccctcggctccttcaaagaccggaaatgcctgttgtattttcctttgttcctctctgggaatgaatgagtctgtgcactgcctctctgcgcactgcctctctgcgcattgctgacgcactacgcagggcggggactccgcatagggcggaccttgaagccgactgccctgaggccaatcagcaaactggccttcgccagccgcttttggcttttttcttgaccaattagctggctggtaatgggctgcttcttcctcccagtctgtttcctcagaggagaattcttcatctgcttcagaactactaagagctggcttcctgagctcatccagtgacgagtatctcctagagacctccgctaattgatctttcttcttttccctttttcctctttttcttctaatctctctccaggtattcctacctaaccttaacttttcctcgggttcaagacccttggaaaggcctgtatacttattttgtgtaccatattttctctttgctcctactctctctccccgctttacttctgatagattgccctgaatttcatctagaatcctccctatcttaaccacttgataacatgtgaaaaggaacaaaagggctcctaacaccagaaaaatttcaaggccaaacatattccactttacttctgatagactgtcttgaatttcgttagaaagttcaagatcagacttacctcgtaaagctgtactcactggtactctcgttccccagctgaaaagt

SEQ ID NO: 1796 - DNA, 2123 bp, Mus musculus
gccttgcgcgcttgcgcactgagtcccgtgcagggcgcgcgcgctcccccaaccttctccgggggccccccggagctgcaacccttcttcttcattccctggacggtcgggcgtccacgggcgtggacatgccggagatcagcctccgccacgtcgtgtcctgcagcagccaggactcgacccattgtgccgaaaatcttctcaaggcggacacttaccggaagtggcgggcagccaaggcaggagagaagaccatctctgtggtcctacagttggagaaggaggagcagatccacagtgtggacattggcaatgatggctcggcctttgtggaggtgctagtgggcagctcggctggaggggccacagctggtgaacaggactatgaggtccttctggtcacctcctctttcatgtccccctctgagagccgaagtggctcaaatcccaaccgtgttcgcatttttggacctgacaagttagtccgggcagcagcggagaagcgctgggaccgtgttaaaattgtgtgcagccagccatacagcaaggactcgccatacggcctgagttttgtgaagtttcacagccctcctgacaaagatgaggcagaggctacatctcagaaggtgacagtgaccaagctcggccagtttcgtgtgaaagaggaggatgacagtgccaactccctgaagccaggggctctcttcttcagtcgtatcaacaagacgtcatcagcctctacgagtgacccagcaggacccagctatgcagcagctacactgcaggcctctagtgcagcctcctcagcctctccagtccccaaggttgtgggcagctcttccaagcctcaggagcctcccaaagggaagagaaaactggacttgagtctagaagacaggaaacctcccagcaaaccctcggcagggccatccaccctcaagagacccaaattgtctgtccctagtcgtactccagctgcagctccagcctctaccccagcacagagagccgtcccagggaagccccggggagaaggcacagagcctaggggggctcgcactggaccccaagagcttggcaagatcctgcaaggggtggggtggtggtgctcagtggcttccagaaccccttccgctcagagctccgggacaaggccctggaactgggggccaagtatcggccagactggaccccagacagcacacatctcatctgtgcctttgccaacactcccaaatacagccaggtcctgggccttggaggccggattgtgcgtaaagagtgggtgctggactgtcaccacatgcggcgccggctgccctcccggaggtacctcatggcaggccttggatccagcagtgaggacgaaggggactctcacagtgagagcggcgaagacgaagctcccaagcttccccaaaagcggccccagcccaaagccaagacccaggcagcaggacccagctcacccccgaggccaccaaccccaaaagagaccaaagcaccgtcaccaggaccccaggacaatagtgacactgagggggaagagtcagaaggacgggacaacggggcagaagattctggggacaccgaggatgaactgaggagggtggccaaacagagggaacaaaggcagcccccagccccagaggagaatggcgaggacccgtatgcaggctccacagatgagaacacagacagtgagaccccctcagaggctgacctgccaatcccagagctcccagacttcttcgagggcaaacacttcttcctgtatggcgagttccctggggatgagaggaggaggctcatccgctacgtgaccgctttcaatggcgagctcgaggactatatgaatgagcgggtccagttcgtcatcacggcccaggagtgggaccccaactttgaggaggccctgatggaaaacccttccctggccttcgtgcggccccggtggatctacagttgtaatgagaagcagaagttactcccccatcagctctatggggtggtgccccaggcctgagtgtacacctgtgtacgtgcagatgtgcacatgtatgcacaggcctgagtgcacacgtgtgtacacacaagagtttaataaaggagactttgtttga

SEQ ID NO: 1797 - protein, 533 aa, Mus musculus
LARLRTESRAGRARSPNLLRGPPGAATLLLHSLDGRASTGVDMPEISLRHVVSCSSQDSTHCAENLLKADTYRKWRAAKAGEKTISVVLQLEKEEQIHSVDIGNDGSAFVEVLVGSSAGGATAGEQDYEVLLVTSSFMSPSESRSGSNPNRVRIFGPDKLVRAAAEKRWDRVKIVCSQPYSKDSPYGLSFVKFHSPPDKDEAEATSQKVTVTKLGQFRVKEEDDSANSLKPGALFFSRINKTSSASTSDPAGPSYAAATLQASSAASSASPVPKVVGSSSKPQEPPKGKRKLDLSLEDRKPPSKPSAGPSTLKRPKLSVPSRTPAAAPASTPAQRAVPGKPRGEGTEPRGARTGPQELGKILQGVGWWCSVASRTPSAQSSGTRPWNWGPSIGQTGPQTAHISSVPLPTLPNTARSWALEAGLCVKSGCWTVTTCGAGCPPGGTSWQALDPAVRTKGTLTVRAAKTKLPSFPKSGPSPKPRPRQQDPAHPRGHQPQKRPKHRHQDPRTIVTLRGKSQKDGTTGQKILGTPRMN

SEQ ID NO: 1798 - DNA, 57013 bp, Homo sapiens
atgttctaggctgctagccacatgtgggggaaaagttgcaggttacagaattcttcagtgtcaaaaacagaaaaggaggatctgagaatccaagcgatagaatcccttttgtcgtagacagaaagagcaaagtccagagagggcaggcttgaggcccaacagcacacagtaaggccctgtgggtctggcccttgcctattctcattcactgccccttcccactcctgtccagcctgatagactttccttctttttttttttgaaatggagtctcaccttgtcacccagtctggagtacagggatgtgatgactgtagctgagatgacaggcatgtgccaccacacctggctaatttttgtagtttagtagagaagggatttcaccctgttggtcaggctggtctcgaactcctgacctcaggtgatccacccgactcagactcccaaagtgctgggattacaggtgtgagccatcatggccgcctgactctttctgatgcctgagtggctaccttgagtcctgcctggggacccatgcacctgctgttctctttccttcaaggctctactcacaacttcctgttctactctcaaaccttcctgtgacgggctcagtcagatctcagctcacgtatcccctcagagaggacttcccctccctgaccaccctatctgaagtagctcacattcccccactattcatttcggccagttgagtttccttgtagcaattattactgtcaaaaatgatcttatttatttacctgtttattggcttttgacccgttgcctgtcctgttctctgttgtttccccagcatctagaacaataggtgcctgacacaataggtgcttcgtaaatatttattattattattattattttagagacagggtcttgctctgttgccccggctggaatacagtgggatgatcatggctcactgccatctccaactcctgggctcaaacgatcctcccacctccgcctacagagtagctgggactataggtacacagcaccaaattttctgtagagacgggggtcttgctttgtagcccacactagtgttgaactcctggcctcaagtgatcctcctgccttgatgggattacaggtgtgagccaccacacccagcctaaatgtttatttcattggtcagtgtcagaactaggattggaatttagattgttaatctcttgccacaagataggaaaatggagcaagatgaggagaaaaaagcatttaatgggagagaacacccttgtctgaggtcagggacctgggaagcaagcacgactttgccactgtcactgtgtgttacttggacagtgccttattttcccatctgtgaaataaaagagctggataagaaccttagttttgagatcctgtctcccttaaaagctgaagacaaaggtaactgatccaagggcagacaagggatggtaccatcatctccagcttggactcccactgctgacaaaatttgtcccttcaaagttgagatagctaccatggggaagagcacttagttctatactgaatggctccaggcattttcatgaaagctctttcagctttggggaagaatattcatccatatctttaccccatcatattagtgtctaagccctgcaatcaggcatgtcagccacgtgatggaatgggagggctgcagggcagcactgtccagtagaaacgaaatgcaagccacatatgtcattttaagttttctttttttgagatggagtttcactccatcacccaggctggagtgcagtggcacgatctcgcctcactgcaacctccgcctcccaggttcatgtgattctcctgcctcagcctcctgagtagctgggattacaggcatatgccaccatgcctggctaatttttgtatttttagtagagatggggtttcaccatgttgatcaggctggtctggaactactgacctcaggccacccgccttggcctcccaaagtgctgggattacaggcatgagccaccgcgcccagctaatttttgtatttttattttatttatttatttattttttgggagacggagtcttgctctgtcacccaggctggagtgcagttgtgcgatcttggctcactgcaacctcagcctcccaagtagctgggattacaggcatgcaccatcatgcccagctaatttttgtatttttagtagagatggggtttcactgtgttggccaggctggtcttgaactcctgacctcaggtgatccaccggcctcagcctcccaaagtgctgggattataggcgtgagccactgcacccgtcctaatttttgtatttttagtagagatggggtttcaccatgttggctaagctggtctggaactcatggcctcaagttatctgcccacctcagcctcccaaagtgctgagtaagccaagttttctaatagccacattagacaagtaaaaggaaacaggttaaattcattttaacatgttttacttaacccaatgtatccaaaatagcatttcaacatgtcatcggttttttagttttttttttttttgagatagtgcttcgctttgttgcccaggctggagtgcagtggcacaatctcggctcactgcaacctccaccttccaggttcaagtgattctcctgcctcagcctcccgagtagctgggattacaggcacccgccaccatgcccactaatttttgtatttttggttagagatggggtttcgccatgttggccaggctagtctcaaactcctgacctcaggtgatccacccacctcggcctcccaaagtgctaggattacaggcgtgaggcaccgtgcctggcgtcatcggtattatttaaatgaattatgttacgttcttttgtgctgtcttcaaaatctgttatatattttacacttacaccaaatctcaattaccatggtacatttttatctgaaatgcttgacctttattttgatttcataaaattcatagttggagaagtagattcacatatccaagttgttccaattatataatagttttccaaaaactgagatgggtgtccattttttttttaagtaaagatgcaggtctggttatgttgaccaagttgctgggttgttttgttttgttttgagacagagtctcactttgtcacccaggctggagtgcagtggcatgacctcagctcactgcaacctctgcctcccaggttcaactgattctcttgcatcatcctcctgagtagctgggactacaggtgtatgccaccatgcctggctaattttggtatttttctcagagacggggtttcaccatgttgggcatgctggtcttgaactgctgacctcaggtgatccgcccacctcggcctcccaaagtgctggtattacaggcatgggccaccacacctggcctcagctgttcaattaaaagtaaatacaacttaaaattctatgtttcattggcagtagtgcaacattaatactgagtagccacatgtgattagtggctatggtattggacagggaaggtacagaatacttccatcaacatagaaaattctatcagtctagctctaggggcagatagtccttccactgacttgggcaagtcactctacaaatggcatctacctcacatggttatggtgagaattcagcgtatgtatgtacatgcaggcacacaatatgcacacagacacataacatagtacaccctttcctgaaaagcctgacacatggagctcaaacatgagtgccacccacccctgggcagcaccaagatggctctagtctgggtgcctttgtctcacccccatgcctttgctcggagtgtgctcctcatttttctgccactttgaccctgtctctgatttggtcctgtctgacatcactgctatatgctttgctcctctcaatttcctctgccctcatgccagcaggagtcatgccagagatcatatctgagaaagcaagacaattttgtgtgtgtgtctgtgcccatagaggagtgctggttgtgttgatatagttgtagattggttgtgtttacacagttgtatatattgacacccttgagtgttatgacttcttttgggggtggtcgccttttaaatcataacttttaatgggattccattttagtctttgtgaagacataaggttgttggcaggcatctgtccctgggagcatccaagcagaaaagactaagactcccttgtagacagatcactggccgccactgaagtgtgtctgcatggcaccacagggctggaagacccttgaaggcaggaattcaaggaaatgtatgatgaattttggcattgccatcaaaagcagaacaggcatggaaaacttgggtgagtgggcgagacaacctcctcaccacagcagagttccatccatgcctggataatgagggagggatttgtgtccactgcagtggggaaccatgaaggacacatcaagggtgtggttggcctgtggtgctctttggaggaatgaataaaaatgaatagaaatcctattgcgtgtctgttcttttggagtttgagggaaaagaaagatccttgagattttgactgggctggaaacctagactccagcgtctggggataggagggatggtggggaatccgctgggaaaaactgggctgtgatcaagagaatttatcagtatctgagtttttccaccctggaaggagtgcgggcagacttactgtttaaacattgggagcttatgatggtaaagcgccttagttctggagccaggtatacccattaatgaccccaactgggccagcctttctgtagccatgcccttggattgttgctctccttctaggtttgactatgtggtttgcttcagccactagaacaatagcaaacatgatacaagcagaggcttggaaagtgcttatgcggccgggtgtggtggctcacacctataatcccagcactttgggaggccagggcgggcagatcacaaggtcaggagatcgagaccatcctggctaacacagtgaaaccccgtctctctactaaaaatacaaaaaattagctgggtgtggtggtgcacacctgtagtcccagctactcgggaggctgaggcaggagaatagcttgaacctgggaggcggaggttgtagtgagctgagactgcgccgctgcactccagcctgggcaacagagcgagacttctctcaaaaaaaaaaaaccaaagtgcttatgcactgggacttcctctcttgctccccttgggacccctaccaccactgccacatccaaaccccgggctggctgagcatggtggcatatgggtataaacccataatcccagcacttagggaggcaaaggtggaagaatttcatgagcccaggagatcgagactagcctgagcaacatggcaagacccccatctctacaaaaaagcaacaacaacagaattagccagatgtggtggtgtgcacctgtggtcccaactacatgggggaggctgaggcaagtggattgtttgagcccaggaagtcgaggctgaagtgagctatgatggctccactgcactccagcctgggtgacagagcaagacaatgtctaaaaaaataaaaagaaggaaagaaaaggaaaagatctgggctaacctgctgggtaataaagggaaaagagacacatggctccgtcatccttgatccctgccacccatagccaaccaacctctgaaacagagctccctagctgataggcagctgaacccagctgagaccagcaaaagaactgcccagctgatcccagaccaagttgcaacccagagaatcattaactaaataggtgattgttctaaaccactaaattttggagtggtttgttatgtagcaaaagcaactaatacagacttgttctctctgtgtgtgatgtggtctctttctccccaacaacatgacccaatgattaaaatcttaaattctgccactttttagctgtgtgactgccaatgtgacagccttctgagcctctgatgtctcctgaaaacagagatgtgaataatagtgcctatgacatagagttgtgaaaataaaatgaaaaacagcttcttaaggggtcatggtggtcatttgtgctattaatgaaacatgtccagttctctgccttctgaccttggggcaggatctcacttcctggtgcccatgtggctgggtgggccatgtgactagctccatccagtgacttgtattaagtcacttctgggtcacagcatgtgattacccatggtagacttcctgtgacacagaaattggccacattcaagttggtggatgctttatttatttatttatttaagacagggtctcactctgtcacccaggctggagtgcagtggcaagatctcggctcactgtggcctccgcctcccggactcaagcaatcctcccgcctcagcctcccaggtggctgggactacaggcgtgcaccaccacgcctggctaatttttttttttttttttttttttgtatttttgtagagacagggttttgccatgttgcccagactggtctcaaattcctgggctcaagtggtcctcctgcctcggcttcccaaagtgctggaatgacaggcgtgagccatcgtgccctgccggtggctgatttatgactatgacgaggaaaacaccctctggatagtgctagggtgaaggaaaagtttaccttttgtgaatgggcagtcattcagcaaatatccactcctctcccttctactggagggggagtatatttccctgctccactgatgggtttcaccatatgatttacttaatggaattttagcagacctaaccttagcaaggcccttaagtgcacttggcttttgtgctcccgtgatgtgccatgagaacatttgcgagggagctgctgatcccagaaaattgtggaatctcatggaagagacctgaatcctcccgaactggagccaaagcagccatcccacaaacccttagaagaatgcttgttggtataagtctcagttttcatgttgggaggccgaggtgggtggatcacttgaacccaggagtttgagaccagcctgggtaacatggggaaaccctgtctctacaaaaaaattacaggaaatagctgggcatggtggcgcatgcctgtagtcccagctaccagggaggctgagcggggaggatcgattcagcccatgaggttgaggctgcagtgaactgtgatggtttcactgcactccagcctgggagacagagtaagactctgtctcaaaaaaaaaaaaaaaaaaaagaagtctcagttttaggatgatttgttacatagcattattacagtgttagttaatacaactttgttgttttaaaccactgagatcagggacttgttttgttactgtaacatctagtctgtcccaattgatgtcagtgtttagcacctgtcaactaatggccactcagtaagtggcagctattatgatgattactgtttactcaggcatacattgtctttagaatccacatgtggtgctaggcattgcactaagcgctttttaagttgtctttcatttgactcttacaacaaccttatgaggttataactattaatatctacattttgcagacatgaacactgaggcaaaaagaggaagcagttaattgagagagatgatcatggactctgaagtataccagactcgggttcaaatcaaggttctgaccctccctggttgtttgacccaaggcaaattttgacacccacaatctatgcctcagtttgttcatctgtagagtggggataataatatcaacctcacagttgttatgatcatgaaatgaggtatagcatggaaaacacagcacagggacctggcaaagactaatcccttcataaaaggcagggccaccaggcatggtagctcacacctgtcatcccagcactttgggaggccaaggatcgcttgagcccaggagttcaagaccagcctgggcaatgtggtgaaaccctgttgctacaaaaaaattaaaaaattagccagtcatggtggtgcacgcttgtagtcccagctactagggaggccgaggtgggagaatcaccgagcatggtggtgcatgcctgtagtgccagctactagggaggctgacgtgagagaatcacctgagcccgggaggtcgaggctgcagtgagccttgaatgcaccactgcacttcagcctgggtggcagagtgagaccctgtctgaaaaagaaagaaagaaagaaggcagggccttccctctcttcctcaaaaggaggggatttgaaatgaggattgagaccccctatttcctgcattctatctcatcaagatacatcacaccacaaggactcaggcttgctctattaacttctttataggcacacggggagttacaggctgaggacaaatggggacttcacactacattatcttcctctgttcagatagcttttcagggggagtgagtgcactctatatgatggaggaagaggacattggtgcctgtgggtacttcagcaccaggcttggtaaagcacatactctctgtagcacagccccgcatagcaaatctgggtttgaaaatacctgaaagggagatttcagactggaatcagggacctcagccccttcttcctcataatcccagaacacatcctcacccacttctctggaaccctctcctcccatcgaacctagaagtttggacctctagttctgtttccttttccagagattcaggcaccactcaccagcctgcacgtgtccagataaggagacgcagtggttttcctttccagtacagtgggtcatgggccccatgcatttgtccctgaagctcgcagtgcaggcggggcacatcaggccattctcagtaagattggtcaagggaactgaggatgaggatgaagtgtaaggtgaatagggatgtttaagccgttcccccaacctcccaacaaccccgggaaacaccagggttgctaatagacactgcattttacaggtaaggaaacaggctcagagccagcaagtggctacagcaagggtcagtggagagccagagcacacaccacacaccacgggcttcttaccagacaaaaaggcactgttgcagccgtcgctctggcagcagaaggagctggttaccatgtggtccttggggcccatggtggtggatataacgccggagtagcagtcctgggacctgatgcagcccttgtaggtgtgcaccaactccttgccctctgtgggatggggacaggcagggacagtgctggctgaccactccctggcttcaacccctgcctcaaggtcttgcctaaccctaggcctccccaaccccacaacttcctgggatggtctctttcttttttttctttcttttcttattttttttagacggagttgcccaggctggagtgcaatggcgcgatcttggctcactgcaacctccacctcccgagtagctgcgatcacaggcgaccgccaccatgcccggctatttttttgtatttttaatagagacggggtttcaccatgttggccaggctggtctccaactcctgacctcaggtgatccgcccgcctcggcctcccaaagtgctgggattacaggcgggagccactgcgccagcccggccggggcggtctctttcaagccccctagagccatgcggccaaatctgtctggtgcatggcctggagtgctttcttaggtagccctccctcccgctgccatagcccctagtcggcctttggtggtctcttccagctccccattgccaacctcagcctgctggatgtggtcccttccaccccaccccaccccacccacggccacccctctctccctgtccttccgggattactctatttcaggccgcctatggccacccccatgccttcgtgaaatggtctcttccagcctcctcaactccccgccaacccccgcccaccccgtagtctcttccaatgaaccccggtcccagcaacaggcatcctcctctctcagatcctgccatggtcactcctcagacctcccaacgagggtctcttgctgcccctcttggctattttcaggtcttgtttaaggtgggttcttccagtctccccggccttccccctccccaccatgtggtggtctcttcctacccaattcacaggttcccccttcactccatcgaggggtcccccagctctctctcctcccttcccgagggtgcgtttcctcttctatgccgggatgggggttctcttcaagcctttcaggtccttccttaacccaccaacgctggctgggtgattttcgatctcactttcctttcacagcctctcccgaccagtgttttctccctgcacccaaagtcgcctttattccctcaccaggcctcatcatctctcctcctgtgattgaaagtctctttcagctttgtataaacatctctgtcccccattggtctcttccattgctccctttctcctccatcatttttcaggtctggggtggtctctttcatttaactcatgcccatcttctctcttccattttattttctgagacaggtttccctctgttgcccaggctggagtgcagcggtgtgcacttagctcgctgcagcctcgatctcctaagctcaagtgatcctcctgcctcagcctcccaagtggctgggactacaggcatgtgccaccatgcgcaactatttttttttttttttttctgtagagatggatctctttttgttgtccaggctggtctcaaactcctgggctcaaacgatcctcccacctcaacctcccaaagtgctgggattacaggcgtgaaccaccgtgcccggcctccctttcattttactcatccacatctccccctccctgtctctgcttctcctctttacgatgatttgctcagccaggcacggtagctcatgcctgtaatcccagcactttgggaggtcgaggcgggagaatcacttgaggtcaggagttagagaccagcctggccaacatggcgaaaccccgtctctactaaaaaatacaaaaattagccaggtgtggtggcacgcacctgtaattccagctactcgggaggctgaggcaggagaatcgcttgaacctgggaagtggaggttgcagtgagcagagatcgcgccattgcactccatcctgggtgacagagcgagactctgtctcaaaaaagaaaaaaaatgatttgctccatacttcaaggttatcatccatctcctgtttggggtgatcccttttctgtctcttccaccactccaacactccaccatcatctctcctccctcggtcaggaatgacctcttccctgattacacttacactttcccaccccagcccagcctcttccttctctatccactccccaccatttccacctcctgccagttagattcttcccctctcactatttctctgccccccacagtgtctttccttacccctcttctgcctaagaaagtctattaactctcacccctcccacattttccttctctttaggacagtgtcattttcagaattctgtgacaataatgatttctatcacaccacttatttctgttccctccatctcatgatggtctttccctctttcctgctctccactgatttcttcccacgctcccgtcttgagaaccgtgatgatcccccctcagcatggtagtctcttccaccctgaaggtacaccccacctccccaccaggtcccaggccacatcctcttacttgaagtagccttcccgaccaggagcacacatgtgtccttgtcactgctgcaggtcttcatttggccatggcacctgctccccgccgccgtacatatttcgcagtgtagtgggcaccctgcagtgtagacagagggcgaggctgtagtcatgggtggtgtggtcttcggaccacgactttgacttaggacttttgtgtcctgagagaggagggaccagcagctccctggtttttcatgggcgggatgttgaccactgcccaaggaactgtccagagttggacgaagaagcagtggtgatgccagcaaagctgcttccaggggcgggaagcgactccaccatgaagcctgtttgcctaattacatggctggggattttggatgccagggtccgctgagaaagctcaggggcagggaggggtcgtgatggaggtttccatggacttttgtgaaacttcaggtccagctggttcttgaatgtgggattctcctccttgaaggtgccatgtaggtcttgtagacagcaggagctcaggcagggggccctgaggctagggtctgcatcccaggtcaaggagggagagtgaggaccaggagggcagaggacttgaacttcttggttctgagagaggggacagctaggggcccagaaacctgggtcctggggaaagtgaggcttacttggactcctgtgtgcaggggaggagggggctggggcctgaacttcttagtctaaggagaaaggaaatctctctacctcttttaaaaaaatatatcatatgatattaatgtattttttttgagatggagttttgctctgtcacccaggctggggagtgcagtggcacgatcttggctcactgcaacctttgcctcccagtttcaagcaatcctctcacctcagcctcccaagtagctaggattacaggcgcccaccaccaagctcagctaactttttttgtatttttagtaaagacggggtttcaccatgttggccaggctggtcttgaactcctgacctcaagtgatccacctgcctcggcctcttaaagtgctggggttacaggcatgagccaccgcacctggccttctccctctttttttttttttaattatatttttaaagatttccctttccagccatgctctcatctgatttcctagaattgagatgtgtttgggatccttcctggaggatggaggattcagagcccaccaagcccctctctcagggatccaatcacaggagcttttcttctctgggacccccaggctttctcttcctttacccttggcctcttccatgaatctgaatttccagaatgcctccccgttcaccttgaggacttgctgaaggctctctctctctctatatctctctctctctcaatctgggacctctctcttcctgaggtcccagagacagttcaggtcccttgtcacttaccaagacccaggagggtgcagagcaacacaaaggccagcagaaaggtctctggtctcctggagagcctcatggtgtgtgtatcagcagtacctggtccccagcttttataggaagctgaggaggggcgggtctggacccacattcaccctacggggagaaatagctgaggtcagaacccagggcagtcctctgtggcctccgggttgggaaggcagaaccagaatccaaaagtgacctgggcatcttgtgcccagccccccacctccatggagaccccaggagtctgggcttccatccccctcttctattagaacccagaaagtcaccaccctgttttctcaccttcccacggcccattgttgtttgtttgtttgcttgaagaccaagacggagttgggcctcttgattcccagtggctgcaagaactgggattccctctccttctctctcttcccctctcctcccaaggaagcacccagtgtgggtagggccccaccttggagcacccagcatgtccaggctggtcctgcgggtgcggggtgccttgtctcccttcccctctcttcatgtgctcggctcacactccttgtgtgtttgggctgtctccagctgcgaccccacccagggctgcacccttgggtctccaaggcaccgaatgaacagagggatgtctgtcggcagtcataggcgggcgtagtaaaagacagatgcccacagtccacatattgggaaactgaggcttttgtggaagaactccaggataggggtgtgtgtgtgtgtgtgtggtgggggttgggcacatgctttgtgttatatttaggacgcagaacccttctcttttggcctcaggcataaggctgaaagagatctgctaatttttttcgcgcgtgcgcgcgcgcgtatgtatgtatatgtgcgtgtgtgtgtgtgtggcaaggggacagagagaagagtgcagccgcctgagccatttgaagagatcctgttgcgtagaatccaggttccctacgaaactacgaaaattcactcagatttgctgtcctagcccagcgcagtcgctcacgcctgtagttccagcactttgagaggccgaggcaggtggatcgcttgagctgaggagttcgagaccagtctgggcaacatggcaagacccgccgccctctcaccccatgtctccacaaaaaatacaaaaattagccgaatgtggtggcgcgtgcgtgtaatcccagctacttaggaggctgaagtgggaggatcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgccccctcccactctccctgcccctcggaccccatactctacctcatccttctggccaggcgaagcccacgacgttgacatgccggagatccgcctccgccatgtcgtgtcctgcagcagccaggactcggtgagggacctgcatgggggaggttggaagacgtgagggaattaatgaggatagctcttaaaagagcttttggggttctcttggaagtctaaggagagtcatggggggatttccaggaggctaaaagtgaattgtggagagatgttgaattagggacgttccggcgtctagggaacttccggagagaaaaggaggaatagggaagctttcttggagagcccataggtgaacttccacgggaaagtgttgtaggggaaactccaggcagagtgtcgggggattaacgggagagcttaaatctgggggtcgtagaggccttgggaggactcaaaggaatcatctgagagctggaggcctagctgtcatctctgtgccctaattctcctctcccactgttgtttccagactcactgtgcagaaaatcttctcaaggcagacacttaccgaaaatggcgggcagccaaggcaggcgagaagaccatctctgtggtcctacaggtgatcctgccaccccacctcctcctcactaggagtctggagtccggggttccagattctgctcctgagccaactggcagtgggtttagtcactttctttgctgggcctcagcttccttactcggaaaatgggcagcataatccctgtgcccctcagcagagaggaaaggagacccaaggattaagtccaggatgaccacaggaatcagtgtgtggtcctgggcaggtggcatctactttctgggttccagtttcctcagctggaacaaaatgaatcattgccacgtactctgcctcctgcagccagtgggctcagggctggaaggtgtccaggaaggtcgtctaagccaatcaactccactttaaagaaggggaaactggccggatgccgtggctcatgcctgtaaacccagcactttcagagcctgagatgggaggattgcttgagctcaggagttccagaccagcctgggcaacatatcaagaccctgtctctatttttattaaaataaataattttttttaaagaataatagccaggtatggtggttcacacctgtaatcccatcactttgggaggccgaagctggagtcttgcatgagcccaggagtttgagaccagcctgggcaatacagtaagatgtcatctctaccaaaattttatagattagctgagtatggtggtgtgcacctgcaatcccagctactggcgagtctgaggtgagagaattgcttgagcccaggagatggaggctgcagtgagctgagattgtgccactgcactccagcctgggcaccagagtgagacccccaaaatataaaaaataaaataataataatgagagctggcattattcaacgttacctgtcagtcgctgctctacacacctcactcacatggattagctcattgagtcctcataaaaaaccccaagaggcaggctctgttatccccacttttacagatgaggaaactgaggcccaaagaagttatacaatttgcctgacagtcaatcttttatttatctgttgagacagagtctcactctgttcccaggctgtagtgcagtggcatgatcttggcttggctcactgcagcctctacctcctgggctcaagcgatcctcccacctcagcctcctgagtagctgggactgcaggtgtgcaccaccatgcctggctagttttttttgtatttttttagagatggggtttccaccatgttgccaggctggtctcaaactcctgggctcaagcgttcctcctgcttcagcctcccaaagtgctcggatgacaggcatgaaccattgttcctggcctgggggctgctttatgactataaggagcagaacactctgtggatagtgctagggtgacggaaaaattaaccttttgtgaatgggcagtcattcagcaaatatccactcctctccctcccactggagggggagtatatttccctgctccattgatgagtttgaccatatgatttacttaatggaatttcagcacatctaacttcagcaagggccttaaatgcacttggcttttgtgctcccataatatgccatgagaacatttgccaggttactgctaatcccagaaaactgtggaatctcatggaagagacctgaatcctcccaaactgcagccaaagcagccatcccacaaactcttataagaatgcttgttggtataagtctcagttttcatgttgggaggtcgaggtgggtgaatcgcttgaacccaggagtttgagaccagcctgggtaacatggggaaaccctatctctacgaaaaaatataaaaaatagctgggcttggtggcgtatgcctgtagtcccagctaccagggaggctgagcggggaggattgattgagcccataaggttgaagctgcagtgaactgtgatggtttcactgcactccggcctgtgagacagagtgagactgtatctcaaaaaaaaaaaaaaaaaaaaaaagaaaagatctcagttttaggatgatttgttacacagcattattacagtgtaagttaatacaacttggttgttttaaaccactgagattagggactcctttgttactgtaacatcatctggtccaccccaattgatgtcagtgtttagtgcctgtcaactaatggcctccacttcccaggttcaaatgattctcatgcctcagccttctgagtagttggaatttacatgcctggctaatttttgtatttataatagagaccgagttttgccatgttggctaggctggtcttgaactcctgacctcaggagttcaaggcaaatgagcaccaaatgctaatttaagtgatccacccaccttggcctcccaaaatgttgggattacaggcatgagccactgcacctgacctcagtcttttaaactgtgatagatacagattgctgacagttttagtcttgagatctagattcaagcccccagctcttcctcttaatcggtgacctcaagaaaattgtttcatttctctaacctgttttctcatgtgtccattgggaataatgacatccaagcccggagttgtgaaaattcggtgacataatgtctgcacaagtgctctgtcaacatgtaggtgtttgtgtagagggagggatttgtgtttttattacttagtgggtgatgattccactgggctctcttatgatcaagtgactccagggaaatcacatttcattctgttaccccagttgctgtggaaacagagtgactggaggcagaagagacagaacctgtctctggcctgggagagactgagggagtattgcagcggtcaccaacatggtaaaccccagagggagcagcttggggaggtgatgtgtttcagttgggatgtccaggtttgatgtgactttgggacattctaggggtggcatccaggaggcagttggggatcacatgtggagctgaagacagaatgtggggaagttgtcagtgcagagaaagaacctatagactcgggagtagatgatggatttatttgttcattcactcatttatttagtcaagtatttattaagtgccttctgtaggccaagcactgttttaatacagcagtacacagcagaagacaaaaaatattcactctcagtggggtgcagtaagctcacgcctataatcccagcactttgggaggccaaggcctggcagttcgagaccagcttgggcaacacagggaaacttcatctctactaaaaatacaaaaatctgccaagcgtggtggcctatgcctgtggtcccagctactccagaggctgaggcgggaggatcacttgagcctggaagatcaaggctgtagtgagctatgatcgcaccattgcgctccagcctgggcaacagaatgagatgctgtctcttaaaaacaaaagaaattcagtcttgtggagctttcacgttagtagggaaagactgacaaatgagtcagtgaaacatatgttggatgatgagtgctatggaggaacttaatgaaggggaatgagagtgccccagctggagctggagcagtggcaaggatttttatttaaatagtagggtccgggaaggcctccctgaaaaggggacatttgagcaacatgagctatgtatgtatctagggaaaagactctgaagctggcttgtgacagcaaggaggccagtatggctggggtggagtcagccagggggagagaggtaggagatgaggtaacagggtgggactgggaacccctaaaaaaccacttaaggcctggaaagccattgaaaggacttgagcttttactccaggtgtgagataggagccaccggagggctccgagcagaggagggacaggatctgccttaggccttcacaggatcctgctggctccatgttgacaatcaactgcaggggccacacacaggagtgggagatcagcattgcagcagttgttttgttaacttactccacgtcagagaccctttggaatgactgattgcatctggcaatgactaatttgtggggttactctggattcatcaaatgctaattttgattcttttgacgtaactgataaggcagacatttctggccaccaaggcagtaggcttatctctgggttgttatgttatgttttgagacagggtctcactctcttgcccaggttggagtgcagttgcaaagtcatggctcactgtagcctcaacctcctgggctcaggcaatcctcccacctcagcctcccagatagctgggactacaggcgtgtgccgccaggcccagctaattttaaaaatttttcgtagagatggggtctcactatgttgcccagcctggtctcggactcctgagctcaagcagtcctcctgtcttggcctcccaaagtgctggcattacaggcatgagccactgcacctggccacatctgtgggttcttctactaccctgcattttctcctctaattattgttatgcaacatctcgatcttaccacatggggcttagccatctgcttatgacagccccacacacctggttgtttgcagtagccacagcaggctctgttgtctgttcatcacctgctcccagagggaaatgccaacctctttgctaactactcctgggctggaggggtggcttggacaagacccagatataactctggtgtgtcactggaggtgtgtcatttttagaagaaatgttcatcagcaatagggcctatggtcatttttgattgttattggttttctaatcactcagttcgccactgtggtgtcttaaatttgtttttactgttttttgatgtgtaacatacatagagtgaagtgaaggtgtaagtaagagtacagctcagtgactctttgcaaactgcagccctgtgtactccacacccagatgcagcacagaacatgcctagcccccagcagttccctcaggttctttctgtcagtacccctgcaagggtaaccactgtcctgattgttaacagcatagattcattttgcctgattttgaattgcatataaaatggaatcgtgtggtataaacttttcttatctggcttcccttgttatgtttgttcatttcatctatgtcgttcagtgtagctgtagatgatttattgtgattttttttttttctgagacggagtttcgtcttgttgttctggctggagtgcaatggcacaatctcagctcactgcaacctccgcctcccaggttcaagtggttctcttgcctcagcctcccaagtagctgggattacaggcatgcaccaccacgcctggctaattttttgtatttagtagagacaggttttcaccatgttggtcaggctggtctcgaactcctgacctctagtgatccacctgccttggcctcccaaagtgctgggattacaggcatgagccactgtgctcgactcctattgtctttttttttttttttttgagacagggtctcactatgttgcccaggctggagtgcagtggcaccatctcagctcactacaggctcgacctcccgggctcaagcgatcctcccacctcagcctcctcagtagttgggactacaggcatgtgccagttcaccagtctaatttttgtattttttttgcagagatgggggtctcactgtgttgtctaggctggtcttgaactcctggactcaagcattcctcctgcctcagcttcttaaatccttgggattacagacatgagccactgcacctggcctattgtcatttctgtatagtattctgttgtattgagataactattatggttttatttatttatatttgatttttttttttaaacggagtctcactatgttgccaaggctggtcttgaactgttgatctcaggtgatcccccaacttggcctcctgagtagctaggactataggtgcacaccaccacacccaactaatttttttttttttttttaagctttttggaggcagcttcctgagtagctgggattacagggattacagacagagccacaaagacctggccattggggttttattatatttgctttctgaatgggtattatatgcatatagtgcaaaattcaaaaggtgcaaaagggtatacactaaaaagaaaatctcccctcaccctttccatccctccctgctccctccccaactcctgctccctccccaactcctgctccctcattcttctctcctgatgcaaccaccattagcagtttttttgggtggtcttcctgggtcattctgtacacatacaagcatatatacctaccgcctccatccctttttaaaaaattcatagtatatacactgttcccttgtgtgttttttttcaagtaacagtgtattttggagatgcacactgcatgaagttctaccttatttatttatttatttatttacttacttacttacttacttactttgagacagaatctcgctctgtcactcaggctggagtgtagtagtgcgatcgtggctcactgcaacctccccctcccagcttcaagtgattctcctgcctcaatctccctagtagctgggattacgggcacatgccaccaggcttggctaatttttgtatttttggtagagatggggtttccccatgttagccaggctggtcttgaattcctgacctcaagtgatcctcctgccttggcctcccaaagtgttgggattacaggcgtcagccacgccgtgcgcagcctaccttattcttttaaatgatgcatacaattgcatttcatggccgggcgcggtggctcacgcctgtaatcccagcactttgggaggctgaggcaggtggatcacgaggtcaggtgttcaagaccagcctggccaagatggtggaaccctgtctctactaaaaatataaaaattagccaggtgcagtggtgggcacctgtaatcccagctacctgggaggctgaggcaggagaattgtttgaacccgggaggcggaggttgcagagagccgagatcgtgccactgtactctagcctgggtgacagagcaagactctgtctcaaaaaaaaaaaaaaaagaaaagattgcatttcatggatgtgaaacagttttttagcaatatatctcaggaactttgccttcctgtgccatgtttgtttcaggaacagttcatatcagaactgtgtctccctgagaaagctgcatgcacacgaacccaggccatcggtgatagtcatcttgtgctcttatcctcacagctgatacatactgagcactcatctcttattttgagaaaaattcacataaaatttactgttttaaccatttaaagtgcacatttcagccagatgcggtagctcacacctgtaatcccagcactttgggaggccaaggcgggtggattgcttgaggtcagggattcgagactaggctggccaacatggtgaaaccccatctctactgaaaatacaaaaattagccgggggtggtggtgcgtgcctgtagtcccagctattcgggaggctgaggcaagagaatcacttgaactggaaggcagagtttgcagtgagctgagattgcaccactgcactccagcctgggcaacagagtgagactccgtctcaacaaaaaacataaataaataaataaataaagtgcacatttcagggttttttttttttttttagcatattgacaatgttcttcaaccatctccattctctaattcagaatattttcatcactccaaaaagaaaccacataaccattaaacagtcacttcttattctctccccaatgttgcccttggcaaccactgatctactttctgcttctctggatttgcgtattctggacttataaatgtatacgtggtcttttacacttaaccttgttacactttgcataatgtttctgaggttcatccatgttgtagcatatatcacaacttcagttttttaaataactggatgatattccataaatatactgtacaatgtttatctattcatcaactgatggacatttattgggttgttaccatgtatatataaacctttttttttttttttttttgagattgagtcttgctctgttgcccaggctggaatgcagtggtgcaatctcggctcactgcaacctctgcttcccaggttcaagtgattctcgtgcctcagtctcctgagtagctgggactacaggcgcatgccaccatgcccaactaatttttctgtttttagtagagacggggtttcgccgtgttgcccaggttggtcttgaactcctgggctcaagaaatccacctgccttggcctcccaaagtgttgggattacaggcgtgagccaccaccccagcctccatgtataaacatttttatcagattcttaaaaagtatttatttacttttttttttttttttttttgagacagagtcttgctctgccacccaggctggaatgcagtggcatgatcttggctcactgcaacctccgcctcctgggttcaagcaattctctgcctcagcctcccgagtagctgggattacaggcgcctgccaccatgcctggttaatttttgtatttttactagagacggggtttcaccctcttggccagcctggtcttgaactctcctgaccttgtgatctgccaacctctgcctcccgaagtgctaggattacaggcctgagccaccgtgcctggccacttttttttttttttagatggagtctcactctgtcacccaggctggagtgcagtggcatgatttcggttcgctgcaacttctgcctcccaggttcaagtgattctctggcctcagcctcctgtgtagctgggattacaggtgcacgccaccaagtctggctaatttttatatttttagtagagacagggtttcaccatattggtcatgctggtcttgaactcctggcctcaagtgatctgcctgccttggcctcccaaagtgctgagattacaggtgtgagccactgtgcccagcctgttgttttctctcttgagacagagtctcactttatcacccaggctggggtgtagtggctcgtctcaactcactgcaacctccacctcccaggttcaagtaattcttgtgccttagcctcctgagtagctgggattattgaggtgcgtgtcaccacacccagctaactttttttatttttggtagagacagggttttgctatgttggccaggctggtctcgaactcctggcctcaagtgattctcccgcctccacctcccacggtgctgggattacaggcgtgagccagtgctcctagccaggactttttttatatacaaagaagaaatgtcagggagtgcctgtttaaagtagaaatagttatttatgcagtaggaattgttcatttaaaatacaagcatctccatcctaccacatttaggagctatgctgaatattgtgggagaggtaaagatgttgagtttgactcagggatggaaagaaaggagttgagaacagtggtggtattggacagtgctttgcagtcaggcagttgcgtccgaagtactctgctagttattagcttgtgtgccatgtaagctattgattaaacctgtctgagcctcagtttccccatctgtgaaactggagtcgtaacagacccttctatttaaagtggttttgaggcttcagtgatgcccggcccatgcttagccaagtgtggtggacagaacagtggtgctcaaaagatgttcatgtcctcatccccagaacctggaaatattttaatggccaaaggagctctgtgggtttgattaaattaaggatcttgagatggggagagtgccctggattatctggtgggcctcacgtaacccccagaggccttataagggaaagagggaggcaagagagctggaaccagagctgtgaagatgcaagcagagcctggagtgatgccagcgctttcagcagctttgaagacgaggaagggactgtgagccaaggaaggcaggtggcctcgagaagccgaagatgcaaggagacacgttctcctctagtgctcccggaaggaaggaatgcagccctgccgcatctagattttagccctgtaaggccgagtttcagacttttgacctccagatctgtaagatattaaatttgtgtgttttttttttgtttttttgagacggagtttcgctcttcttgcccaggctggagtgcagtggtgtgatctcggctcactgcaacctccgcccccccggtttaagcaattctcctgcctcagcctcctgagtagctgggattacaggcatgcgccaccacgcctggctaattttgtatttttagtagagacggagtttctgcattttggtcaggctggtctcgaactccctacctcaggtgatccgcctgcctcagtctcccaaagttctgggattacaggcgtgagccactgcgcctggccaaatttgtgtttttagccacaaagtttgtgctaatttgtacaacagtaacaggaaactcatacaccaagcacctggcacatggtgagaatccgaaaatgttagccatgatgatcctcttgtgacagatgggacacccaggcaagcagcagagaaggggctcaacagggccacttggtaagggaggacagagccagagttactgcttaataactcttgagtagtaacttctgcaaacggttgctgggcgcctgttctgtgtctgtctgtacatccattgggaatgcagtagaggcctgctgtgttaatgatattcgcagctgacatttatgtagtgtttgctcggtgccaggcagtattccaggcacttggtatgttatttctcattcttggtatggatttgaatgttctcaacaactttatgagatagacgttgttattgtccccatttcataggttcgaaaactaaggcacaaggggtgaaatgaaaccatttgctccaggatcacacagcaggaaatcagcagagctgggaaggaccagacactgttcttggccttggggacacagtagggaacaactcagacgatactgtccttgctcttgtggagcttaaaagtctggcgggagagacagatgctagacaaatacaaacaaaaaagatgtaactgtgtaacaccaggcagtaatcatgaagaaaagtaaagtcgggtagggagatagagagtggcaccaggtagggggcgaggtaggttacttatggtctgaagtgacatctgagtgggcacctgaagcacagaaggcaaacttttacccagctatggatatgtttgagggaagagtggtctaggcagggggattggcaggtgcagaggccctgaggtgggaaggagccagactgttcttggcacagaagggaggccgttgtggctggtggaaagtcaccaagcctggcctggggagcagtcagactgggacttcttgttgttgttgtttttgttgttgttgttgtttttgagacagagtctcactccatcgcccaagctggagtgcagtggcacaatctcggctcactgcaacctctgcctcccgggttcaagtgattctcctgcctcagcctccccagtatctgggattacaggcgctcaccaccatgcccggctaattttaattttcatatttttagtagagacagggtttcaccatgttggccaggctagtctcaaactcctgacctcaagcgattcacctgtctcagcctcccaaagtgctggtattacgggtgtgagccaccacacctggcccagactgggacatctcatgagcccaggcagcactgtacactgcccagggcccagggctgggaatggcggtggaggcaggggagtcagcaggaggtctgccggcctcagccttaggcaggcccttcctccagcaccatcttcctcctctagcacgtcagtggtgtgatggaggagcacgcgtggactgttgccagcctgcctgggttccggtccggctttgccacccaccagctgtgaagttacataaccacttcctgcctccgtttgctcatgtgtaagatggagataattatagcaactgcctggcagagccattgcaggagagtagatacatgtattattagcaggagtctggcacaccaggagcgctcagtgcactcggatgttggccgcagttgtggttatagttgttaattctgtgtcatctcaacttccttcagagggagggtaagtttttttttgaagacaaggtctcatcactctgtcgcccagagtacagtgatgcgaacatgactcactgcagccttgacctccccaggctcacgcgatcctccttcctcagcctcctgagtagctgggaccacaggtatgtgccaccatgccttgctaatttttgtaatttttgtagagacaaggtctggctatgttgcccaggctggtcttgaactcccagcctcaagtgatcctcccaccccagcctcccaaagtgctggttatagagacgtgagccactgcgcctggccaaggagggagggttgttatgaccatcttccctttttgcatgtgaggaaactgcctcacagagacgttgaatacgtcacccaaggttgtgcaggttggaaatggcattgctgtatttgagcccaggcctacctcaccccaagtccaggctccctccttccatacagtggtgttcctgttgatagcagtgtgcaggtgatgtctagatgatctgacagggaggcaacagagcagattggagcatctgtcatcaccaggggtgggagagggcagtgtagggtggactaggtaccttggttttttttttttttttttttgtgacagagtctcgctctgtcacccaggctggagtgcagtggcatgatctctgcttactgaaacctctgcctcctaggttcaagagattcttgtgcctcagcctcttgaagagctgggactacaggcatgtgtcaccatgcccggctatattttatatttttagtagagaaggggttttgccatgttggccaggctggcctcaagtggtccactgccttggcctcgcagagtgctggatttacaggcttgagccactgcacctggcccaggtacctttgagagttgtaataatgcgtcattctaggatcctaataaaagagccccaaactggaaggcaggacacttgcctcaacctaactgcctcccgtgcccgcatggcccgcacggctttctgcatcttcatctgtcagacaggaatggcagatcctttgagatgagccctcctataggtagctcttttcttctttcaacaaatagttgtctagcactgactaataatacctcctgactgacagcagataattgcctactcttcgccatgccctgtggccattatttatgtgcatgatcctagatatggtggtcattcccattttacagatgagaaaactgaggctccaaaaggttaactggtatggtcatacagctagtgtgcagcacagctgggattcaaacccaggaaccagcggtgagcaagatcggacaaagcccctgccctcagggaggtttcctggagtcctctgcgattgtgggtgaggggtgacatgtgctgtttgtctgcatgatgatttgaataaagttataactctggcaagtgcttatcaaggagagctctatggcagtgtgtgataagctgacctggtggagtctggagaggtcagggaagcaggtatgtgtgaggtgggcgcgtatgcattcattcagtgactattttgtgagtttctgctccatgccataccctgtgctgcatggaggggacacatggcaccattcaaccctggtgtgccccctcacagaattgacattacagggacatggtgatccaaaggagattcatcctgaggtcccacagtgagcccagaggcagagcaggcactgacagtggcctctctctctgcccacagttggagaaggaggagcagatacacagtgtggacattgggaatgatggctcagctttcgtggaggtgctggtgggcagttcagctggaggcgctggggagcaagactatgaggtaagcagggctatgagatggatcccatactgacctctgcccctcatgctcgcatcaccgtctcccccaggggctggggctgggaagacatggggcagatgtgagtcacacctgattgctgccctctggaggatcacccagtgtacggaggagacagaaggcagacacagggcggtaaactgcacatcagggaagagagcaagtttggatcatggcttaaaatgacacaaatgtattattcgactgttctggaggtcagaagtctgaaatcactctcactgggctaaaatctaggtgtaggcagagccctgttccttctggaggctctaggggagaatccatttccttgcctatttcagcttctagagtccatctgccctcctcagcttgtgacccttccttcatcaaagccagcactcctgtcactctaacgcctgcttccacttccattgttacttctccaactctgactctcttgccttctttttttctttttctttttttttttttgagacggagtctcgctctgtcgcccaggctggagtgagtgcactggcgcgatctcagctccttgcaacctctgcctcccgggttcaagctattcttctgcctcagcctcccgagttgctgggactacaggtgcccaccaccacgcccggctaactttttttttttgtatttttagtagagacggggtttcaccatattggccaggctggtctcgaactcctgacctcgtcatctgcccgcctcagcctcccaaagtgctgggattacaggcgtgagccactgcgcctggccttctttttcttttgttcatttttttttgagacagggtttcatttccgttgcccaggctggagtacagtggcgtgttctcagctcactgcaacttctgcctctgaggttcaagtgattctcccacctcagcctcccaagtagccagggctacaggtgcacaccaccactcctggctagcttttgttattttttatagagagagggtttcactgtgttgcccaggctggtctcaaactcctgggctcaagtgatccacccaccccagcctcccaaagtgctaggattacaggcatgagccaccacacccagccctcctttcttataaagacccttatgatgacacttggcctacccggataatccaggggcatctcccccatttcaacatcttcaagttcatcacatctgcaaagtgccttctgccacatttccaggttcagggattaggatgtaaacatctttgaggagctgttattctgcctgtctcctatgttttcttctagaagctttctatttttagattttacatttagatctctgtttcatctcaagtgaatttttgtgtattgtgtgaagcaggggataaggtttattttttctgtatcttttttttttttttttttttttgagatggagtctcactctgttgcccaggctggagtgcagtggcgcgatctcggctcactgcaagctccacctcccgggttcacgccattctgcctcagcctccggagtagctgggactacaggcacgtgccaccatgcccggctaattttttgtatttttagtagagacagggtttcactgtgttagccaggatggtctcgatctcctgaccttgtgatctgcccaccttagcctcccaaagtgctgggattacaggtgtgagccaccgcacccggcccttttctgtatcttttttatatgtttgttgacaatgcttatttatttattttatttattttaagacagagtctcactctgttggccaggctggagtgcagtggcatgatcttggctcactgcaacctccgcttcccagactcaagggattctccagcctcagcctcctgagtagctgggactataggtgtgagccgccatacccggctaattttttaaaaaattttttgtagaaatggggtttcactacattgcctggctggtcttgaactcctgagcttaaagtgatcctcccaccttggcctcccaaagtattgggattacagacctgagccactgcacctggctgaaaatactttgaaaaaaaaaaaaagacttgccttttctcattgaatcattttgactccttgttgagaattaattaaccatatgtatgggtttatttctgtactctcttctctgttccattgatatgtatagttttctttatgccaataccaaactgtctctttttttaaccatattatttatttatgtatatatgtatttatttatttatttatttatttatttgagatgggggtctcactctgttgctcaggttggagtacagtggcatgatctcagctcactgcaacctctgcctcctgggctcaagtgatcctcccgcctcagccccccaagtagctagtgggagccaccatgcccggctaatttttaaatattttttgtagaaatagggtttcactgtgttgcccaggctggtcttgaactcctgaggtcaggtgatccacctgctgcggcctcccaaagtgctaggattacacatgtgagccgctgtgtgtacctggcctactcttttttttttgaaacgaggtctcactttgtcacccaggctggagtgcagtggcacgatctcagctcactgcagccttgtcctcccgggttcaagtgatcctccttccacagcccctcaagtagctgggactacaggcttgcaccaccatgcccaactttgcactagtcagtgtgacaaggtgagaaaaagaaaaaagaaaactatcttttttcacagatggcatgattgtctatgcagaaaatcccaagagatctagacaaactacaaggtttagtaagtgaaggtcacaagatgagaagtcaatatacaaaataaactgtatattacacatcacttctgtggtattctggccaaagtgtgcaacctaaattaatcacaaggaaacatcagatactttgtacaataagtgatatctgacaaaaatcactgacctctactcttcaaaaacatcaaaggcacaaacccaaagtcacaggagccttccttccttccattctccctcccctccttccctccctccttcctttttttttttttttttttttttttttgagatggaattttgctcctgttgcccaggctggagtgcagtggtgcaatctcggctcactgcaacctccgcctcccaggtacaaacgattctccatcttagcctcccaagtagctcggattacaggcctgtgccaccatgcatggctattttttttgtatttagtaggacagggttttcccatgttagtcaccagatgataaatgcagcttccctgtcagctccaaatcaggccttttataaacaagtatagtcaaggtcaggaagaaaacttcccttctgtataattgtctttcttgtttcctttgcataatcagctgtgcacaaagagagctatagttatgttctgtttttctcagcaaaaggctttattgtccaattttataatttcacagcatgtcagttagaaaagagactaagtcagtaacaaaatatacccaaccaaaagtggctgcattcatctttttttttttttttttttttttgagacggagtctcgctctattgccaggctggagtgcagtggcgcaatcttggctcactgcaacctccgcctcctgggttcaagtgattctcctgcctcagcctcccgagtagctgggactacaggcacgcgccaccatgcccagctaatttttttgtatttttagtagagatggggtttcactatgttggccaggatggtctcgatctcctgacctcgtgatttgcctgctttggcctcccaaagtgctgggattacaggtgtgagccactgtgcccagtctttttgtttcgttttttgttttttggcagagtcttgctccgtcacccaggctggaatgcagtggcacaatctcggctcaccatcacctccaactcctgggttcaagcgattcttgtgcctcagcctctcgagtagctgggattataggtgcctaccaccatgtccagctaatttttgtatttttagtaaagacggtgtttcaccatgttggctaggctggtcttgaactcctggcctcttgtccaccaggcttaagtgcaatggtgcgatctcagctcactgcaacctccgcctcctgggttcaagcaattctcgtgcctcagcctcccgagtagctgggacaacaggcgtctgccaccatgcccggcttaaattttgtatttttagtagagatggggttttaccatgttggccaggctggtattgaactcctaacctcaaatgatccgcctgccttggcctcccaaagtgctgggattacaggcgtgagccaccgcgcctggcctcagcttgggtttttcaatgcagattgctaacatgaattgctactctcaattccttgagagaacagacttgtgaggagttctcccgagaagaattttcacctcttctttggtgtccccccaagctaaggccaagacagacaggcctcccagggactctttccacaggcttatttccccttcatgtaactagtgtgggcgttgcctttggggagtcctcagttctatgcagtgtggtgaggatctctgagatgccactctcccttgcttggagcctaggttttctctcttgttctctttcaccaccacgtgcataacccttaaagatcaagttctagctgggtgtggtggcttacacttgtacttctatagctttgggaggctgaggtgagaggatcatttgaggccaggagttcaggaccagcctgggcaacatagcaagaccatgcctctacaaaaaataaaaaattagccaggtgtggtgtcgtgcatctctagacccagctactcagaggccaaggtgggagaatcacttgagacccagaggtcgaggctgcagtgagctatgatcgcaccactgtgctccagcctgggtgacagagaaagaccctgtctcttaaaaaaataataataataaataaaatcaagttatttgctatctgggatcagcaccacgacaaactaccaacatgagtgctgccgggtcagtcagggtccttgcccggagattaaaaccacaccagttattttaacagataatttgatagaaagaaccagtaactaggtgttactagaagactaagatatgagggagaagcaaccgcagggagtagctaccactcccagggttgggggaacaaaagaaaggagcaggaattattgaaacgtagatgtttggaaactgggaggtggggctccaggagctgaaattcagatcgtttgaggagggcttcctcccccaccggctgctgagaggggctgaatgaggctgtttctggaggtattgggacactgcaaactggattcatctgctgctgcaggcaggaaccactgcagcagcagaagcttaactgggggtgatgctcacaggatctgcaatgcacgagaagctggtccttcctccctcctgcagccttgcaaactctctctcttgccccccctattggcagagcctggtcacgatcagctagggaagcagaaaggtggtttgccaagtgcgggcccagatcacagagatgagttgtagagggtaggtttgagctgagaaacaatcacttaatacttagtgcagctcgcctgactctctggattctgttttctcatttccagcctctagtaattccccttgcctttccgctgactcacctgtgcatttccaaaaggtgtttgaatattgtgccagtttactgaatattctctgccgggaaagttccttaggacatgtagcccgctgtattgccagatatggaagactccatgggagaatttagataagggtcgctcacatctggaggataaagagatccctctggggcctgtgtcagggcaggactgactcaaggcctagaaacaaagggtctggagacatctaggcccaagctacattctagtgactcccagtcccctgtgtgggccctgtgccctcttccccagcccctagaagctctcatctaagccaacctgccctggttctcatgcactgtggcttctcccacccaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggtacctagggtgggagccagggtgcagagtccttggtcctgggcaaggagggaaataagggccaatattgagtcccatagggctgggaggagtagacagctggtgtcccatgggattatggggaggctgggtccctgcgttccctgaaatgggtttgggatctttcctgtaatgagaagtttcatctcccggagggaatctaggaagggtgaactgcagcatctcagaggggaatcggaggaggggaactgacttgttagagaggtggcctagtagagtgggcctagtagttaacatcaggagatctggcgtctgattactgagttcacgtcctggctataccactttttagctgtgtgatcttgggcaagtgacttacgctctctgggcctccattgcctgatccttacagggttgctgtaggttaagggatgctaaaagctgtggtaacagtgagactggagtatgtgatgatgccacacactaaaggtgtgcttcttgcccaggtaactgtcctggggagtgtttagcctgtcagctggcttctccttatgaggtcgtgcagggacccagacttctcctattttctggctctgcatccagctggcagaggagagagcctggaacacttctgtgttctggaagtggcacgcagcactccctcccattccacaggcaggagtttgtgcatagggcagtgaattcgctgggacacctagtagactctgccaattgcccaaagagctaatgcgtgaaaagggcttggagccagactcagagttagggctcagtcataacagcttaatcctataattgtcatcaccatcgccagggcccctccttcaacatgggtgttcatgagagggaaggagccaggaagaggtttccctgagtgaaaagggtcttgggccctggcctctgtccttgggccagactccctgactcccacccctcctttcccaggactccccctttggcttgagttttgtacggtttcatagccccccagacaaagatgaggcagaggccccgtcccaggtaagctgtacctgtcactccccatggccttctccctgcctctccacccccacctgccagcagcccacctataatactgaccttgcgggaccttagaaggtgacagtgaccaagcttggccagttccgtgtgaaggaggaggatgagagcgccaactctctgaggccgggggctctcttcttcagccggatcaacaagacatccccaggtgagctcggacaacgtgggtcctgagtgagtagggttgagacctagactcgtgggtctgagggtagagggggctggggctcagattcctgggtctgagggaggagggtagtggagtcctggactcctgggtctcagggtggaggaaggtgggcctggcctcttgtgtcctgagggttgagaggtctggaggctgggactcctggatcactggtgggttttggcaacaatattctgtgtcccatagataggagtgaaagggtcttggggctcagccctctcatcctggatccactttctcccttcatagtcacagccagcgacccggcaggacctagctatgcagctgctaccctccaggcttctagtgctgcctcctcagcctctccagtctccagggccataggcagcacctccaaggtgaaatcatcagactttggtggggtggaggaggagagaagctggaggcctcaatccatccccatcccctcagccccaggagtctcccaaagggaagaggaagttggatttgaaccaagaagaaaagaagacccccagcaaaccaccagcccagctgtcgccatctgttcccaagagacctaaatgtgagctaactagatcccttgtttccacaggggcctgtgctcctgtgtcctaggggaagcggggctggagcctgctgtcctgaatctgagggaggaagggctgggggcctggacccctgggtctgagggaggaggggctgggggcctggattcctgaatccgagggaggaggggctgagggcctaaacccctgggtctgagggaggaggggctgggagcctggacccctgggtctgagagaggaggggttgggggcctggatccctgggtctgagggaggaggggctgggggcctggactcctgggcctgagggaggaggggctgggggcctggactcctgggtctgagggaggaggggctgggggcctggacccctgggtctgaggggggaggggctggggcctggattgctgggtctgagggaggagggtctggggcctggactgctgggtctgagggaggaggggctgggggttgacccccagtggtgctaacctaatctactctttgtcttctccagtgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatgtaggcttgcgcccccctccctgcgccgctgcagtttctcccccagctccctgtgtctcctccaccttgtgctttctctgtgtccactatgctgcatgctttctctctctctcactcgctttctttctcactgcattctgtagcctttgtcttctctctgatttttgcatctctcccttggtctccaacctctttttgtttctcccacctcaatctcatgatctgtctgtctgtctgtctctctctctctctgtctgtctcccctgtctcattcccctttgcccctcagatcacacctaactggcatcttcacttctgccccccaccagctgtgcctttgccaacacccccaagtacagccaggtcctaggcctgggaggccgcatcgtgcgtaaggagtgggtgctggactgtcaccgcatgcgtcggcggctgccctcccggaggtaaggcctcacacgccaaccctgctccttatcctgtgctgggcaatgccaggaatctggaggggagtcagactggggcctgccagcggagaacacaggtggtcccagcccagagccagcagactactgagaggagcggggcaggggctggggtactccagatgagggaaggaggacctgcctgggaggtcacagagggctctgtgaagcctgcttatcagaaaaggctggaggagcagtttgtgcaaaaactcaggggtgggagaacaagtgttagggtccatattcattcattcaaagtgagtcccggtgcagtggctcacgcctgtaatcccagcactctgggaggctgaggcaggtggatcacttgaggtcagaagttcgagaccagcctggccaacatggtgaaaccccatctctactaaaaacacaaaaattagctgggcttggtggcgcacgcctgtaatcccagttactcggaaggctgaggcaggagaatcgcttgaacctggaagccaaaatcgtgccactgcactctggcctgggtgacagagcgagactcccatctcaacaagaaaaaaaaaacccaaaaaccaaaatgagtcccagaagcccctgcttggtgccaggctggaatgtgcaaggctgaggatccagtcattgagccctgcccttgaaggcttctcactttgatgagggatcagaattgttgtaacagtgcagtggaagccccacagggtggcccgcagagagcgaggggtcttcaaggtccaagagaggtttttcaggctgaacagaggcagagaacatgctgggcagaggagacaaggtcaggtcagcctgttgtctgcctggagttgtaggtgaggctgagcttacacaggggcaagaagtggcaggaaaaatgggactggggcattaggaaccacagaaggctttggactgagcaaaggctagctcatatctgaggtccatgaattggaggggagactggattgtactccatggcctgagtgtgttcagaagttagttgtacctggtgtatttgagaaattatttgccttgggggatagcgaggctgtgaggtgggtgggctcaggtcagaaggggcttccggagcccaggctacacactgggctccatgcagcttcacagaaccctcatctgttattcaggaatccaaacatctctagaagctgaaagttcttttctaggttcagcacaaactcatttcgctgcagtcatcctgaactaatgtgaggctatttgcggacttttttttttttatccccttaagtgtgtcatggtcttaactgcagaaatattagtgggtttgatcatggggtgctcccccaggccctcctgggagtttatgtaacaatctgtatgccagccatttgcctctctaaaacctgaaagattcaaaattctgaagcccatccagctccagaggcctcctcttgtgagcagaggggagtcacagaaggtttgatgggggcaggggcaggctctgttgggagggatgaagtgtcaaggggaggctgcaggtggggactcctgagtaggctggggcctcaggaacagaagaggggatgggctggtgctatatctggggcagaaggaaccagatttgggttattatctgcctgggagagcttaaggagggcatgaaagaaagggaaaaagacaaacagtgttggatttgcaactggtcttaacaaaaagaattcacaaagcattttatatttttaaaaattctggcttgtactcatttataaactaaaaaaaaataactatatgatgcaggcaacgtggtgagaccccatccctacaaaacatgaaaaaaattatccaggtgtggtggcacatacctgtagtcgtagatacttgggaggctgaggtggtaggatcacttgagcccaggaggttcaggctgcaatgagccatgattgcaccgctgcactccagtctaggtggcaaatcaagaccttatctcaaaaataaaaatttggctgagtgcagtggctcacgcctgtaatcccagcactttgggaggccaaggtgggcagatcacgtgacatcaggagtttgagaccagcctggccaacatggtaaaaccccatctgtaccaaaaaatacaaaaattagctgggcatggtggcgcacacctgtagccccagctactctagaggctgaggcaggagaatcccttgaacctgggaggaaggggttgaagtgagtcgagatcatgccactgcactccagcctggggacagagcgagactctgtctcaaaaaataaaaataaaataaaaattcaactatagaaggaagaccccaagaggatgactctccatacctaataagcacaaatttagttttttttttaatctttgaatagagcactttgaagaaaaagttaagtaaacctgctattgactgttaatgaactactacattttaaatcctctgaatctcctgtaggcaccgttttatgagtgtgacttacctaaacagcatttcaccagcttgaaaacaaccaaattaaatgcagaagggtcttaacatgtatgtctcagaaaaatggagctaatacattcatttgtgtctgcataccttccctgtggcttagggcagattaaataatctctctgtgccttagtctcctcacctgtaaaatggggccaaaaataggacctaccccaggattcagtgactcagtatttgtcacgtgctacctggcatgtaggaagtcccatgtaagtgtcaacctgctactgttgtgtttttttttttttttttttttttttgatcattcttgggtgtttctcacagagggggatttggcagggtcataggacaatagtgaagggaaggtcagcagataaacaagtgaacaaaggtctctggctttcctaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaaccctgagtggacacaacacatgtttcagagagcacagggttgagggtaaggtcgtagattaacagcatcccaaggcagaagagtttttcttagtacagaacaaaatgaagtctcccatgtctacttctttctacacagacacagcaacaatctgatttctctatcttttccccacctttcccccttttctattccacaaaaccgccatcgtcatcatggcccgttctcaatgagctgttgggtacacctcccagacggggtggtggccaggcagaggggctcctcacttcccagaaggggcggccgggcagaggcgccccccacctccctcccggacgggaacctgctgctgttgttagagctaggaaaatccttttcctggaatgttagtggcttaaggaaccatgattatagtgttgtagtctttaaaatgtgtttgctttgagattttccccttaaatggtgggtattttcctaatgagaaactgcctttgattcttaaaggagaaagttctgatttttcattcctttctgaattgagacatttcttccccaagagggaggggaattctgggtactgtggttcatgcctgtaatcccagcactttgggaggctgaggtgggtggatcactcgaggtcaggagttcgagaccatcctggccaacgtgatgaaacctcgtatgtacttaaaaaacaaaacaacacaaaaaacacaaaattagccaggcgtggtggcacatgcctgtaatcgcagttactggggaggctgaggcaggagactcgctcgaaccctgggaggtggaggttgcagtgagccaagatcacgccactgcactctatcctgggtgacagagtgagatcttgtctaaaaaaaaaaaaagcggccaggagtggtggctaacgcctgtaattccagcactttcagaggctgacgggggcagagcatgaggtcaggagatcgagaccatcctggccaacatggtgaaaccgtgtctctactaaaatacaaaaagttggcggggcatggtggtgtgcacctgtaatcccagctactagggaggctgaggcaggggagtcgctcgaacctggaggcagagattgcagtgagccgagatgaggccactgcactccagcctggcgatggaatggactctgtctcaaaaaaaaaagagggaggggaagaaagggggtacccaggtctgcagggcaggtggccagactgactgggttcactggggccttcctgagctgggagagaatgggctgggaacaagaccatgaggcccactagagtgagtattttagtaaatgccaatggctgttgcctcctgaacgccctccccacttcccttgggcctgtttgtctgaggcccgatttgtcccctaggtacctcatggcagggccaggttccagcagtgaggaggatgaggcctctcacagcggtggcagcggagatgaagcccccaagcttcctcagaaggtctgatgccccctgtccagtgggggagggtgtagtgggaggatgacatgagtccgctgtggcaccccaaacttcccactcttgcctcttgcaggtacccccccaacacacccacactgttcctgccctcctcacccacccactctccctccttagcaaccccagaccaaaaccaagcccactcaggcagctggacccagctcaccccagaagcccccaacccctgaagagaccaaagcagcctcaccagtgctccaggaagatatagacattgagggggtacagtcaggtcagactctgagggaggaggggctggggcctgggctcctgagtctgagggaggagggcctgcggcctgggctcctgagtctgagggaggaggggctggggcctggactcctgagtctgagggaagagagcctggggacctggactcctgggtctgagggatgaggggctgggggcctggactcctgggtctgagggaggaggggctgggggcctgggcttctgggtctgagggaggaggggctgggggctggactcctgtgtctgagggaggaagggctgagtcctggactcctgggtctgagggaggaggggctggggcctggactcctggatcagagggaggaggggctgggggcccagacgactggatctggagggcagttgaggctgggggcatgagatgcctgggtctgtgccatactgggagagctgccagtcttcccaggagacaaggcagccttgcattgactgagcttctacttgcagaaggacaggacaatggggcggaagattctggggacacagaggatgagctgaggaggtagggctagggctgggggttggggtgtccctggccttgggtgtaggggaggctgctctgcatgctcactctctactcctcttggcacccccagggtggcagagcagaaggaacacagactgccccctggccaggaggagaatggggaagacccgtatgcaggctccacggatgagaacacggacagtgaggaacaccaggagcctcctgatctgccagtccctgagctcccaggtgggaaatccccccatccctcctgaagtggcattttctcttctcagttctcagctgggacttgccctggccagccctggggtcactgctgcccccgtgtcttgcctcccctctccttcctcaacccactccctgcctcagcaccttcaggttctgccaggcttgttcctttcctttcagcatcctctctgtgacttgcctttttctcccctccagatttcttgttctgaccactcccctcgcagccatgtgccaggtgtgacctcctttttttcacgtcaggggtgagggccccaccctcatgctagtgcttcacttgctcaggtgccgttctgttggtctggggtgaagccgggcacaccaggtgacaggggcactgctctctgtcaggccctgggtgggtgcacaccagtgtctgctttaacatcagccatcactctggacgtggatgctgtctgcacacattgtgtgtttgcatttccagtgtaaaagaataagaacaaaaggaaatggggaaactctgcagggagttgtgggatgaggggcagggaggcagagcttcttcgagaatgaagggagcagaggaaagacagtcacgggctgtgcagaggtgtggttctggggcttccagaagagccgtttccacccagttcctcgtgggtgatgggcaggaagatgctttgattctcccaagcccctaaagtggcatcagcaaattgatggcctagagagtcaccttaaaatggaaagaaggagccaccccaaaggtcagaacaagaaaggcactggttggaaaggagagcaaaggtgaagaagtggcagatactgacgttttcagcctggactaagctcattaagtggctccaggcaggccaggcgtggtggctcaccctgtactttgagaggccgaggtgggaggactgcttgagtccaagagttcaagaccagcctgggcaacatagtgagaccccccccaacccccgcctttacaaaacattttaaaaattagccgagcgtggtggtgtgctactcagtagtcctggctactcaggaggctgaggtgggaggattgcttgagcccaagagtttgagaccagcctgagcaacatgtcaataccccgtctctctacaaaaagtttaaaaattagtctggcttggtggcatgcacctgtagtcccagctactggggaggctgagatgggagaatcacttgagcccaggaggcagaggttgcagtgaggcaagatcacgccactgcactccagcctgggcgacagagtgagtccttgtcttaaaaaaaaaaaagagagagagagaggtaagtggctccagcctgtcggtcagaaacaaatcacaataataggcattgtatcttctaccattaaagcaaaccaaccaaccaaccaacctacctccccaggaggctctgatgggccgctgggcagggtccactgcctgccatcaatccctgcccacatgtggacagccctctcctcagctgctgggtcagcctcgtcactcctgtttggtgcctgggaactcctggggcctcatgcttaccttagcccccttctctcctgcagatttcttccagggcaagcacttctttctttacggggagttccctggggacgagcggcggaaactcatccgatacgtcacagccttcaatgggtgagtctccagggactggggtggggaaggggtgatggatccaagggaacgctcagggacctgctgggaggggtgggggtgtgggaaagaagaccatcaggaggatggagaagggccatgcccagcaggtgggcacaggtcatggaatccgaatgctagcttgcccaccaccggcagcccagggtgcattgcttgcctcagtttcctcttctgtatggcgaggatccctacccctacccctgcttctgaaagggacagcctgaggattagccactgtgggagctctggtcattgtggctgtggcaagatggatacatgaaagaatggagcctagaggcaacctagaggcgcataggtggggacagtgtggggacagccattgagagtggctggggagtaggacgtcagtgctgattccctgatgtgccttctacctcttttcttctctcccgccagggagctcgaggactatatgagtgaccgggttcagtttgtgatcacagcacaggaatgggatcccagctttgaggaggtgagtaccaaagaggcagagaatgggagacccgggcacacctttgcatctcctccgtcctcccctcgatgacacattcccgtatggactccaccccaccctgcaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctcatccaagagtctcccaaaactctaagaggctccctgggacctggggaagaatgctgggcacctccgtcagagatctggtagagaaggaactctttgtctcttctgcttggccccttatccctgtgttggcaagaggcagggaactgggaatctgaccctcagcactgcccctcaactttttctggccctctgagccacacctgtatcttggctgtccctttgtggctggaggcctgggtacccatgaggcttgtctctctcctgaagcctcagcgtccccaggccagggatagtgcctttcctccagggttttcagaagtagctgtataatgaatgtcaccactgtggttttacatcacctaatttaggaggtagaatgggaggaagggacattttaagcaacctacccaaaccctgcacccccttcaaggctccaccacatttaagtgggaattgaggtgattgtgagggaatcagggcagaggatgggatggtgctctaggcagaggccatagcatgggccaggaggtgggaagcagcctgaggcaggcagaagagcattgctgcctttggcaaagaggctttgggggcagatttagaaagccaggcacagtccttgcagctctgctgtccagtgtgatcaccactgggtacaggtggctatttaaattaattaaaatgaaatgaaatgaaatgtaaacttcacttccatagtcacactggccatgcatttcaattgctcagtggctattgtattaggcagtacagagaacatttgcatcagtctagaaaggtcttttggacagggctggcctgaaggtctgcgaactccaggctgagaagcctggactttaatctgagggtgggaaggttgggagggggtttgagcaggacagaggccagggtcagaggtaggtttgagatctgacctttgggtaaccttttattggacattccaagccctttcccaacttttgcctcatcaaccaagggctaccagtctcactcctgtctctttctggacctttgtttttgcatctttaagatgagggtggtttattattattattattattattattattattattagagacagggtcttgctctgttgcccaggctgaagtgcagtggtgcaatcattgttcactccagcctcgaactcctgggcccaagcgatcctcctgcttcagcctcctgagcagctgggactataggcatgtaccaccacacctgataaattttctattttttgtagagatgggctctcactatgttgcccaggctggcctcgaacttctggcctcaagcagtcttcccgccttggcctcctaaagtgctgggattacaggtgttgagccacactgcccagctaagggtggctttagacttcatgttcactcattcgtttgctcattcacactcccaccgataactcaccatgttagttttgtactactgctataacaaattatcacaaactcagtggcttaaaataatagaaatttatgatcttacaggtttggaggtctgaagtccaaaatgggtatccttgggctaaaaatcaaggtaggcagggctgcgttccttctggaggcttgaggggagaatctgttttcttgtcttttccagcttctagaagccacccacattccattcaccttctatattccaggcctgcaatggcctgttgagtccttctcacatcccatcaccctgaccttgactcttctgttccatacttccacatgtaaagatctttgttattgtaggccaggcgcaggggctcacgcctgtaatcccagcactttgggaggccgaggggggtggatcacctgaggttgggagtttgagaccagcctgaccaacatggagaaactccatctctactaaaaatacaaaatgagccggacgtggtggcatatgcctgtaatcccagctacgtgggaggctgaggcaggagaatcgcttgaacccgggaggcggaggttgcagtgagctgagatcatgccattgcacttcagcctgggcaacaagagatctttgtgattacattaagcctacctagatcatttgggataatctccctgtttttttgtttttgagacggagtcttgctctatcacgcaggctggagtgcagtggtgtgttcttggctcactgcaacctctgcctcccaggttcaagcaattctctgccttagccacccgagtacctgggattccaggcgcctgccatcatgcccagctaatttttgtatttttagtagagacggggtttcgccatgttggccaggcaggtctcgaactcctgacttcaggtgacccactcgcctcagccattcaaagtgctggattacaggcgtgagccactgtgcccagctgggatgtgaacatctttgggaggccattactctgcctaccaaagccaccatgtgggggacactgggaagacagtatgaaaaaaacagtagtccccgatctcattggcctgacattgtacagggggagagagatggtgcacgtgcaatgcaaccttggacagtgggaaatgctgtgagagcaaggaaaacagagcattgtgagtgacagagcaatggcagggtcctggtagtttatagataggatgattggggatggcctcttggaggacttacccctctgcagggacctgggagaagtaaggagtatctgagagagcccttccaggtagaggaaaagcaagtgcaaaggccccgaggcaggagcgagcattatgtgttcaaggaacagctgggtgggtgtcaggctatcaagagacctaggatccacctagactcaggtactgccctgtggtttggttgccaataaatctcatctttcctggcctcatttccccaatctgtaaaagtaaggttggaccagatcaacaccctctcacatgagtatgtgtctttgaaattttgctgctggtgtggttgctttggagaaattcttccggacagttctctgcataaacgtggatacaagcagcactgctgggttgggaggacagagtagaacccttacccctcccaaaaccttccccgaaatgccttactgagtagagtgcagttcagcagcctgctcagtcctagcccttaggctggacactttcttttctcctacttttattttaagttcgggggtacatgtgcaggatgtgcagttttgtttcataggtaaatacatgccatggtggtttgctgcacagatcatcccatcacctgagtattaaccccagcgtccattaggtatacttcctgatgctcttcctagccccccacccccaccccctgacaggccccagtgtgtgttgttcccctgatgtgttcttttttttttttctgaggcagagtctcactctgtcgcccaggctggagtgcagtggcatgatcttggctcactgcaacctctgcctcctgggttcaagggattcttgtgcctcagcctcccgagtagctgggattacaggcgtttgccaccacgcccagctaatttttgttttttagtagaggggggttttgccacgttggccaggctggttttgaactgacctcaggtgatatgcccgcctccacctcccaaagtgctgggattacaggcgtgaggcaccatgcccggccatgtccatgtgttctcatcattcagctccaacttataagtgagaacatgcagtgtttgattttctgttcctgcgttagtttgctgaggataatggcttccagctccatccatgtccctgcaaaagatgtgatctcattccattttatggctgcatagtattccgtggtgtatatgtaccaaattttctttatccaatctatggacactttctactctctcactccttccaccacaactttcagatctcagttcagacattacatcctcaacaaggcctttcctaacctccactgtataataggatatgccaggtacacactcttaaaatactatatctcatccatcctagtcataactttacattcgtttatggtcacatttacccatgttttcatctatgatttacattcttttgtctcttaaggatactgtctctacttctggagttactaagataattcttcttatttccatgtaaatatttttgagttcttctcttcagatttagatcttaaactcccagaaacttgtttttgcatatggtgtgaggtagggatctgcagtagtttcccattgttgctgtaacaaattgccataagcttagtggttttaaactacacaagttaattttattatagttctggaggtcagtagtccaaaatcagccttattgggctaaaatcaagtgtcagcagggctgcaatccttctggaggctctaaggaggaatttatttccttgccctttgtaggcaaaattccttgacttggggcctttcatcactcgaatgtttgctttcatgatcacctctctctgtcttctgcgtccttctttcccatataaggacctttgtgattatattgggcctatctgaataatcaggataacttacccatctcaatcacatctgcaatgtcccttttgctacatgcaagctaacatacaggttctggggattcaaatgtggatatctttgggggatcattcttctacataccaggggattcaacttaatttttccccatgtctcttagccttatttatgattagtctgtccatcctccactcatccatgtcaaggctcaacaaactatagcccataggcaaaatccagcctacctagtgttttggtaaatgtttattggaacacagccatgctcattcatttatgtattgtaatgtgtgtggctgctttcctgctacagtggcagagtggaatagttgtggaagacactgtatggcctgcaaaacttaaacatataacagatgcagctgggcttggcggcccacgcctggaatcccaggacattgggaggccaagacaggaagatcacttgaggctaggagattgagaccagcctgggcaacatagtgagaccccatctctacaaaaaaatttacaaaaaaaatttagctgggggctgggcgcagtgactcacgtctgtaattccagcactttgggaggccaaggcaggtggaccacttgaggtcaggagttagaccagcctggtcaacatggtgaaaccccatctctactaaaaatacaaaaattagctgggcatggtggtgcacacctgaaatcccagctactcaggaggctgaggtaggagaagcttgagcccaggaggcagaggtaggttgcagtgagcggcgatcatgccactgcattccagcctggacaacaaagcaagactccatctcaaaaataaataagccgggtgtggtggtgcttgcctgtagtcccagctacttgggaggctgaggtaggaggatcgcttgcgcccaggaattcagggcaatgagctgcgattgtgccactgcactccagcctggacaacagagcaagaccctgtctaaaaaacaaaacaaaacaaaacaaaacaaaaaaaacccaatgccctttgacttacaatgatgctacatccggatgaacccatcataaagttggagaatcctgaaatcaaaccattgttaagtcaggggacatctgtactctttggccctttatagaaaaaggttgccactcccaggtctacaggtccagtttgtcatatgtcagcataagcacaggtctgtttctgagctctcaattgtcttccactggcccgttttcaagccaccaccaccaatttcattactgcacagctttgtaatcttgtatctgggttgagggggtggggagccaaggctctcctacttgttcttctaaatggacttggggccgggcatggtggctcatgcctgtaatcctagcactttgggaggccaaagtgggagtccagaagttcagactagcctgggcaacatagaccctgtctctacatacatacacacatggatgaatgaatgacttggctgctgctgcttttttttttttttttgaggcaggatctctgtcgcccaggctggagtgcagtggtgcaaccttggctcactgcaacctcgtctcccgcgtccaagcgattctcatacctcagcctcccaagtagctgggattacaggtgcatgccaccatgtccagctagtttttgtatttttagtagagatggagtttcgccatgctgaccaggctggttttgaactcctgacctcaagttatccgcctgcctcagcctcccaaagtgctgggattacaggcctgagccactctgcctggtctgctgctgctttttaaaattagtgttcactttcctcactagacaaggtctgtcttcaatgctgtgtccccaacaccccatgcagggaccagcacacaggaggtgcttagtatttgtggaatgaagaacattccaatgttagcttgttcatccttattttataatgagagaaacaggctccataaggggaactgactttgcctgaggtgttgcttgccccttacaaatgccttataacccacccattttacaacaaaggcatctgaatccagaggagtgacaaagcttgtccaaggcctggcaacttgtaagaagtgggtcagggatgggtctgaatcttgggctttttttgtttttctttttgagatggggtctcgctctgtcacccagactggaaggcagtggcaccatcacagctcatggcagccttgacctgccagctcaagtgatccaccttcctcagtctcccaagtagctgggactaaggtacatgccaccacagccagctttttttttttttttggtagagatggtgtctcgctatgttgcccagactgctcttgaactggcctcaagctaaccaaagtgctggcattataggcgtgaaccaccacacccagcctgaagcttgggcttttgaatgtctttaaatggtcagtggtatataccctttgttcttgctcttatcacctagtgtatcggagatttttccacatcagtacatatagcgcttccttttttcctatggctacctattccattccatggctgtaattcaatagtcggtcccctgttcttgggcacttgagttgcttccagtctttggccacaacagtcgcactgcagtgaacacccttaacactatgcttttttttcacattcatgagtttatagaataaattcctacaagtggaagagttgagacaagcatgtatgtattttcaatttcttagataccgtcatatggccaaagtggagacaccagtttaaacttttaacaagagagcctgtttgcccacaatcctcatcaacccacgatagtagcagactttttacctttgccatgtaagtgtgtggggagaagcagagccagcgctgtcaaaccacagctccacgtccatggtttgagatctccccaaagcaggggagcaaagagttcctcgggcttctgagctcgagcccagtataaatggccaatcccttgccctgccctctgccagctatctggaagaggcgagctcatacagtcggtcttagaaatcccacctcttactggctagggctggcggcagaaggggacagtgagccaagggagggctcagtctctctcccccttgtgctccacctggtggtggctgcgttgatgaaggagcagtaagcgtctctggccaaaggcctggccgcagctggagcatcggtgccaggcagtcgcctggctgccgggcgcggttggggggtcgtgacataggcgatgggcggccagcttggagggaaatgagaaagccttggggcaatgcgggcaaggataggggcgggcgtcggtggcgtggtgcgtgtggcggtgggccgccagcttggaagggtagcagaaggacttggggcagtcggggcacgggtaggggcgggtgggtgcgtgggtccagaggtgagccgccagcttggagcggtggccaaaggacttcgggcagtgtgggcacgggtgcgggcgggcgccgctgtgcgtgaggcggtgggctgccagcttggaggggtaggagaaggccttggggcagtctgggcatgggtggggtcgggcgcctccgtgtgctaagcggtgcgtggccagcttggacgggtacgagaaggccttgtcacagtcggggcagcggtgcgggcgctggggcgggggccgccggcgaggccggggaggcgagcccgcggacgcggtgggccctggagctgactggctgggcttctgcggtgggccctggtggggagctgggggacaggagggctggtgggctccaggaagcagccaacgccctgggcctaggccaggctccgccacgactttgatattcgtggggctcctccaagtgtacctgggcacctcaagcatcacattgagactccccaaattgcatgtttctgctcccccctccccccaggcgtcattctgagggactccaaagggttactttcctggatccccaaagctactaaggcttcctcaaagctaccaaggtatccgtttctagtatcttcccagtgatcaccctgacatcccgcatgtcatccctgacccgtcccttctgtaaggctcatttcctgagccttagcaaatggtcactgaggctctctctgagccaaatgggaggatttcccagaatgtggcagttttggggatcccaaatagtcatcaccctagggccctcaaattttcaccctgagattcccccagaatgtgattattttggcccccgttcctggagaatgctccctactcacaggcggggcactctcaccttctttggtcactggttccttgccagtgggactaggatcggtagccccggccgcggactccgcgcctcgctccagcatcttgctggcacaggaacctaggggcagggcgcggggcgggggtgacgccggtgatgaccaggctgatggggatagggttggagggcctaaaatgagggatcacactgtttaggagcaaggtctgcaagtatgggatgctaaggcgggggcaggcttagcggggaggcggagcctaagagcacagtgagcggggctatgcaaattcaagccagaggcagtcccttcgctatctaaacccagggttggagtctttcagcagagtgggcggggtctccacaactaactcagcggccgtcttaagcgcggagccggcggggcctatgcgcagagtgggcgggaccttccccaccagaccctgcagtcctggaatgggcggggctgtacaaaaaaagtcttgttctgaaactagacccagggggcgggggccttcgagcggagtgggcaggtctttcatcaccgtcccaggggaggggcctatgggcacagtgggcggggcttcacgtcgaagacctagctttacccggcttttgacttagtctcagttcattgacgccgcgtcaactgcgcccttcttgccgttaaatttcatccctggcttggatggggccgtggaggatagaggggggacctggaggaagatacggaaggaacctggcatgcgtcgcggtccagagacccctaatggacttttccctcagagtcccaagcgtaaaggattcaatgcacccctcggaatcagacattcaggcaccgatgcaccctcccgaggctctggcaccaatgcacagtccctccagcatctccagaatctaggcgtccggaccacaaccgatctccctcggggtgattctggcattcagcctgcaagccaatatccgcgcccgaacccctgcgccctcacctgcaggacggcccctccccgggggcggggcttccggctcctcccgccacggccacggccgcagccgctgtcgccgctgctgcactgccctcggaccagcggagctgccccgcccggcgcgcgtccggcgtcgggggagggcaggcaagggagcgcgcgcaagctgcttagcccaacctcatttccatcccctcctcccacgctggaccaaagggg

SEQ ID NO: 1799 - DNA, 2196 bp, Homo sapiens
tcccagcaacaggcatcctcctctctcagatcctgccatggtcactcctcagacctcccaacgagggtctcttgctgcccctcttggctattttcaggtcttgtttaagactttagccagcgcagggcgcaccccgccccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccggcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctc

SEQ ID NO: 1800 - protein, 633 aa, Homo sapiens
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 1801 - DNA, 32963 bp, Mus musculus
  misc_feature (1)...(32963): n = A,T,C or G
gcaaccccatttccagttttatggggtgctggaaattgaacccagggcttcaggtccattaggggagcactttatctacagacagatccaaactctggcagccagacaacagctagcattcctcaggcacttgggaagccagttcccctctgccccaagagctattccttcagcctattccttcagccgtatcactggctgaagggacacacggctctctgtgatgcgtattagcctacccatgctgacctccagactccctcagtatctatcacaagtgcccggtacacatttcagagtctgtgtcagtatcctggcccttctcagctctcctcagctcctcccctgccatgactcccccagctcccggctcctgtcctccagcttctcattctccccataaccctgccgttcccactgtgtgtctgctctctagtcttcctgtcttagtcctttctcttgctccctctgggtccccctaccccactatggccatgtctagtctactgccttctctctctgttctagactcttccagaagcctctggctgatctctctctctctctctctctctctctctctctctctctctctctctcatatctacaataaaaaccttccccctcagctataccacagagtgctcatgtcgtcagtttttatatctggtgctgagtccctccgtttatacagcgcataccctgcacagacaagggaccgacctgtgcctgaaggagaggaaaggtattcctaggagccatcaagaggccaaggcttgcaggtggggattgctctcctcgcaagctgcagctgctgctggctcctgtcagctccagtccagcccataggctcacgtgctgatgaaagttaggaagcaactacagaagtctgcagaagaaaggcagaacttctaaggtcggctttgcccccagccttgtcctcagcggcaacccttgcttggggtggcaggtgtggcagcactcaacttagaagctctctcacaccatcagacatggatctggttcaacatcctcactggatagaactggagccaggaaagagggctgggccacctggtcccaattctcaactccctataggagacctcagccctgcctttgctcaccagcagcctccccatgatggattcctgggcaaagtaacttgacccaccgcaggggagtgttccatggtagatataagccatgcagtgtgcagcggcgtacaatcaaaaaagtcaccaaactccatgccagtccagactaagctggtagaggtggaaacggcctctcaatctgggctgggggagccctatctcccagccagcctctggtgtgacctccagagggacccctgagagtcttggatggaagctagaagaggcccagctttttcctacacaccttcccacaccttcccattctagatgaagaatcagagtctggggcttcgggtctcaatccaggtcacaggctggtttctcccccgggatccagaccacttaattattatttattattattaataataataatttatggttgtgagccaccatgtggttgttgggatttgaactcaggaccttcagaagagcagtcagtgctcttaactgctgagccacctctccagccccaggccacttatttcttagccctgggcagagcttggagaatcagagccaaaggaaaaggaatgctgctggcaacgcccaaggccttgaaattgcccttgaatagcagttcccattctcagccaggcagctagaccctgtcctggtcagactcagttaggcagtgtggtgcttcattgtaatcgagcatttgggaggctgaggcaggaggattgttgcaagttttaaactgaaaacctgaatttcagcaagcatgagtagagaaaaagaaataaaggaaggaaggaagaaaaaatgaagagagaaagaaaaaagaaggaaggaaaggaaggaaggaaggaaggaaggaaggaaggaaggaaggaaggaaggaaggaagggacatgactattcctaggtatggtggaggagaaggtttattgtggatatgagggagagcgtagccagaggcaggaacatctgggagaatctacagtggactggagtcatgtgaggagaaggagggagggaagggaggaggggacgggggtggggtggggaggagaaaccaggtgctgcaactagaaggctcaaaaatgagcagggtaattaaaatggttgaattatataggaagatcaactggggaaagggtagcccagcccctgggctggagaagtttagggtaggggtggggtatgtcagccaggagggccctgtaacacacatggactgaaggatagtgggagaacctggtggccaggcctgctttgatacattaaacaggaaccttagtcacttgtccggggtttgagacctaacccactctaagtcctgggctacagagtagcactttgtctcaaaaacaaaccaaattacctctggaagcaaattcaattctttcacgggttgggaaaatgaagtccagagagatgaaggtgcctgcctgttcagggtcacacagctgagcagagttagggaaacaaaggtggaagaggggcaatgggtaccctgggctttaattcaagagccttgtccaggcgagcaggagagagagcagatagcatagcaggggaagatatgggtcccacctggcctgaaggctgatgggaaagggcatggaaagacatctggatggggactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaaagttcaggaatgtcccagctgaggtgtcttagtctttgttagtgttgcctgtttgtatggaaccccctcccagctaacggtttatctcgggttctgtaaaatgaccttacttccaggaagcttcctgcagctgctcagttgcaagatccctttgaacacacagaggaatacacacacaggaacacacacacaggaacacacacacagtatcctgaatatccggggccacacctagatctctggacatttggacgtggtcctagagggctgcagtaaacagttccaattgccatagactgtgtctgaatggtcatctctggtgggctgcctgtaacagtgagagcctatcttagagagaaagaaacaaagaaataaggaatgaagcccacattagtgatgatgatggtagctggccatggtggcacatgccttaaatcctagcactggggaggcaggagaaagcaaatctctgagtttgaggccagcccggtctgcagagcaagcgccaggacagccagagacagatatagtgagatcctgtctcaaaataataataacaacaatatttgagaggtcaaggggcttgtgatgccactcacttgcctaacacaggatgccctgagttctctctgtataaaaccaatgagggtgggacaagcccgtaatcccagcacttgggaatggacacaggaggttcagtagttcaaagccagcctaggcaacatgaggaactgtaagggtctgaaattcgctgaagacagaccccagactcaaatagtatgcgaggacaaagagtgtttcttctgcagaaataaccaacatgcaggagtcaaccattcttcaaaatggcaaccccagacaaaggcaggcaggccttctcatagggaagcaggggaactctctagaaggattaggtaatctctaatgtgattgtcaggggccataaaggagacattagtgtagcattgattggtgaatatgttagttctttctgtatttagagagtggggtaggtaatctgaaatttgattggtgggtgctggggaggtcacagaggtcggcttctgattggctgtgccaggtgctcagtggtctgacctatgtcatgaactacaggatgaggtaggactgcccagcacagatgatccatcctgggataaagatattttccattcttgtagttatccccaggctgttccttgggacggggttttatgaccttgtttctggattttatggtctgttccgaagatagtgccttacagccttcttttctttcttttttttttttttttttttttttttctttttttggttctttgagacagggtttctctgtgtagccctggctgtcctggaactcactttatagaccaggctggcctcaatctcagaaaccctcctgcctctgcctcccaagtgctgggattaaaggcgtgcaccaccacgcctggctacagccttctttttaaaatcaggcctggtccttaaacagagacaaaatcgggtttatgttgtcctttcagggtttatgttgtcctttcagaacctgttgggggcggtgtgaatgctagaattaaggctggcagctccttcggaatggttttgcctatttcactcagagcctggattccatgcccagctctgcataaggctggtctctccccactgtgaggtacagggcacccagcctgtgagctgacagaggtagggtgttaagggcccaactctaaggggtaggtgagagaggaggcagaagtctgggtgctagctcagccatcttgtcctacagaccgtgagcccttggttctgggttggtgggaagaagaaagagagagaggaagacgccacctccaagagagaacgaccagctgtagggtccaatgaccagctgcagggactgtaaagaggtgtcaccctcagaggttaccgggctggtcaagaggccagtgaggaaaacagtggaggagactctcccgccctgaactggaaacgggtgggacttcattatgtagtccagagcgatctcaagctcctgatcctcctgcctcagactcctcggtgctggatttcggtttagaccacagttgctgggcacagagttctttgtggtagcacgcagagagtcacacaaaccacaggaagccgctcaactttgagaggcacacacatcctgcgtagaaagagagagtacttacgaacatagcttgcctcagtgtcatggaaagactggagcagggcagagtgcggagaacactgtgtgcaagaaagcaggggcctgtgggaacacacacacatacacacacacacacaagaaagagagacagacagatagacaaataatactgcctgtctgttggcaccccagaagtgagaagagagcactggcttccctggagctagcatttcagatggctgtgccctcccccagccttgagtgggctgatttagaccttgtttaagccacagccggctggcccacctagggtggagtcttccgacttaggtgaagtttattgccctgccacaagaagtcactacctgctgaggggctgaacctgttttcctggccgatccgatccgtagcaaggagagcctggcgtggtgggggatgggcttccccccccccccttttaaagttcagactcaagaagtaaactttgggccttgatcagaaacttgtgttggtctcgttctttctctctcccatccagccccagcttttctctcaggaacccagttcatgtagctgcgggcagctacaggtggctatgagttaccccacgtgagtactgagaactctggaagagaagcaagccctcctatcctctgaggtatctgtccagcccctagctagaatctttaaaaaaaaaaaaaaattaaggggttatttatttaataagtgtaagtgttttgtacctgtatgtgcactagctatgtgtctggtgtccagtgaggcctcgggtcctctcggaccacacccagtgctaatttttaaagaggtgggaagttggagagatggctcggcagctacagttgctcttacagatgatccaggtatggttcgtgtgtggaactccctggttctagggaccccactgccttctgtggcctcggctctcccccccccccccccgcccctcaaacccaggacccagggtatcctaggcaacgtttggcttcggaccctgggacaagagactgaggtacgaattttacacaccaaagcagacctggcctccaggttctccggcatccctcagtccctacctggcataccctgaactttctcgtacaccggctgggctgcccttcccccagggattcttccttatataatccagacatttggtctttctcttcacacacacaccccttctcttctctctttgtctctcttcctcttccccctccccatggcgactcccctggcttcagtccttgggtccagtgaactcgtccgagagcagcttcccaataaacttgaatttaatctaatctggtttgatttggcccatttcacgtgcaagtgctctacaactgagcggcaccccagcccgctcagactcttctctcatctattgtttctccttcccaggtcatctctccctctaacccttggctcccttcactcctgactctgctctctctctccctctctnnnnnnnnnnnnnnnnnnnnnnnnnnnnnnnnnnnnnnnnnnnnnnnnnnnnnnnnnntctccctctccctcttcctgccctctccctctctctctctctcccctccctctcccttcccctgtctctttcctcctccctctcttcctctccatctcctctgccccccactctcacctttatccctatatagtcttttttccttcctcaggctggggaagcccccacgcgctggacctcgcccacaacccagcagcagggtgaggccaggtgagtcaccagaaggaaggagtggacattcctgcaatttttctacacaggggatcagtgacttggcacttttctctcccttccttctactcctgactggaacctcccagaagtcagagtggtacaaacccacagggaaggaagaagatatggacagacaaacagacaactgaggaggggacgcagaaagagagatagttatgcagaggcagatagaggtggcatatgccagtaatgccagcacgcctaatgcccctgtctcagcttccagaactctggtggacaggtatggtggcaactggatcccaagctctgtatgctaggcaaacactgccccaacccagccccaaccaatgttcagtcttccaagtaaagaaacagagaactgtgttggcttatggtgacacaaccagggagtggcccatcctggccaccatcagcatgacaaacactgacctcagactcccaggctggggccagcttccctgtcacatagcaagagctctggcaggagggtagggggaagggttgggagagaggttgggccagctgccataaagcacacctctccccagaggatgagtgcattctggagccaaacgtgagtgaccatggccaggggacacagattcgtgatcccctaagcacccacggttacatgaacttctcagagcgacagcatgaagtaggctgaatctcacagcaactttcaaagctgaggcttagaacaaactgggaaaattctactatagacctcagatgctctctgatgatgttcgtagcctttagattggtagaagctggggatgtgtttgcacacccccaaactatccagcagctgcccgaatgttagagccaacaccgagaaaagcaatacatacctattttaaaaaaacataggtagcctaccataaatttggctctggacctgtaacattccaactctacgcttagtcaatcaactttgtagaatgtttttaaatttatttattattatatgtaagtacactgtagctgtcctcagacaccccagaagagggcatcagattggtataagccaccatgtggttgctgggatttgaactcaggacctttggaagagcagtcagtgctcttaaatgctgagccatctctccagcccccagcaaaagcttttcaattgacagattctagagttaggaatgaatatgttcaagacaaccaccttcttattgagcatatactacgcctgaggccctaaagcaatcacagtttgttttcctcctccatatgaaacaggatctctctcacttctctcagggctcctctcagacctttgctgtctcaaccttccagatgagcttgcagcacagagaggctaagaaagacacctgctaatgatcagtaagtcacacagccctcacagtctggggccagccccctactctctcagttaggacctcttagaggaaaactttatttgggcatttttatttttatttttcaccttttaccttatcttgacattaaatcaagccaagctgggtgtgtggctcagtggtggagcccctgcctagcctcccccagtgaggggttggggtgtggctcagtggtagagcctctgcctagcctcccccagtgaggggctggaggcgtggctcagtggtagagcccctgcctagaatcccccaatgaggggctgggggcatggctcagtggtagagcccctgcctagaatcccccagtgaggggctgggggcgtggctcagtggtagagcccctgcctagaatcccccagggaggggctgggggcgtggcacagtggtagagcctctgcctagcctcccccagtgaggggctgggggcgtggctcagtggtagactccttgtcaatcctgcaggagaccttgggttccgtgtttcccagctcaggcttcagtgactcggtactcacagcagtgacatcactactgtacgggtgctactcattgctctctgctctctctggttcccactcatcagccacactgagccgctctgagtgattctttgccctcagggcttttgcgatgactctttcctctccctcaaaggctttctgtaggaatccactagacttcttgcacacctttcctggctgccctccgcatcaccctcccaaagcaattaagccatttacctctctccctacagtttgttcctctttcaacttgtttttcccctggtttccgactgatgggagagattagataactaatgtatcctccccatcgtaatggcagagggtggcgtccttgtgtttcctgctgtgttccagttcctggaacagtgcccagtacccaggaggtccttggtcaggagctgaaggaattttgccctctagtttggcaagttagtgttccacatgatttccctacatggaattgtaccgcctcggccaaggatggtagcgtgcccatgatccagactcgggggagactgaggcaggaggttcctgagttcaaggctggtcttcatagcaagactctctctggagaaactcaaataaaacaaactttgaaaacataaactctgattggtaagaaatagccaaggctagagaggattctaacccttgctatttggttgtcttcctttctccatcatagtctctctctctctctctctctctctctctctccctcatccctccttctccctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggagctgactcactctttagcaaacagtgggaggagccctagggtcacaaaactgtcttcttcccctcggtcagtctagagcagaggtgaaggaagaacccatgggactcccaaggcggctgctgctgctgctgttgctggcgactacctgtgtcccaggtaagagctgcgtggtggcaccgggcgtgagctagaggaggatggcccagcgctccacccttctatccagctattctccgggtgtgttctcaggctccacgtggcacagtcagactcccgcaggcattcatttagtaaacgctgatccctggtgcacagtgcctggcacactggaggacgcggaggaacagagaggttaagaagctggtccaaagcctcacagctaggggttgaatgataactggacatgtgacctcacagccactccccacagtgttttggtctgtgtggggatcccactttgggacaagacaggggctcaggggtctacatctcaaaggtccacagagttcagcgggagcccagggcctgtccctcgaatacacttgtcttttactatgttatgtcctcagccttcttcctccaggaaatgcgggggaaatggtgttgagaaagtagagggaaatggggaaggaattgagtcagggtttggcacggtgaataactcggaaagccctctctagtccgcgggagaccggagatgattaatggggtgggaaaagatctctggcggggcctgggtggtctgggagctagaggggggaggggtgggggtgcaaaggggaggggctcttgttgaagaaaggatatctggcacaaagggaccggctctaaattgcagaccggatctcggggctcagacaggacagttcttactgtgaaatccaaccccgggaggaggggaccctggagtggggctgccacctggggtcaaaactggctgtgtggttcaggacagttacttagcctttctgttcctggaacttgtctgggaaatgggggccagactaaggctaggctggtgcaaaagttctgattagaaactgggcagtcgggggctggagagatggctcagtggttaagagcacggactgcttttccgaaggtccttagttcaaatcccagcaaccacatggtgggtcacaaccatctataatgagatctgacgccctcttctggtgcatctgaagacagctacagtgtacttacacataataataaataaatctttaaaaaaaaaacgaaaaaaaaaactgggcagtctgaggcggggggctataacattggcgagacgtggcctaggtgaagacctgcaggagggacttcggtcctggggtgggacaaacgtttgggggctgaggtgggtctttgaaagtggttctcaaccttccgaatgctatgatcctttaatacaactcctcacagtttggtgacctccgaccataaaattatttttgttgctacttcataactgtaattttgcaactgttagaaatcttcatgtaaatatctgatgggcagaatatcggatatatgacccctcctgagggtgagaacagctgggctgtgtgctgttaagccccggcagggctagtctaccaagaacagagtagagtgtgatgggaaaatagccttaattccaaggcaggtggatttctgactttaaggccagcctggtttacataaatagtgaccagccataaatagtgaaaacatttcagaaatatttaataaaataatataaaggtaggaagagaatttagggaaggagccagagtatgggaactagcgtctagaaggaagcattaagcatggttaaggaagccaggggcagggctagaatattgggcagaactggagactctgagacaggcaggagctacgggctgggactagaacctaggagagtgtcggggaagggggagagaatgtttttggaggtaagctcagttgattatcttggagggctactgggcagggttagagcttcaggaggaaagattcatgtcttggagagaatcctgaggagtagctaaggaagaggatggaatgggtggacaagggataaagatccaatgtccagagctgaccaagtagagaggacacaggacctaaatgggacccagggtagaaagtcctttcaagaactagaaagaaggtgttggggatttagctcagtggtagagggtttgcctagcaagcgcaaggccctgggtttggtcctcagctctggaaaaaaaaaaagacaaaaagaactagaaagaagaagagttagaggttgggagatggggcggggggggggggtcgcatgcctttgattcaagcattagggagacagaagtgggtggatttctgtgagttcaaggcctccatcctggtctacagagcaagtttcaggaaagtcagggtaacacagagaaaccttgtcttggaaaaaaaggaaggaagggggcaaaagtgcagagttagaatgaatggcaggtgatgcctgtctgtaatcctcacacacaggaggatgaggcaggaggattgctgtgagtttgaggtcagcttggactatatagatcttagagagagggagtggaccatgggcaatcagggcacaatgcatgcatccaaggggaacaggcctagatcagtttcacaccatggtggggtgggaggcagaccctggccatcacctctgactcctctcctctcctctcctctcctctcgcccagcctcccagggcctgcagtgcatgcagtgtgagagtaaccagagctgcctggtagaggagtgtgctctgggccaggacctctgcaggactaccgtgcttcgggaatggcaaggtgaggctgaccacccccccaacaaccgatagcaaacaataggccaggaaaccatctctctccagattgtaaagatatacaaaagtttaaacgtctaacaagggtggagaggcagcccggcatttaagaccagccgctcttctcttccagaggcctggagttcagttcaggtagccagccagatggggtgactcacaaccacccatgacccccagctccggaaggagagccaaggctctcacacacccacagatgcataactaaacacctgttgatcttgtaaaggaccgagattcattcacagcatccacctggtggctcacctgctcctcgggcagcaagcatgggtgtggtacatagatgtacatgcaggcaaaactctcgtgcacacaaagtaataaacccaagagaattgtttacagtgttggtgcaaccctggcgatggggataaattggctgtgtgcaactcagataaatattttttgctttgtttttgggattggcggtggtggggtggtgtttagtttggtggttgttgcttggtcttgagtttttattttgttttgttgtaagacagggtctcacatagctcaagctagccttaaacctgtactgtagccagtgatgaccttgaacatgtggtcctcctgcctgaaactcctaaggtagagatcatagatgtcaccaccacgcctgaactgggatgtctgagttcaaggccagcctgatctacaaagtgagttccaggacagccagggctatacagagagacctagtcatgaaaaaaccaaaaccaaacaaacagataaacaaacaaacaaacaaaaacaagaaaagcaaacagggctagagaaaccgctgagcaggctaatgcacttgccaccaagccccataacctgagtttgacctcctggaaggagaacactgactttgaaaatgtcctctgacctccacaagagcacacaagcacacacgtgcacacacagacacaaatatgtacacacatgcacatatacacatacataaacatacacacacaaaataaataaagttaaaataaaagctggacacattggtacacacctggaactctattactagggagattgaggcaggatcccgaccggaccaggctatgtagcaagatcctatcccaaaaaagtctaattaattaatcagtgtatttgttttactttttttttcccattaaatgcacctcccctctggtttcattcaccttgggatagatcctgaaaatccacgtgacgtgtacaggggaagggaggatcattctagaagataacagagtgggctcaagcaagaagaaaggctcacaagggttggccctggagatgagtgactctgcggccaggagtgtcatgggctggctggaccttggagcttctgagggactaaagctgttttcctcacagatgatagagagctggaggtggtgacaagaggctgtgcccacagcgaaaagaccaacaggaccatgagttaccgcatgggctccatgatcatcagcctgacagagaccgtgtgcgccacaaacctctgcaacaggcccagacccggtgagtcgggcgtccttgccacccctagccaaagcccatcaccaccccaattctatccccagacctgcattaccccagtctgttcctcaccccggcccgaatccatctatagccctacccaaatttcacacctgcccccatcagtgtcccaagacatctccctcccccatgtcgaaatagccggacacccagtggttttgttgggttgaaatgatatagctagcccaggctggctagaaaagaagaacttcctgcctcagcttcctgagtactgaaactgggggtgtgactcagtgctggagcccctgcatgtgtgacatcttagttttcttccccaacaccctttttgaaaatgaggatttctgactcggaaagcatggtgagcgtgtggagagaaaggagaagcttccatgaaccttttgcctgagcatcgtggctttaggctgcggtcagtagtcgggagacggaaggggaggaaggaactccactccttgtgttttttttcttcactgtctggtcctggatggacattgattatgggacagtcctggggtcctcatgagggaagggacggcctttctgcctgctttatcttcttcctctgccgtacctactgactgtcctaaactcactctgtagaccaagctagcctcaaactcacaggtcccgtgcctccacctcgagtgcagagattaaaggtgtatgtcaccacgcctggcttatttgtttcttagataaccctctctggcattgaccttcccatatccctatggaataccttgaatgcccggttctctgtcaccacctcctgagtgctgggatcccagccatgggctccctcggtgttggagagagaacccggagctctgtgcatgcgaggcaaatactccaccaactgagccacatccctagaccctcttccctaatttttatatccccctcccacttctgtttttgacaaatgattctgcccttagcagggaggactgatgagaggggagctagagtggagaaatggacatgggtggataatgtagcctgcacccagacaggggtgttcactgagctgggatagaattgtcttgatggatggattacctttggcaggtgataaggggaatttagtggcatgggacctgcacactgaggcttcttttctgggtgtgatagagactcttatgtcagggcaatgcttccaagggcggcggcttataaagctgggcagatgacagccagtgatttgaggtctctgaagagcacaaagcaaaggcaggaacttggggccctgtgatctttagaagagagaagccagacacagagagtgtcacaggtgtcacgcttgtgttccaactcaccagctcagctctgttaaagcagacagagccatgaagagagagtcctgagactgaggcaacaggctcaggctgggtggcagttttccctcccgtttttttggcaagtgtacgcgcaaaaaagaacaacaggagcggagctggagaggtgcgggtatccattttagatcccctgagagccagccaggaggtgaagaacagaccctgattgataaaaaggaacagaagaaaataacttagagctgtgtgtgtgtgtgttatcatgtatgtgtcagtgttgtgtgtatgtgtatggtgtcggtgcaagagcatgtggtgtgtgtatggtgtgtgcatggatgtgtatatgtatgtggtgtgtgtgcatgtgaatgtttatgtgtgtgcatatgtgtacatgtctgtgagtgtgtgtgtgtgcatgtgtgtatatgtgtgactgcattgtctgtggatgtatgtgtatgtgtgtgagtgcattatctgtgtgtgtgtgtgtgtgtgtggtgtgtatatatgtgtgtgtgcacaaagaggccagaggaagacagcagctgttctactctgtcattccgtacctaattctattcagagagggtctcactgagcctgaagctagactggcagccagcaagtccaagggtccctcccaactctgcctacccagaccagggattacaggacactggctccatggtttttacattagttttggggtcaaactcatgtttgtctagcaagcaccaaagagctgtaaagaaaagagctgcagcctggcatggtggcacacacctattatcccagaacttgagagaacataatagaaggatttccataagttggaggccagcctggtccacctagcagattccagaatgcagactgaaccctagtcaaaaaaattaaaaaattaaaaaagcatatgtacctcatcgtttgggaaatgggaagggaattccacacaggacatgctagctctggccagagacttccccatcacacacacatcggatacccccagtaccctgtcacctcatgactgtattgctgaggaagaattcaaaatggagcaccacagctctgggttggctcactggttcaatttgttcttctagaagacccaggttcagttcccggcacctacatcaggctgctcacagaagtctgtaactccagttctgtgtgtgttgccctcttctggtcatctctggtactgcatgcacatggtgcacagacaatacatgccagcaaaacaccacacacataaaataaaacgaaggggaagaaaactaaaagccattttttctcttgagagccaagttggaatcccctccaaagttaatttattaatctcttccaaaagcagtgtgtgcatatgacgtggcagcttctcactagcttcctgccttaaaggtgcatcccctaacactctgccacactaaagaccaattaaaacatatggccctctgggagacaaaccacacccaaccatggcagaggcagatagagactcaggtgagtgaagccaagaaaaccaagaggcacctgagtacacaggtctggaagtcagatatttgtttttagtaccacaaatggaaggtagagtcttgggagtcctagttctgtactgctgagccatgcccacagcccaggctccaccactgagccatgcccctagcccagtttctcactagggaatcctcctgcctcagcctcccaagtgcttttctccaccaagaaaaaagttacaccactggtgagatttagcaatgagtaattaaattttaaaaaaatgggggcactaagcagattcctgaaggtcacatgacccgtacttagaagagcatcctgggaagaagtattcaaaatgaaaccccccccatcccaccccctgccaagaggggtgggacagacagcgtggctgtgctggaaattcctgttttgattttttttcccccaagacagggtttctctgtatagcccctggctgtcctggaactcactttgtagaccaggctggcctcaaactcagaaatccgcctgcctctgcctcccaagtgctgggattaaaggcgtgcgccgctaccaccacccggcttttttttttttttttttttttttttttttttttttgccccagtcttcctgtgtactccaggctatcctcaaatttgcaatcttctagccccagccaaagtccaccaaaagtccagggattacgggaatgtagcaccatgcctgaagaagttctgcttttggttttcgtggaagtttgtgggaagaggcgggctgtgggccttttaggcatttttctttgaatgagatagatgagttggctctggatggagtgattcacctaattgccttgcgcctgccagtggactgactcagctcagacacagctctgatctcctgggtcaggaaggagaggccgtgccaggctacaggatggtgtgagccaacgcctgggcaagggatgacatggtgtttccagggaaaaccatccagttggcctcagttagaagctttgagcaaaacaagattaccatggatccatcaagtgaggctttggcctttcgggtcatccatcagtgagtgataatttgtgattccaggtagactgtcttggaaataaaggcaaagctaagagatagttctgttccatgagatagctggagataacggattctgtattatggttacattgtgagaccttgtatcaaaaaagggggaggggctactaatacaacacagtagtagagcccctgcctagaatcccccagtgaggggctgggggcgtggcttagtggtagagcccctgcctagaatcccccagtaataggttgggggtgtggctcagtggtagagcccctgcctagaatcccccagtgaggggatgggggcgtggctcagtggtaaagcccctgcctagaatcccccagtgaagggctgggggcgtggcttagtggtagagcccctgcctagaatcccccagtgaagggctgggggcgtggcttagtggtagagcccctgcctagaatcccccagtgaggggctgggggcgtggctcagtggtagagtccctgcctagaatcccccagtgaggggctgggggtgtggcttagtgggagagtccctgcctagaatcccccagtgaggggctgggggcgtggcttagtggtagagcccctgcctagaagaggtgctatttaggaatgatgcagaatgaggaggagttgggaaagaccaggaataaaggaagggtgttctagacagagacaacagactatcaagaagtctggtgctgctcagggtctatgtgctaagactgtggagccagtatggaagagagcttgggagaggctggcacttggagatggggcaggacaggtggcagggacccagtcctcagtgggcctggaatgccacactcatgtgcttggctgttaatctaacagtagggagctctggaagggttttgagcagaggagaactggattagatgtgctttaaagacttcattttagggccatttgagaggaactggagtggagatgggcgtggctagaaccacgtagacgctcgtattgaggagtaccaaaggcgggaaaggacaggattcattctagaaggacttgggataagtaggcttggtgattggctgccaggttcagagtggagttctctgcaggacctggccgccaacacgccactctctcctcttcctaggagcccgaggccgtgctttcccccagggccgttacctcgagtgtgcgtcctgcacctctttggaccagagctgtgagaggggccgggagcaaagcctgcaatgccgctatcctacagagcactgtattgaagtggtgaccctccagagcacagaaagtaagctcccatctgctgggcaactcctagtagagatcttcaagtcctgggagcagagcgcaagcaagagacaactgaatccacacacagtcacgggaccaacattctcagtgactggaagttcccggtcactggatcagcttgggagtgaccaggaacccagctaccttatcatgtctcccatattgctttcgttctgatgactgcctcatggcacagtatggccaccataattccagacttggtgtccacattccagagagaagaaaaggggaaagaagggccccaaaattcctttgttttgtaagggttttctttctagaaatcccagaaacgcataaggatctatttatcgttcgggcctcctttatctataacaaaggggaaaaggaacacgaagccctttggctaaggatgaagttaccctaagtagcaagggcctctgataaaaggggtgtgcgcaagggggcaaatcaacacccagccccttaccaggatctgccctctgccttctgcagggagcttgaaggatgaggactacacccgaggctgtggcagtcttcccggatgcccaggcacagcaggtttccatagcaaccagacctttcacttcctgaagtgttgcaactacacccactgcaatggtggcccaggtgaggagcaggaaagatgaagtggacattcctgtctctttctacaactctctctcctcactctctcctaagtccgttcaaacagcataagtatcgcctctcctggaggtctgccctgacttgcaaatctgctactgagtcactcaattctccatgccccagctctgcccactctgggtggggactgtctgctgacaaagctgtgtgtcctgagattacagagccaggctgtccaagccaccgtgatatcccaacacagcatgaggttaaggtcaaggaaaccatttcatagcaatctcgtagaaatatagctcttctataaaccgagctggagaggtggctcagtggttaaaggcactggctgctcttgcagaggaccgaccaggtttgagtccccgtgcccacccagctcacatctgtaaccacagttccagggcatctggtgccctcttctggacaccatgggcattgcatgcatatggaacatagacaccggtgcaggcaagaactcatacacataaaataaataaatgtgcttaaaattgttaatgttctgcaaaaccctgcttttgattcctggggcaggcggttgaagccagggtcttacacatttcagcaaggtcctcagacttgtcagaaggcatcttcactcactgagccatctcagtcctaaacttactatttcatattaattaatttgaacctaaatacaatctcagtacgccagaggtggagcttcaaaggttcaaagctgtctcctatacagtgagttccagggctagcccagctacatgagaccctatcactttccacagtaatagacattgtttgtactgaaggctgaagagatggcccagcaccatctactaagagtagataccagatctggagtcagttcccagcacccatggtggaacagctcacaattacctgtaactccagctccaagggatctgatgacacacatacttatagttttcaaatttgtattgtgtgtatgagtgcacacgagcgcacatgagcataccgtagtttaattgtaggagtcagaagacaactttaagaagtcatttctcacttcccaccatgtgggtcttggggcctgaactcagatcatcacacttggctgcaagctcctctgcctgcttagccatctcattagctcgaggactatatttaacaataattcatttaaaccttaagaaacacaggtagccagtggatactacagtgaacaactctgtttagtaactttttagagagtggggcctgtttgataatacatagtttgttagggtccaccatcagttgcctagctagatgtgagtggagttcaaccctggagaaccaaatgccaaaagaatgcagttcctgggcatgaccatcaggtggcgccctatcacctcaggctgagtgtgggcagatggatggctgcatagacccagtgctcatcttcgttccctgtcgttttttttttttttttttttttttccatctttaagttctggatcttcagagctttccaccgaatggcttccagtgttacagctgtgaggggaacaatacccttgggtgttcctccgaagaggcgtctctcatcaactgccggggaccaatgaatcagtgcctggtggctacaggcttagatggtgaggccctgtgggagctggaaggggacccactgaggcactgagcgctgataagactgattgacagatggtccggttggatcttcctatggtaaaggcgacactttagctggggatggtggtacacagtttactcccagcacttgggaatcagaggtaggtggatctctgggtttgaggacagcctggtccatacagagaggccctgtctggggggtggggaggaggcggtgtctacctgcaaaaaggacaaattgcaacaagagagtttgcctctgtggagccaacaagaataatacacttcattacaccctaatgtttctctttgagactgggtcttactctgtcgccctggctgccctggaactcactctgtagaccaggctggcgtcaaaccgagagatctgcctgccactgccttctgagtgctgggattaaaggtgtgcactaccatagctggtctcataaataatagttttgatgggggggggggtgcctgtgtttttcataatgaaaaagtgcaaagagagtgctgtcattgtttactgtgtggcaaccctcttcccgtctggctctaatagcagacagctggtccccggctctgctttcgtgttccgcctgttgcaatatcatgtcctggggtttctctggaaaagtatctcttgtacacacaaaaagcttggaagggccaaatgacatctcagtgttactatgaaatcaatcctggtgtgagtctgaggcactgccaggggttcctggaacacactttgggaagccctgctcccaacagggaactggtggttggcgatggcgtccaccaccaggagcctgtcactttcctgagaattcttactcggactcaccgactcttctttttcctcagtgctgggaaaccggagttataccgtaagaggctgcgccacggcttcctggtgccaaggctcccacgtggcagactccttcccgacccacctcaacgtctctgtctcctgctgccacggcagcggctgtaacagccccacagggggcgcccccaggccaggccctgctcaactcagcctcattgcctctctgctcctgaccctcggactatggggcgtcctcctctggacctgactcctgagccggcagccctggctggacccagggtcttttgactccctcccccctgctccatctttgaggatgtgtgtgccctcgtgttgtcttctttggacctcagtttttccatgaaccagaagagaattggaacaagggctgcgggcagcaggggcctcttagttgagataatattgttgctgttattattattattatcattgttattgctctaatttattatataaatatatatataaaagatttttgtaccagtgaacaaggttgggtctccccactgtcacatttagcttgggaagatgagagcagcagggaattgtttttttgtttgtttgtttgtttgattgattgattgatttttgctttgagacaggatctcaccatgtagccctagctgccctggaacttactttatagaccaggctagcctaaaactcacagagacccacctgcctctacctcctcagtgctttgattaaaggtgtgtaccaccatgcctggctaggtctcttactgaaccccagagcccactggtttgactatgcaggttgagaggatgctgcagatcgtcctgtctcccaagcacgataaccacagaggtactaagactgtctggtttttttgttttgttttgttttgttttgttttgttttttttaaatgggtacaggggatctgaactcaggttctcctatttctggagccaagtactgtatccacaaagctgtcttcccagccccccagtctatatcattgctgatgccttccacgggggtgggggaagggggtgggggggcggggagccaaaaggtatatttcccatcatgccctgcagcagagagccaaagatgacgttgtatgagatgcttcctagttgaaatagaaaatagtctcaccgtgatgcctcgcaaaagacaccgaggctaaggcttcctttcccatgatgccttgcagtgggactcagaatgtagaaatggcctcacaaggtcctattctacggtttgtattaggcctcagtctctcaggctcctgagttggtcttacaggatctttagctgcaagagataaaatcgctttgtgctgacttaagcagaaactgttattggaagttagaatctaggcaaagtcctgggtctcctggggtttgctggggacaagaaagaacctgtgtaaaccagaaaagactccctcctgctgattctgtccctccctacccttgcacacatgcctacccgcgtggggggggggggcaacaagaggtcgacctcagtcatcttgctcaggagcacccatcttggatttaagacaatggtccccgttgctcactggcctggagctcagactacctacttttgacttcccacatagtagacagaaacacctaccgtggagctaaagaccaaaaccacttcaattcctttttccaggttctcacattttagctaaaggatccaccagttctgcccacggctcccctctgcttggggccagggaaggtcacctcatcccgcagttctcacgatctacggcccactcactggggagccaggaaacagaccctgtgggagggatcctgccacaagtaagaaggagtaactggagagaaaagccaagaaagttcccatcacttagaatgttctagttggcaagcaagcgggaccgcttccacattatctgtatgaatcatgtggccaagagtacacccaactcaagatggttgaaaggaaaagggaaatgctttttctcatacaaaaaagcagttgtggagctagggaattcctgagctgattaattcagtgtccaaaatggcccatgtttgtctgcttcatgatctcaagatggctgcctccattccaggcattacacccatgttcagaggccatagcaaaggggtcatttactccggtgacttctttgaaaaaacacaggacacctacaacattcgttaggcaaaccctgcttggcgttccactttcctggactgtctcatgcatctttgtatcatctggttagtgaagggggtgggcactgtaatgagaagatcattggtcttctcagaatagagcaaagggctggaggtggaactaggaaacccaagagcaaagtcagtatgctcccctgacatctgccatgtatgcagttcatggtgcatgggggggccgtttccgtctctagacagtagggccagcaattccattctagcatccacctgtgattgagaaggctgctttccattgtaagcagagttaggacctgtggtcctctctgatataatcagcatagtcgcacactcttagccactgtcttagttatgcgacaagcccaatgaccaaagcaacatataaaagaaagcctttaattgggcttatgttagagtccatgatggaagaccagaggcatggtgacaggaacagataaacacatgtttatctgcaagcctgaggcagagggagccaagtgaaccccagagacctgcctccagggacacacctcctccaagaaggacacacctcctaacccttcccaaacagttccatcagctgcagagccaggattcaaacatatgaacctaagggggctgtgctcacccaaacctccaccggaaccatagatgctggtttaggatacaaatcccagggcccaagaactggaggcaggatctggaatttgaggctacaaagtgagaccctttgtgtgttgagacagggaggaggaggaggaggaggaggaggagaaagaggagagggttaggctaagagttcctgatatgcaatgctgaggaccagagttgagatcctagcctgcatgtaacaagccaggcatggagcaaatgcctataactccagctccaagggaccggatgtcctcctctggcttccatgtaccagaacacacacatgcacacacacacacacctcacatgagacagagagggagagagagagagagagagagagagagagagagagagagagagagaagaaaaaaaatgcacacaatcccaacccaccctgtcactttggcataacctggccatttgtctatgctgagcaccgatggttcccctcatcttaatagatggctggcagacagccctagggctagaattactagtgaggccagacaccgggaagaaaaggatggttgaacaaagaagtctactgaagaaactcaagggagagcccttggcctcactgaaacggggtggggtggggtatgtggaggctacactggccctaaactatgtcacaggagctgaccttgaattcctgagcacagagatttataggtgtgtgccaccatgcctggtttctgtggtgctggggatcacactggggtacacactgcaccccctgagccttggctacagcccactggaatcatcgctctttcaccagctgaattagttgaagtaggtttctgtgtcgcttgcaccaaaaatcctacgaagagagggccttgaaggaatgggacccctatctactagtgacctgccctccctcggcagatgcagagaggacagatgagaaccagtctctcccaaggtgcccaaagctgggaaagaagacatgagagacagatggatggaggcccacctgcttgcctaagtaaaaggtcatcaggagtaactatgagtcactcccctgtagtggtgtgggtctagcttggatgcatgccaacaagttctgtgttgaaagtgcatcctgtgctaaggagatagatcagtcagtgaagtgctcagtgtgcgagcatgaggacctgtgttcgattcccagaacctatgggaaatgtagtcaagacatggcggcatgtgctggaaaccccaggatctgggagacacagacagggggaaccctggggcttgttggccaggcagtcaagtcagtcggtgagtatcaggtaagtgaaagaacttgtctcaaagggggaaaacaggagacactgttaggaaaagtattggctcaggacactccaagatcaagttctcagcacaaaggaggtttatttgccccagagggacagagggcagggaatcaggagacaacaaagacaggagatggggggtgatggagaaggggaagggaacaaggcagagagaggaggggtgtttctcccagagtgggacaaaggactgcctctgtatagagaggagacaggcatggcccataggcaaacagtagtctttaagggggaaacccgtgttaggatgaggtgtttaattttaattggtcatgttaattaggtgagccaaggggggcttttgattgctggaccctggtggtctcagaaggaggaaggatccaaatgaggaaacagaccctgggggctgggcatgggagggaagggcaagacctcagagccatgctggccatgcatgagctggccagggtcccttcagacacacctgaagagaagtgacacctaaggtgatcctccagctggcacatgcaggtgcacacacacagaaatacacattcacacagaaacgcatacatacacacacaggcacacacacacacattcgcaccttagcctacagatatacacacctagaaagacacaaacacacacatccacaaagaaacacacagacatgcacacacacagaaagacacaaacacagaaagatacacacacacacacacacacacacacacacacacacacacgaacattaatccctttgtaagccactaaaaggatggacacttaatccaactacgatgcttagatgctcagaggtggggcctctggggctgcatcagtgaagtcatccgggtggatccctcatgattgaacactggcagctgggtgagcagagaccaggagacacacgtgtgctttctgtctcccgccacgtgacaccctgaggactctcaacaaaaaggccctcggcagatgcagttcccgagagcttgccaaagtaaagcttccttcagaactcatccaatctctgtcaccaagttactggcaacaaaaaaccggttaatagaccctgaacaagtattcccgaaacagtctctcacctcgctcgcatcacagagatgagcggctttgtactccgtcccctaatctacgtggtgagccgagaattgggaagaaatgcagctgctcacagctgtgggtggatatggagctacggtagagaacagagaggctgctgggagccttggtccttgaaacaagatgctaggagttttggtcctgacataagagttgatgaatttgggactaaagacagagaggatgctgggagctaggcactggacaggaagtgtgtcatgtgatgatgacccttggttgacctggatatacaacagtttagaagtgatggagagaaaataaaaagccgagcttttcagaatgggcatatgttgacccagtttacctgctgtccctgagtcctgtgagaggcagaggccaccagcacctcactttcttcctcttcttggtcctatgagtcataagcctgctccaggccttcaggtggccacaggggtgggttcaggggaacccacacccaagaagaaaaaagagagcaaagtttggagggatgagtcagccccccaggatgaggaacagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccacgcaccccctatgggtttcccaagcagcttctgcacaacccccgtgcatcttccccgcatctcccgtgtgtcttctatacattcccccgtgcatctcccgcgcctctcccacgcatctctcgtgcatcttccgcgcacactccggtgcatctcctgcgcatcttccccgtgtctcccgtgcagcgtcctctagggagctccgctagtccaggctacgcctgcgcgcacacgcacgcacacctttgcaccttcacacgaccctcacgaccttccgctctcccaagtcctcccccactggctcccacgacgccgtcacgctcacgccctgccctcgcgcccgggtccgcatgctgtcctgctctcccacccccgtgcgcgcccttccgcgctcccgtcctccctctccccgcattgtctgggcccctctgtccccgtccggtccccgccccttagctgacgccacgcccaccaaggcgcgcagtgggcggagcagagggcgggactggactcgggggcggggtcgacggcgcgggaggtgcaggtgccgggccgggagcgagcggcggcggcggtggcggcggcggtggcggcggcggcggcggcaccatgggccgggcccggcgcttccagtggccgctgctgctgctgtgggcggccgcggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctcccctccccctatgtccccaagccctccttctccaggccgggtcccactgtccttcggtcctagtctatagatctctctctctctctctctctctctctctctctctctctcattttcccccagcccttgtcctctgtccctcagtcttcaagtcctgtccttccttccctctgtcctcctttctccttgtttcccccttcccgtttctccacgccgcctttgtcccccacctctgtccctttttcctgggtcactctgcctgccccccatcctctattcactctgccgcctcctgtgctgctgtcgtccctctatgtccccattcaccatctctctccccgtctccttgacatcctgtatctcttcccttctctgtcccctatcattctcccatttctctagcagcctctgttgcctagctgcctcctttctcctctctaccccactgtctccctctcccccaaatctgcttcctctctccatgcatcctccatcctccttttcccatctctgtatccctcctcgctcctggagaagagtggtgtcaggcagggcagtgacagtatagatgtgtgaagtggcatatagggaacattggcatgtgagcacacacgtggattccacaaatgtctcccccaaaccctcccacccgttcacacatccaagccacacttcacagaagagccccctccaggacatccacatgtctttctcactcactatgggaatctggaggaccccccagcccccacccaagacacggtgaccctgaggctggggacaaggtcaggaaatgtcacctgaatgctcacacttagaaccctgtgtttcttatatccaccatgggacactcccctgcggtgggtcaagttactttgcccaggaatccatcatggggaggctgctggtgagcaaaggcagggctgaggtctcctatagggagttgagaattgggaccaggtggcccagccctctttcctggctccagttctatccagtgagagtgttgaaccggatccatgtctgacaatgtgagggagcttctaagttgagtgctgccacacctgccaccccaagcaagggttgccgctgaggacaaggctgggggcaaagccgaccttagaagttctgcctttcttctgcagacttctgtagttgcttcctaactttcatcagaccctcctttgcgacgagcatgccccaatttcccaggtgtgagcttgggactctgggtacatttccatctgtttttttctttctttcttcttatgcattaaaaccaggctcttgggatcctgcgatcagtgagtccagtaaacatagagcccgaggctacttcaaacgttgacaccccgatgatgttagatacgggaagtctttagaaccttaacacctttacatttctagagttttgttggacatggcggcctgtaatcccagctgctctgctctggaggctgaggcaggagggaggctcgtgagacttgcctgccaggattactacagaatgagttcaaggctagcctgggcaatttagtgatttttctgtttcaaaataaaggcattaaagaaagagaagggggtgctagggaagtagcttgttagtcacaggtgtctagaacccaccaatgaggggctgggggtggggctcggtaagtacttgcctagaattagcagccagagagggactgcaaatatatagctcagtggcaaagcacttatctagcataccaacatatgagggaccctaggctcatttcccagtacagagagagagagagagaggtagagcgagagagggagagagagagagacagacagagagagagaactagattctcaatgatgagaccattctagtgaaatttgacatctgtgaaattatgaaatcttgactcattaggggttgtgcagcccccggaccccttacaccttggaacttgtatgtagcctcagctgactacctacccagctcaggagtcaactctcaggcacttctgggaggtggctctaagcgttgtccctggtctagattttaaagtgattgcttcctggtaccttaatcctttctgtaaacgacctctaaattacatgttgtgggactttataaataggaggcaagcttggcgtcttggggagagctccaggtggctgggtcctagcttctggggcagtctggggcagtcctctctgccatggtttaatgtcagtctctggccttctctgggcctcagtttctctttctggtgagcatggacctcaggggttctatttgtgaagcttcttattgatatccagtttctcttctgtgttttgagacaaggtctatgtacaaaaggctggctttaaactaggtagcccccaactggtctcaacattatagtggtcttcctggctcagactcttgagtattgagattatatgtttttgcccccgtgcctacctttttaaaagctctttatgaagggctctgaccacccgttttagggggtttcagtggccatatatctccttacccagccagcatggatggaagactggaatctatatttgtgcttttcaaacacacacacacacacacacacacacacacacaggcaaaatgtatcctgtctttcctggatcactcatttgctgagaatatgaagaggcagatgctgagagaaagaaggttctaggtggataggatctgtgaaaagggacaggtgcttcccagagatgcgcatgggggtaggggtggcgtgtgacccacagctggaaactgggtgaaaacagaaggaagcagaaaacacagatatgtagatactgagagagaataaagaggctgttaagacttggggagccctcttgagggggactttgttgatcccaagtttctcttctagggtgactcacttctccctgtcatggttctaagtggccacttagagcatagacggaccctcctttcatagtgactcaccccaaaggctgggtcttgggagatggctatcactgacccctgacccactcatggactggatgcctgggtccccagaatgtgggggtgggaggtcaggttccaccacagattccaagaccttagacccagcagggcttgggctcaggggtgggttaatgtcgtgcgagcctggcctgtccccgacttggggaacacaaaggcggctttc

SEQ ID NO: 1802 - DNA, 984 bp, Mus musculus
atgggactcccaaggcggctgctgctgctgctgttgctggcgactacctgtgtcccagcctcccagggcctgcagtgcatgcagtgtgagagtaaccagagctgcctggtagaggagtgtgctctgggccaggacctctgcaggactaccgtgcttcgggaatggcaagatgatagagagctggaggtggtgacaagaggctgtgcccacagcgaaaagaccaacaggaccatgagttaccgcatgggctccatgatcatcagcctgacagagaccgtgtgcgccacaaacctctgcaacaggcccagacccggagcccgaggccgtgctttcccccagggccgttacctcgagtgtgcgtcctgcacctctttggaccagagctgtgagaggggccgggagcaaagcctgcaatgccgctatcctacagagcactgtattgaagtggtgaccctccagagcacagaaaggagcttgaaggatgaggactacacccgaggctgtggcagtcttcccggatgcccaggcacagcaggtttccatagcaaccagacctttcacttcctgaagtgttgcaactacacccactgcaatggtggcccagttctggatcttcagagctttccaccgaatggcttccagtgttacagctgtgaggggaacaatacccttgggtgttcctccgaagaggcgtctctcatcaactgccggggaccaatgaatcagtgcctggtggctacaggcttagatgtgctgggaaaccggagttataccgtaagaggctgcgccacggcttcctggtgccaaggctcccacgtggcagactccttcccgacccacctcaacgtctctgtctcctgctgccacggcagcggctgtaacagccccacagggggcgcccccaggccaggccctgctcaactcagcctcattgcctctctgctcctgaccctcggactatggggcgtcctcctctggacctga

SEQ ID NO: 1803 - protein, 327 aa, Mus musculus
MGLPRRLLLLLLLATTCVPASQGLQCMQCESNQSCLVEECALGQDLCRTTVLREWQDDRELEVVTRGCAHSEKTNRTMSYRMGSMIISLTETVCATNLCNRPRPGARGRAFPQGRYLECASCTSLDQSCERGREQSLQCRYPTEHCIEVVTLQSTERSLKDEDYTRGCGSLPGCPGTAGFHSNQTFHFLKCCNYTHCNGGPVLDLQSFPPNGFQCYSCEGNNTLGCSSEEASLINCRGPMNQCLVATGLDVLGNRSYTVRGCATASWCQGSHVADSFPTHLNVSVSCCHGSGCNSPTGGAPRPGPAQLSLIASLLLTLGLWGVLLWT

SEQ ID NO: 1804 - DNA, 41966 bp, Homo sapiens
accatgcccagctaattttttgtattttagtggagacggggtttcatggtgttgcccaggctggtctcgaactcctgagctcaggcaatccacccatcttggcctcccaaagtgctgggattacaggcgtgagccactgtgctccacccaattgattcatagaagctctgttagcctcctatggctgctgtaacaaagtactacagactgggtgggtcagaacgacaaatgtattgtcttacagtccagagtccagaagtccaagatcaaggtgtcatcagggccataaacccatagaggactcctacctggctcttcccagcagcagtggctttctggcaatctttggcggtccttggcttgcagctgcctagctccagtctcttcctttgtctttacatggcattattcctgtgtctctctgtcgtcacagggccaccttcttcttttttttgagatggagtctcactctgtcacccaggccggagtgcagtggcacagtctcggctcactgcagcctctgcctgatgggttctagcgattctcctgcctcagcctcccaagtagctgggtctacaggcacgcgccaccatgcccggctaattttttgtattgtagtagagacggggtttcacggtgttgcccaggctggtctcgatctcctgagctcaggcaatccacccatcttggcctcccaaagtgctgggattacaggcgtgagccactgtgctccacccaattgattcatagaagctctgttagcctcctatggctgctgttacaaagtactacagactgggtgggtcagaacgacaaatgtattgtctcacagtccagagtccagaagtccaagatcaaggtgtcagcagggccataaacccatagaggaatccttcctggctcttcccagcagcagtggctttctggcaatctttggtggtccttggcttgcagctgcctagctccggtctcttcctttgtctttacatggcattattcctgtgtctctctgtcatcacagggtcaccttcctttttttttttttttttttttttgagacagagtctcactctattgcccaggctggagtgcagtggcacaatctcggctcactgcagcctccgcctgatgggttctggcaattctcctgcctcagcctcacaagtagctgggactacaggcacacgccaccacgcctggctaatttttgtatttttagtagagatggggtttcatcatattggccaggctggtctcaaactcctgacctcaggtgatgcacccacctcagcctcccaaagtgctgggattataggcgtgagccaccgcgcccggcctagggccacgttcttataaggatgccagtcatagtgatttggggcccaacctacttcagtatgactgcaacttaactaattatatctgcaacagccctatttccaaataaggtcacattctgagtactgggggttaggacttcaacctatgtttttctggtgtggaggggaagcaattcaacccataacaggagctccttatatattcagaatattaggccttgaattgcaaagatgatttctgctgttgcatctaggcggtggaataaaagagctgcaaggtgctagaggcaaggaaagcttttttctttacacaaactcagtgaatattattcctctggtccctgcttctttccaagtcacccctaataccatgaagccagagagaggcatagcaaagaaggctgctgaaggatgagatggaaagaggcgggagctgggagagaacaggatgaaacttctattaatagctcctagtctttgcttgccctactccagggcagcacccctcagcatggtgggtgtaagtgtaggaagcagagccagaatgcaggggttcaaatcctgacactacacttagcaagtcagtttatcttattttatttatttatttatttatttttgagacagagtctcgccctgttgtctaggctggagtgcagtggcgcgttctcggctcactgcaacctccacctcccgggttcaagtgattctcatgcctcagcctcctgagtagctgggattacaggcacctgccaccataccaggctaatttttatattttttttaagtagagacggggtttcaccatgtcggccaggctgatcttgaaatcctgacctcaagtgatccttccgcctcggcctcccaaagttctgggattacaagcatgaggcaccacacctggcctaacaagtcagtttagaagccagatgtggtagttcaagcctattaattccaacactttgggaggccaacactggaggaatgatggaggccacgagttcaagaccagcctgggcaacatagtgagaccccccaccctcccccaccgtctctattaaaaaaaaaaattcaatcagccaggcagccagacacgatggctcatgcctgtaatcccagcacttcgggaggccaaggtgagtggatcaactgaggacaggagttcaagcccagcctggccaacatagtgaaaccccgtctctactaaaatacaaaaattagccgagcatgatgacaggcatctgtaatcccagctactcaggaggctgaggcaggagaattgcttgaacctgggatgtggaggttgcagtgagctgagattgcaccactgtactccagcctgggcaacagagccagaatccacctcaaaacaaacaaacaaacaaacaaaaaagctctctaaaatcagccaggcttggtcacatgggcctgtagttccagttactcaggaggctgaggcaggaggatcacttgaggccaggaactggaggccgcaatcagctatgatcctgccgttgcactccagcctaggcaacagagcaagaccgtgtctcaaaaaataaaaaatatcagctcaatttaggcaagtgagttaacctcttgtattggtgtcctattttgctgtaacaaattagcttagatctagtggcttaaaacaacagaaatttattctctcacagactggaggtcagaagtacaaaatgtgtctcatgtaatcaaaatcaaggtgtcagcagagcagtgccctggtcaagagatgtccggggtgagtgatttccttgtcgttttccagcaggagctgcatttcttacatttcttggttcttggccatttctccatcatcaaagcccgcagcaaataccttctgtctcccaccctgttttcctctgcttctctcccatgacttacttttcttctgtctacagtcaaatgtccctgtccctccttcctccaggggcacttctgattacacttagggcccatctggataattaggaaaatgttcctgattaagttccttaacttaatcatatctgcaaagacccttttttcctttaaggtaacacccataggctccagggcttaggacctggatattttcggggaccatctctcagcccaccacacctctctaatcctcagtttccgtgtgtgtgtacgaaataggatatttacagattcaccaataatatagataatactctcaaaacagtacccactgtaacacaaacacaataaacttgagacggggagaaactcatttaaagtctcctgttttaggccgggcgccgtggctcatgcctgtaatcccaggactttgggaggtggaggtgggcagatcgcttgagctcaggagttcaagaccagcctggagaacatggtgaaatgttgtctctacaaaaaatacaaaaattagccaggcgtggtagtgcacgcctgtcatcccacctgcttgggcagctgaggtgggaggatggcttgagcccaggaggtggaggttgcagtgagctgagatctcaccactgcactccagcatggacgataaagccagacgttatctcaaaaaaataaaaagtcttccctttggacctcagtttctctgcctggaaaacgggggaagagggttattggactcaagggtttaccagctcttccactccccagggaggccctgagtggagaggtcctctacatctaagaggtgtccaggccaggatctgaaagccacatcagtgtggcctgttaggcgtcccagaaaggggaggttatgagcgatggccctttccctaccagcagctcagccaccccccatcccccccacctccccaaccagagaaggaccttcccagcggccaggccagagggcagtcacttcatcatggcaggtggcaagaggatgagggagccccaaacaggtgcacacacacacacacgcatgcatgcaggcacactcacacacatgcatgcatacacacactcacacatgcacatatgcacacacacacacaggcacacaaacacgtgcgcgcacacacacatgcacacaaacacatgtgtgcgcacacacgcatgcacgtacactcacacacatgcacacgcatgcacacacgcgcacacatgcacacacgcacacacacagtgtccctgtatctctgtgtctattttgtgttctctgaaggcaactgtgtgttgttttctctaactcctctgtcagtctcttatcttctctctctccctgcttgcccatttttctttctccctgtccttgttcttcggttgctgttttctgtctctctcactccccccacacccccatctcagatttcccctgagccagtctgtctgtgggtctcttctctctccctctccctcatttccccacctccatctctatccccagctctctctctctctctctgtctctccctctctttgcctcctcctctatcaccctctctgtctctgcctgaaattctcctctccacaggctggggaagcccccgaaacccatgggcctcacccatgatcccgcaggcaggcaagagctgggtgaggcccaggtgagtcatgaggaggaaggagccgacatccctgccgtgtttctggagagtgtccaggtcctgatccctgcatttcccttccctttacacgtcagcagaaccttacaggtgtgtgtgtgtgtcacttgagggagagacagagagaaagaatcagaaagagaaacagaaacaatgacacagaaagagaaagagagccatggggagagacagagaaaagggagaagcagagataaaaagacatgaagagagagacaaacagatacagagatcgaggtacagagagagaaagtgatagagttggagagagagagagataggcattgagagagagaaagagggacagagacaaagaaaacaacaaaacagagagatagaaaaagacaaagacacagggagagacagaaatttcaggaggcgagggcagccttgggcagggatgagtgggctctgaaatacctctcattcgttaaagaggaaattggctgagcatagtggctcacacctgtaatcccaccactttgggaggccaaggcgggaggatcactcgaacccagcagttcaagaccagcctggggaacagaccaaggctccatctctacaaaaaacacgaaatatgagaaaatagccaggcatggtggtgcacacccctaggtcccaactactcaggaggctgaagtgggagtttcgcttgagcccaggagttcaaggcagcagtgagctatgatcatgcctctgtctcaaaaaaaaaaaaaaaaaaaaaaaagggaaattgggaaattgtggcttagagaagtgaggtcatcccaccaggaagtggtagcagcacagcacacagctccgcatgaccctcaaacctgagttttctcttcactgagagatgccccctacccaccccagacccatttcataggtggcaaagccggggattgatggagtgaagccatctgcccagggtcacccagaagcaagtggctgagctgggtctcaagcctgcttggaccaacaccccaactgtctatttccccacctcatgtacattccgatctagtttagttttcacaccagcccaagagggatccccttctccagctgagaaaactgaggctcagaaagaagaatgtcattggcccagggtgacccagccagggaagtgcccacttcagcagctgacgcgtgataactgttgacgtcagactcaatgacaggcctccatctcccttcctactccaggaagaggtgaatgtccagagttgcaacaatgataatactggcagctatcgcttttattgagcacatactatgtaccaggcactgtggcaagcatcttaggagcattcttctttttgtttgtttgtttgtttgttttagatggagtctagctctgtcgcacaggctggagtggagtggtgcgatctcggctcactgcaatctctgcctcccaggttcaagcaattctcgtgcctcagcctcctgcgtagctgggactacaggtgcatgccaccacacctagctaatttttttgtattttttagtagagacagggttttgccatggtggccaggctggtcttgaactcctgacctcaagtgatccacctgccttggtctcccaaagcactggtattatagacgtgagccaccatgctcagtcattttaggtggattcttttacctccgcagtacaccagccctgggagggtgatacttgctatctctactttccagataaggggcttgggcacagagatagattaagtaacctgctagaggtgacacagcccatatgtagatgcaatttagattttcacaatctgagaccagctcccacactcttaaccattgggctatactacctcttaggaaattctctgggagttctttttttttttttttcagtctcgcttttgttgcccaggctcgagttcagtagctcgattttggctcactgcagcctcaaacccctggggctcaagtgatcctcccacctcaaccagagagtagctgagaccacaagtgtgcaccacgacacctggctaatttttctatttttcatagagacaaggtctcgctatgttgtccaggctgtaattttatttttttatagatacaaggtcttactatgttgcccagggtggtctcgaacccctgagctcaagcaatcctccagccttcgcctcccaaagtgctgagattataggcatgaaccactgtgctcaccattgggagtttttttgttttttgttttctaaccttatcttaaaatcattagcttacagcttcaatgagttagtaagaatcacatagtacaggctggaagcggtagctcatgtctgtaatttcagcaatttgggaggccaaggtgggtggatcacctgtagtcaggagttagagaccagcctggcagacatggtgaaaccccatctctactaacaatacaaaaattagggccgggtgcggtggctcacccctgtaatcccagcactttgggaggctgaggcaggttgatcatctgaagtcaggagttcgagaccagcctagccgacatggcgaaaccccatctctactaagaatacaaaaattagggctgggcgcagtggttcaagcctgtaatcccagcattttgggaggctgaggcgggtggatcacctgaagtcaggagttcaagaccagtctggccagcatggtgaaaccccatctctactaaaaatgcaaaaaattcgccaggcatggtggagaatgcctgtaatctcagctactcaggaggctgaggcaggagaacctcttgaacctgggaggcagaagttgcagtgagccgagaccgtgccattgcactccagcctgggtaacaagaaagaaactccgactcaaaaaaaaaaaaaaaaatagccaggcatgcctgtaatcccaactactcaggaagctgatgcatgagaatcccttgaacctgggaggtggaagttgcagtgagccgagaccacgccattgcatccagcctgggagacaaagtgagactctgtctcaaaaacaacaacaacaacgacaacaaatcacatagtataatcattattacagcagtagaagtagctaccacttactcatcccctacgactctcttcctctcctaatctgttccagccacactgacatctcttctgttcctagaatctcatcaggcttccacctcaaggcctttgcactggttgttcctgctccttggaaaggttccctgcccatctgccctacttcttccctcactgcattcagcctctgcttgaatgccacttgctcagggaacccctcctggatcacccacctaaaacagctcacacctcatttgcacccagatacttccttcagcctgctttgttttctccagtttgcttatccctctcagacagtgaaagattagataacacatatctgctccccactgtcaacacaacaaaaggtgggaactttgctttgcttcctgctgtgcccctagctcctggaccagtgcccagcacaaagtaggtccttggtagatgttaaaggaatgtgttgagccctccatttcggccagcagctattccaggcattgcacctacattaaattgctctgtttagttagatgcatcctaagacggggagacaattttatctttagtattttattttacttaaaaaaaaaaaaaacttggccaggtgcagtggctcatgcctgtaatcccagcactttggaaggacaaggcaggtggatcacctgaggtcaggagttcgagaccaccctgaccaacatggtgaaaccccatctctactaaaaatacaaaaattagccgggtgtgctggcgtgcccctgtaatcccagttactcaggaggctgaggcaggagaattgcatgaacccaggaggcggagattgcagtggccgagattgcaccactgcactctagcctgggtgacagagtgagacttcgtctcaataaataaataaataaataataaaaagaaagaaaaaacttattataagccttttcaaacccacagaaaaggagacagaatggcataatatgcccttatatactgattacctttatataattgatacaaccatttggctattttgcctttattttctactcaagtatttatttatttattatttttttgagacagggtctcgctctgttgcccaggttggagtgcagtggtgcaatcatagctcactgcagcttccagttcccaggttcaagcggtcctcccaccttagcctcccaactacctaggactacaagtacgggccactgcacccagctaattttattttatttttaatttcttttggaaagatgagggctctttatgtttcccaagctgatcttgaactcctggccccaagtgatcctcctgccttggcttcccaaagcattggtgttacaggcatgagccacctcatctgacctcttctaaaatattataaaataaatacagacatcaaaatgaaaacaaaagaaaaagaaaaaacaaaacaaaaatccccaaaacaacaacaacaaaaaatgcagacatcaataacattcaccactaaatactctagtaagcatctgcaaaaacaaacaaacaaacaaaaaccagaatcccacctaagcatacagccattgtcgtaacagtgatatctacttttttggctgaagtgtcttttttttttttttttttttttttctgtgagaaggagtcttgttctgttgccaggctggagtgcagtggcacgatctcggctcactgcaacccaacctccgcctcccgggttcaagcgattctcctgcctcagcctcctaagtaacacacacacgccactacgcccggctaatttttgtatttttagtagagacggggtttcaccattaagtgttttaatgtaggtgcaatgcctggaatagctgctggccaaaatggagggctcaacacattcctttaacatttaccaaggacctacttcgtgctgggcactggtccaggagctgggggcacagcaggaagcaaagcaagggttaagtgttttaagtgtttaagagatgcatatttcaggatgcatctctagataaggacattttccaaaataccagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccaggtaggggctgggtcccgaacgcctgcgcctggaacagggtctaattgagggggttgggggttgtcagaggatgagttggaggaatgcggttcagtcctcagcatcctccctaatcaaataatagtaattctcgtgctttgtgcaacgccacgcggcgcagtacctggcactcagtagctaaggaaatattagtggagcaaaggcatttagctttacataatttagtgagtgctttttttttttttttttttttttgacagagtctcactctgtcgcccaggctggagtgcagtggcgcgatctcggctcactgcaacctctgccgcccgggttcaagcgattctcctgcctcagcctcctgggtagctgggattacaggcgcctgccatcgcgcccggctaatttctgtatttttagtggagaccgggtttcactctgttagccaggatggtctcaatctcctgacctcagatgatccacctgcctcggcctcccaaactgctgggattacaggcgtgagccaccgcgcccggcccaagtgttctttttttaaatggagttcttcgaagcctcttccttgcaatttcaaactaggcgatgggactttattaatttcgtttcgcagaggaaactagggcacagagaggttagataactggcctaaaatcacacagccagtgcttgaatacgcaggatctgaccctgcagcgccccccagcgctctccacgctgctgggtctccccctctgagaaacggggggacaggacccccttttacaaaaggcccaaagggaggctgactgagcggcgcagagccagtgctggagacccgggactgtccctcaggacctttccctctcactgaggcgactctcacttacttccccggaaaatgtggggggctctgggtcgaggaattcgagaaggaactgagtcagggcgggtggccacagggtgttggggccgcgatgaataacccggaaagcgctcgagaccgcgggaggccgggaatgagtaacagctccgggatactccgaacgcgcagctggaaagggatgtccgggaaggcccggaggtcggggaccgggcctagggactgggctgcaatctcggggcggagcctggggcggggagagagtgtcggggaggagccagagggcggggctggaacctcaaggaagagctacgggagaggttacagaccgaggaagagctaggagcggggctagaacctcgaggcggagccagagggcggggttataacctcgaggcgtaaccagagggcggagttataacctcgggaggagctagaaggtgggactagactcttgaggggcaggattataacctcggggaggagctagagggcggggctggaacctcaaggaggggctaggggcggggttataagcttggggaggagctacggggctgggctaggacctcaaggggccaaggggcgggggttacgacctcggggaggagctacagggtggggctgaaacctcaagaagggactggggcggagttatgacctcaggggaaaactaggggcggggagagctaaagggcgaagttagaatctcaaggaggagctagagggagggactaaagcctcgaggaggagctaggggcggggttatggcatcggggaggagctagggggcgggaagataaggtcaggaagagctaaagggcggggctagaacctcgacgatgagtctggagcggggccaaaacctagttggagagctggagggcggagacagaacttcgcgggaaactagagtatctaacaatagaaactccggagggctgatggggccgggcctagaatttgggaataaattagtgggccgggagaggctctggagccgggtagaaccagggggagtgagtggagggatagttccattagggcactgggagtgacggtataacataaagatcgacgcgggtggggcaaggctagaacgtccccagcagaactggagaggcgtaatcgaccgagggccggtgcggtgagaaggacctaataggagcaggaatagaacgtactgatagagagggcggggatacgactgtcaggatatacgcctcacgaggacagaatgaaaggaaaaacgggccaaggcaggactttgggaaaggacttgtgggcagggatagaacgttcagttagtggggtggaggtagaacgtggacaacggacagactggaagtaccgccggccggaacccagcagaacatggacacgaatctgaatggacggggcctggagacttggtgttggtattgggacatgcaggggtgagcgggggtcttggagctaagcgtagttaacctctcctctcctctccctccttcccccagcctcttggggcctgcggtgcatgcagtgtaagaccaacggggattgccgtgtggaagagtgcgccctgggacaggacctctgcaggaccacgatcgtgcgcttgtgggaaggtgagcttccccccaacccacacacccctccagcgcagcatggaacgcgagtgattgagaaaccttcctcaccagtaactgggacatgcaaactaaaaacaaacaaacaaggagagcccatttcacacccaccagattggcaagcatttaaaaatctgacaatacccgggttagtaaggatgtggagttgcagaccgtgtctgtggtgggggagtaaattggcacatcaaccacttagagcgattcggcaatatctagtccagatgaagattaacatatgctacagctcaactcctcgccatgcagaaatgccaaagaaccttggccacatatacccagggacacatgtatacgaatgttcttagcagcaatgtttgtgacatggaaaattggaaacaggctgggcactggctcacacctgtatttccagcactttgggaggcagaggcggatgaattgcttgaggtcaggagttcaagaccaggctggccaacatggtgaaacacccgtctccacacacacacaaaaaaggaaaaattagccgagtgtggtggcacgcacctgtaatctcagctacttgggaggctgaggcaggagaattgcttgaacctgggaggtggaggttgcagtgagctgagatcatgctactgcactccagcctgggcgacagagcgagatcctgtcaaaaaaatgaacgaaagagagaaaggtgggccgggcatggtggctcacacctgtaatcccagcactttgggaggctgaggcaggtggattacctgaggtcaggagttcaggaccagcctggccaacatggtgaaaccctgtctctactaaaaaatacaaaaattagccgggcttggtggcaggcaccagttatcccagctactcgggaggctgagacaggagaattgtttgaacccaggaggcggaggttgcagtgagctgagattgtgccattgcactccagcctgggcgacaagagcaaaactccatctcaagaaagaaagaaagaaaggaaaggaagagagagagagagaaagagagagaggaagggagggagggacggagagaggcagggagggagggagggaggagggaggaaggaaggggagaaagaaagaaaagaagaaaatggaaacgactttaagtcagtcagcaagtcagcagcagaagagaaacactgtggtaataattacataatggagcgctctactgcagcttaaagaaggaaatagagctgcagataccaatgtggacacatctcagaaacctaaggttgagagggaaaaaaatgttgcagaatatgatacgttttttataagctttaagaacacatgaaacaacagtatatgaagccaagcacagtagctcacatttgtacccctagctactcaggaggctaaggcagaaggattccttgagcccagaagttcgaggttgtggtgagctatgattgccccagctgggacaacagagaccctgtttctaataaataaataaataaaataaagttacatttgaggcatctcagtactgagatcactaagctgagggtgtgggggagggatagatggatccagaaagtcccagttgtagtgctgtcactacaagagcaggagtgggacacagtggctcacacctgtaattccagcactttgggaggccaaggtgggaggatcacttgaggccaggagtttgagatcagcctgggcaacatagtgagatgccatctgtataaaaaatttaaaaattagcagggtgtggtgatgtaagcctgtggttccagctactcgggaggccgaagcaggactgcttgagcctgggaggtcaaggctccagtgagctatgattgcaccactccagcctgggtgacagagcaagaccctgtctcccggaaaaaaaaattaattaattaattaattgaaataaaatagagcaggctccttgttggggtgggggtggaggcaaggttaactctagaaaaagacagagttggactcaaataacagaagaggcctagcagagatcagccctgggagtggatgaccttgagaccaggagtgtcagaggctggttgagctgagaggagcctctggggtaatgaagatcccctccttgcagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggtgagtagggcagcccttgccatccccaaccccaagccatccccagctcaacctcatcatcatcccaatcctattcttaactttacatcagctgaaccccaactccatgccttatccaagtcccaaccccaacccaacccatctctagctcagctccatccccaactcattcttgaccccatatccaaccccaactcaacttcacctccaatcctatgcccaacttcatgttaccctaacactgttcccaactcaaacccagccctgttccaagcacagttccaaccccatccccaaatcaaccccatccttatctcagactacccaaatccccaccccaacgacacaattactttcatccttaacccaatccccatcctgcatgtttgtatgtatggttgttatgtataacttgcaactctgcccttaacaagctcacacgcatgcatgagacatagatgagatgtctcagtgatgtttgtccatctgactgggcaggagatggtcctgcccaatccattgggacgggagatggtccaagcaatagatactgaggggccaggattcaagcaaagacttgacgttcttaagggaagtcgaaagaggggaagattaaatgggccgcagtaggctgggagaatcctctgcaatagatggtctctgacttgggcagtgaaaaaacaaatgtgaggaaatgtccataataggctgggtgtggtggctcatgcctgtaatccaagcactttgggagaccaaggcgggagaaccgcttgagcccaagagtttaagaccagcctgggcaacaaccataagcccctttgtcgaatttcatggcttcaggctctgatcattttaagaaaaagacttagaaaaggtcaaattttcctaaattcccacaggagaggaagggtggggaaggaatgggtccatggtgcatggatccatccgtgaaagagattcctctttctggacctggtgaggaaggaaatagggtaaggccagtctagtcatggttggtgacatcagtgagcagagtgctgcgtttgcactgggttttctttgttcttcattcatcctgattctgcctggttttcatccatcctgacctcaaacactaatccgctggtggggccaaatcagatgtttgttttgaggaagtgacgagaggatgtgggcttcccgtctcggtgagatgtgcttaaggaaagcaccaatacttgggtctaagtagtgcattcaatcagagatgatagcgaaaatatttaacaatattggtcagtgctgggacaaactcctggagtccgctgctgggcctggtgttgcccctttccatgatgggtcacagggacatgaagggtcctggggagagagttggcagtggtcagggatccaccaggagcttagagcagcagctatcaattcaggaatctaataactgagatacctatatcatccctttttcttttcttttttctttctttttttttttgtttccttttgtttttgttttttttttttgtttgtttgttcgtttgagatggagtttcactcttcttgcccaggctggagtgcaatgccacgatctcggctctctgcaacctccgcctcctaggctcgagcgattcttctgcctcagcctcccaagtagctgggattacaggcatgcgccaccacgcccagctaattttgtatttttagtagagatgaggtttctccatgttggtcaagctgatcttgaactcctgacctcaggtgatctgcccgcctcagcctcccaaagtgctgggattacagacgtgagccaccgtgcccggcctcatccccatttctaatgccattgtaccctgcttgtggcaacttgcatagttggttaaactgcactcagtacttacatgatgctgggaacacagcagggaccaagacagccttgtgccctgcctgactccatgggactcacagtcctgtgtgtgtgtgtgtgtgtgtgtgtgtgtgtgtgtgtgtgtgtgtgtaggggtgacagacccatccatcaccagacagtgactgattattaggttaatgcaaaagtaattgtggcttttgccattaaaagcaatggcagaaaccacaattacttttgcaccaacctaatagatttgtctgggctatgaagggggaaacacaggcagaggggtcagggctgggatgagggaagagtaggagctgtgggaccctagaggagatacctgactcaggtcagggaaggtttcctaggggaagcaacagctaagctggatcttgaaggatgagtaggaatcagactattaaacagctaatggaggctgggtgcagtggctcacgcctgtaatcccaacactttgggaggcccaggtgggaggattgtttcagaccagcctaggcaacatgactctacaaaaaaattaaaaaattagccagatgtgatggtacatgcctgtgatcccagctccttgggaggttgaggcgggaggatcactatagcccaggtggtggaggctgcagtaagctatgatcgcaccactgtaccccagcctgggtgacagagcgagatcctgtaaaaaaaaaaaaaacagtggaaagggttttccagcagagggagcagcagatacaaaggtggccaaaagcagtgtggctggacaaaggaaacagtacagtggggcgagatgagctggaaagcttggcaggggcatgttacacaggggtttctagacattgtcctgggagcactggggcatcacagaagattttaaacagcgaatgtcatgatcgcaattatttatttatttatttttgagatggagtttcgctctttttgcccaggctggagtgcaatggtgcgatctcagctcactgcaacctccgcctcctaggttcaagtgattctcctgcctcagcctcccaagaaactgagattacaggcacccgccaccatgcccggctaatttttttgaatttttagtagagatggggtttcaccatgttggccaggctggtctcgaactcttgacctcgtgatccgcccacctcggcctcccaaagtgctgggattacagacgtgagccaccgcgcccggcccccatttatatttttaacaaattattctgacctcaggacagaagatagactgaaaggaagcaagagtagatgaggggaaaccaacttgggggtgggcgaggttgtccaggtggagaagagggcagcaggactagggtgtcaggtgtgcagaggaagaaaagtggatagatttaagagctattcaggctaggcacagtggctcacgcctgtaatcccagcactttggaaggccaaggcaggaggactgcttgatcccaggagttggaggctgcagtgatcacgccactgcactccagcctaggcggcagagcaaaaccctgtctcaaccaaagccgaacaagagctattaagaagcaggccttagtggtggattagatgtgggaggggacctgcaattctggtcatgatggagtcacttgtatcagaccaacccttctgccaatgacagttgcaaatgctggacaaataataaacaattattggaagtcactggagagcagcaaatgaaaggagaaacttggctgggcaaagtggttcatgcctgtaatcccagcactttgggaggccaagacaggtgaattgcttgagctcatgagttcaagaccagcctgggcaacatggcgaaaccccgtctctactaaaaatacaaaagttagccaggcgtggtggcacatgcctgtggtcccagctacttgggtggctgaggcacaagaattgcttgaacccgggaggtagaggttacagtgagccaagatcacacgactgcactccagcctgggcgacagcgcgagactccatttcaaaaaaaaaaaaagaaaaaagaaagaaaggagaaacttgaggcgctacaatctctgaaataacagaagtgtagaatttgggttccacagacaacctggctttttcccggagtgcacttgccaatctgctgctgtggaagggaaatagagcccagacggaaagagagtcgctagactgagaagacggaggttggagtttggggctgccagaatgtctggaagatgagagttaaaatcctggaatggatgggaccacagaaaagggagttcccaacctgcaaacaaatctccctcaagtcattggcaagctctacatgcacagggtgagagtccaagaaacttggaagagaaaaatagcaactgggaagctacaaaagcgaacaaggcttccagcagacatgtgatgctggggacacaggttgccaagctgaagaggccttggtaagcatctcaggctttccccctaagaccaccctaggggtaagggccaaagtgaaataggccagccctaaacaagcctaggtccagtccttgacaggaatgaaaacctgactctctgtggaagaagaaaacatcgtttaggcccttgacagatttttatctagaatgtctggcgtctgatcaaaatttacaagatagctaggcatggtggcatgcgtctgtagtcccaactacttggaaggatttcttgagcctgagagttctgggctgtagtgtgctatatcaaccgggtgtctgcactaagtttggcatcaatatggtgatctcccaggagcaggggaccaccaggttgtctaaggaggggttgaagcagcccaggtcagaaatggagcaggtcaaaactcctgtgatgatcagtagcaggattatgcctatgaatagccactgcacaccagcctggacaacatagcaagaccccatctttaaaaaaaaaaaaaaccaggccgggcatggtggctcaagcctgtaatcccagcactttgggaggccgaggtgggaggattacgaggtcaggagttcatgaccacactggccaacatggtgaaaccccttctctactaaagatacaaaaaaaaaaaaaattagccgggtatggtggcacacacctgtaataccagctacttgggagactgaggcaggagaattgcttgaaccagggaggtggaggttgcagtgagccgagatcacaccattgcactccagcctgagcgagagggcaagactctgtctcaaaacaaaacaaaacaaaacaaaacaaaacgcaagactctgtctcaaaacaaaacaaaacaaaaaacaaaaaataaaaaacagtaacaaaaaaccttacaaggtatcctgaagaaaataaaagggaccaattgaccagaaaccaagagaaaaatccaactgtagaaacagaattgtagcaactcagatattggattataggacaggaaacatgaaaattgctacaatcgatatattcaggaaaacagaagaaaggatatgttttagcacctggaatccattttttaaaagagtccaacagaaaatatagaacagtgactcaaatgaagaactcggcagttaggcttgatagaggtcagaaacagcagagcaaaaggattaaagagctagaagacagaacagtagaagcatgtcggttgatgcacagatgtggaagataagggggtctgccaggtttctgccccggggactggatggggccgccttggacgcgtggacttcaagaaaaagagcagttgtgggagaagatggggagttttgtttaggacaggtgttagaggtatagccatggggcctcgaagagacagttgggtgtctggagctcagagagaagtctagactagagagagatttgtgagtgatgagcagatagatggaaatgaagtcatgtcaatatttaccccatgagagagtctatactgtgagagataaaaagggcttaaaacagagccctggccaggtgcggtactcacgtctgtaatcccagcactttaggaggccgaagcggcaggatcatttgagtccaggagttcgagactagcctgggtaacatagcaagaccttgtctctacaaaaatacaggaatcagccaggtgaactggcacatgcctgtagtctcagctactcagtaggctgagatgggagaatcacctgagctcagggaggtcgaggtggcagtgagccactgcactccagccttgggacagagcaagaccctatctcaaaaaaaaaaaaaaaaaaaaaagaaaagaaaagaaaaaggaaaatagccctaaggatcattggcatttacaagagttcacaccagagacccatgagtgaccacccagagtgggcagaactagaaatggggaattcaaggggcagtgggagctcagagcaggtacccgttccaggctgatgggtcagggagggcttcctagaggaggtgaaattgaagatgacagctgaagaatgaataggagttagagaaagtagggctcaaggaaaaggtgttctaggtgtgaacagctatgttggcaatggtgagaatttgtgttttcattttcatggaagtttgtgtgagaagacgtgggtggccttgtagttatttttctttgagggggacgactgggctttggatgtaaatgattcgcctaattacagctagcggcctgccagttgagaaccttggctgacatggtcctctcacttttttaagacttggcctggactcagcttagatgtgtcttgggtcaggacggggagggcatgccaagcatgggaaatggtgtgagccaagggctgggtagaggaatgactctggtgtttccagggaaaagtaacggatccagttggccaacaccacaaggttcgtgcaaaaggcgaagtgatcaggaatcagtcaagtgagtctttgatccctgggacaattaggtagtgtattatctattgcttatctattatctattgctgcattacagattgcagcaataaaataagcatgtgttatttcacaaagtttctgaaggtcaaaaaccctggagtggcttagctaggtggttctggctcaggatccttcatgagcctgcagtcgagatgtcagctggggctgcagtcatctgaaggctcctaaggtagcttcactcacatgaatgctcccctcccatggctttggcacaggcctcagttctgccacgtgaactttcccatggtgctacttgagtgtcctcacaacatggctgctgcttgccccagaaaaagtgatccaagtgagagagccaggcatgtgttctatgatctagccacagaaggcatacaccatcatttccataatatccagttgactacatagggcatccttattcttttcttcttcttttttttttttaatttaaagacagagtcttgctatgttgcccagactagtctcaaactcccagactcaagcaatcctcccacctcggcctcccaaaatgctgggattacaggcatgagctgctgcacccagccagccctattctttaagggcatgaataccagggagcagagattattgggggccattttggagacaggctaccacagggaacaatagaagggttttaagtaattgctcattcattcattcatttaacaaatatgcattgaatatcttatctgtccctggccatgtgccaggtggtgttgggacacagtagtgatcaagacagcccctggccctgccctcctgggggctcacagtccagtagaggagacatacctgtcaccagacagtgaccacccagagtgggatgggggagtacaggggtgtgtgggagcctggtggatcaggaagggcttcctagaggaggtgaaattagagctgacacctgaagaatgagtaggagttagggaaggcagagagcaaaggaaaggtgttctagacagaaacaacggcatatgcaaaggcctggatgccagggaacatgtgtcgtcgcagactgtgggaagtcagtgtggagcagagtctcagggtgtagtggagggagacgaggcaggagaggtgctcaggccccagtatttgataggctttgaatcccatgctgaggatcttggaatttattttcagggcagtagggagctatggaagagtcttgagcagaggagagacagggtcagatatgagtattagaaatatccttctaagggcccgagtgcagtggctcatgcctgtaatcccagcactttgggaggccaaggcatgtagatcacttgaggttaggagttcgagaccagcctggccaacatggtgaaaccctgtctctactaaaaatacaaaaattagcccagcgtgatggtgcacgcctgtagtcccagctattcgggaggctgaggcaggagaatcacttgaacccggggagtggaggttgcagtgagccaagatggtgccactgcgttccagcctgggtgacggagtgagactctgtctcgggaaaaaaaaaaaaaaaaaggaaagaaatgtttctagggccatgtggagatgctgcactggggtgagtagggggtgacaagaatggaaacccagaggctagggaggtagctggagttgaaggaggtctgagctggactggtccatggggctggaaaggagggggtggattctagaaagattcagcaggcagaataggcagggctcaatgactggctgcagggtgggataaggaggaattgattttgagtgagtccttgcagagctggggctccaggactgtccccatggagtctcactcccctccccctcttccaaacaggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaaggtgagccccaacctgctggcaactcctcctccctgctctgctcctccctaagactgcacttaacaaacaaccccaaagtaacagggatgtcagcaagggactaagttctctcatacacaagaggtccagtgataggaagtccagggccacaaggacaggtccagagtcaccaggaacccagatgccttctcatttctttttatttatttatttatttattttttgagacagagtcttgctctctgtcacccaggctggagtgcaatggcatgatcttggctggctgcaacctccgcctcccaggttcaagtgattctcctgcctcagcctcctgaatagctgggattacaggtgtgcatcaccacgccttgctaatttttgtatttttagtagagatggggtttcaccatgttggtcaggctggtctcaaactcctgaccttgtgatccacccgcctcaacctcccaaagtgctgggattacaagcgtgagccaccacgcccggccaccctcttgtttcttacacattacttccattctcaaaatgcctcatagtctaaaatggctgccagagctccgggtctcacatctaagttccaggaaggaggaagaaggaaagaagggacaaaaaagggggcactcctccttttgtaagggttctcctttctggaagtcccataaagcacttctatttatatcacattagtccgaacttcatcacatgactacctggagaggctggaatatgtagttttcgacaagatctatgactgttctagataaaatgagggtcttatgatgaagggtgaagtagagaatggttgaatgcctgctatttcgggcaaatcccatcttagtccctcattcacaatctgacatctgacctctgtcccctggcccccatagggcgtccaaaggatgaccgccacctccgtggctgtggctaccttcccggctgcccgggctccaatggtttccacaacaacgacaccttccacttcctgaaatgctgcaacaccaccaaatgcaacgagggcccaagtaaggaacgggagacacaggcaaggcctggggtcgggcaggggcatgcactcaggcagacagctgcgcagtcactctctggcaatcaagtcctctctgggcctctgtttgcttttctgaaaaatgggagtatcaggcctttttttttttttttttttttttgagacggagtctcactctgttgcccaggctggagtgcaatggcgtgatctccgctcactgtaaacttcgcctcacgagttcaagcgattctcctgcttcagcctcctgagtagctgggattacaggtgcccaccatcacccctggctaatttttctatttttagtagagatgggggtttcaccatgttggccaggctggtctcgaactcctgacctcaagtgatctgtctgcctcagcctcacaaagtgctggggtaacaggcatgagccactgcacccagccaggcctttcttcaaagaagaacttcgtaaggattcaatgatactatcagccctcgccaagacctgtgcttcctgtctcttttgtctctctcaaattttcccactcctcccctgctccactgccaccacctgggctgagccacgctgacttcttgcccaggttgttgcaatgacctcctctctggtctccctgcttccactcctgccaccctacagccaaggctcaacccagcagcgagtgattttttggggggtatgggggggacagggtctcgctctgtcacccaggctggagtgcactggcatgatcatggctcactgcagcctcaaactcctgggctcaggaattcttcccacctaagctactggagtagctgcgactacaggtgcatgccaccgtacccagctaattttgtatttttggtagagatggggtcttgctttgttgcccaggctggtcttgaactcctgggcttggcctcccaaagtgttaggattacaggcatgagccaccatgcaccaccaattttttattttttaatgtaaatcagatcatgtcaccctcctttctcaggcacttcaatgacttccccttcctcttagaataagatccaaagaccttattctgttggcctatgtaatctggcacctgtctgcctcacagtctttgtttagattcgtttttggggttttgtgttttctttagacatagggtcttgctctgccacccaggctggggtgcagtggcacaatcacggctcactgccacctcaaactcctgggctccagtgatcctcccacctcagcttcccaagtagctgggactacagatgcgcatcattgcacccagctacattttttttttttttctgagatggagtcttgcgctgttgcccaggctggagtgcagtggcgcgatcttggctcactgcaagctccgcctcccgggttcacgccattcccctgcctcagcctcccgagtggctgggactacaggcacccaccaccatgcctggctaatttttgtatttttagtagagacagggtttcactgtgttagccaggatgatctcgatctcctgacctcatgatccgcctgactcagcctcccaaagtgctgggattacaggcgtgagccaccacgcccggccgcacccagctaaatttttaaaacttttgtagagatggggtctcactatgttgccggggctggtatcaaactcccaggctcaagcaatccttctgccttgacctcccaaagtgctgggattacaggcatgagccgctgcacctggccttcatttagtttctttctttcttcctttctttctttttttagatggagtctcgctctgtcagccaggctggagggcagtggcgtgatcttggctcactgcaacctccgcctcccaggttcaagcgattctcctgcctcggcctcccaaagtgctgggattacaggcatgagccgctgtgctgacgttcatttggtttctataatcaccaaagcccatctggtctcatggcccttgcagatgaatatcctcccttagaacacatcttccccaagagttcaccctgctggcaacttctcatccattaggcctcagctttaatgtatcatcttcagggatgctttcactgtccctcccctccagtgtaatctagatccctgtctctattacccagcactgtcaacagatagaaatgttccctatctgtcctgtccaatattacagccaccactgtatgtggtcagtgagcacttgaaatgtgaactgaattttaagattcgatttaatattaatttatttaaatgtaaacaaccacatgtggccagtggctaccagattgggtagtgtagctctaaattgtaaattctggctgggcacagtggctcacacctgtaatcccagcacttttggaggcggaggcgggagggtcgcctgaggccaggagtttgagacaagcctaggcaacatagcaagactccgtctcaaaaaaaattttttagtaataataatagtaataacttgtaagttctggccaggtacagtggctcacacctgtactccgagaacattgggaggctgaggcaggcagattgcttgatcccaggagtttgagaccagcctgagtaatgtgtcaaaaccccatctctacaaaaaacagaaaaattggctaggcatggtggtgcacgcctgtagtcccagctactcaggaggctgatgtggaagaatctcttgagccggggtggtcgaggctgcagtgagctacaattgcgccactgcactccagcctgggcaacaaactgagaccctgtatcaaaaataaataaataagttgtaacttttgtgagagcaaggacagtttcatcttacatagttttacccagcacccagcacggtgcctggccagaaatgggactcatggggagttgaaagttggggtttctctcaagccctcgaaaaccatccccctccaaatgccattcagacgcctgaccacaaggtggctccatgacatctctggctcggagtggaagtcctggggaggtcattcaaggaagtggagatccaagcactaattttcttggtctctgtgtctctggtcttctcctaagtcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacggtgaggccctctccgaggctgggagggaacacttattgggggtggagagttccgcaagagattgacttccagttaagctggagttaactgtggtgggtctccctgtggaaaaggtgggatttccttcaggtgggtgaatattattgtaaggaattaggacttgtccatcaggatgtggacatttttgccatggaaaagtggaattccggctgggtgcggtggctgaagcttgtactctcagcactttgggaggctgaggccggaggatctcttgaggccaggagtttgagaccagcctgggcaacatagcaagacccccatctctacaaaaagaaaaatggaattctttggtggatttctcgtgggttgtggggatttgctgaagacatcttgggctttcatcctgtggtgtcctggaaaggtctctgtattccagtggttctcaaactttttggtctcaacttcttcatgcttttaaaaattatttttggccaggtgtggtggctcacgcctgtaattgcaacaccttgggagggtgaggaggagaaccacttgaggtcaggagtatgagagcaagcctggccaccatggtgaaaccctgtctctacaaaaaattacaaaaattagctgggtgtggtggcgtgcacctataaccccagctactcagggggctgaggcacgagaatcacttgaacccaggaggaggaggttgcagtgagtggggatcaccccactgcactccagcctggatgacagagggagactttgtctcaaaaaaaaaaaaaaactctttattgtttatatcagtgatttctatagataaatgccacattaaaattaaaactgagaaccaggagtggtggctcacgcctgtaatcctagcactttgggaggccgaggtgggtagatcacctgaggtcgggagttcaagaccagcctgaccaacatggtgaaaccccatctctactaaaaatacaaattagtcgggcatggtggcacatgcctataatcccagctactcgggaggctgaggcaggagaatcacttgaacctgggaggcagaggttgcggtgagccaagattgtgccattgcactccagcctgggcaacaagagtgaaactccgtcccaaaaaataaaataaaataaaattaaattaaaattaaaactgagaaatcttttttttttttttttgaaatggagtcttgctctgtcgccaggctagagtgcagtggcatggtctcagctcactgcaacctccccctcctgggttcaagcaatcctcctgcctcagcttcctgcatagctgggattacaggcatgagccaccatgcccagcttatttttgtaattttagtagagacggggtttcaccatgttggccaggatggtctcgatctcctgacctcatgatctgcctgcctcggcctcccaaagtgctgggattacagatgtgagccaccgtgcccagccaaaactgagaaatctttaaagatttatttatgaattcatcttataacaataaaaactcattacacattaagataaataacattttaatgaaaaataagtatagtttccaaagaaaaaatgtaatgatagccaggcatggtggctcatgcctataatcccaatactttgggaggccaaggtgggcgggtcacttaagcctagggatttgagaccagcctgggcaacatagcaagatcctgtctctacagaaaatacaaaagttagctgggcatggtggtgcatgcctgtagtcccagctgcttgggaggctgaggtgggagggtcacttgagcctgggaggtggaggttgcagtgaacggagattgcaccactgcactgcggcctgggcaacagagcgagaccctgtcttaaaaaaacaaacaaagaaacaacaaaaaaaaaaccagccaggcgcggtggctcacgcctgtaataccagcactttgggaggccaaggcgggcagatcacaaggtcaggagttcgagaccagcctggccaatatggtgaaaccccgtctctactagaaatacaaaaattagctgggcatggtggtcgcgcctgtagtcccagctacttgggaggctgaggcagaagaattgcttgaacccgggaggcagaggttgcagtgagccgagatcgtgccactgcactccagcctgggtgacagagtgagactccatctcaaaaaaaaaaacaaaaaaaaagcgtaatgagaaaactggcattattttgctgtgttgcacatctctttaatgtccagcttaatagaagacagctgggtcctcatggaagcttctgctttcagtctcttgcaatatcacatgtcctggagtttttggaaaagcccattgtacacttatgagagtgaaaaagccatgtgaaatcacagatctcctgaaagggtctctggggtccctgagccacactttaagaaccgctgctcgcttcctttctttctttttttttctttccttttctttctctgtctctctttccctttctttctttctttcttccttccttcctcccttccttccttctttcccttctccttccttccttcctccctctctctctctttctttcttttctttcccttcttcccttcctcccttccttcttccctccctccctccctcccttccttcctttctttctttttatttgttttttgaaacagggtctcactctgttacccaggctggagtgcagtggcgtgatcataactcaccacagcctccatctcctgagctcaagtgatcctctcatctcagcctcccaagtagctgggactacagctgtttttttcttttttatgtttgtagaaacagagttttgctatgttgtccaggctggtctggaactcctgggctcaagctatcctctctccttggcttcccaaggtgttgagattacaggcatgagccaccacacctggccctgagaactgctgctttctctaggtggtagtgaaggtggcacccactgcaaggtggcaggtcacctactggagaattccagtcctgggcccaggagctggaagtctcactccgtcttctctttcctcagaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggccaggtatgcccttctttgtagtgtctatctttgggaggataaatggtgggggacaccttttcacaggctcctggaatcaggggtcatgtttgaggcccctgcctaggttggaagtcctcctgggggctgcctccacatctatttctggactccaaatgctgacagagcaggagcactgccatcttgaacaaacaccaccattcttagttcctcttgattaaaaatcggctaaatccggacgtggtggcgggtgcctgtagtcccagctattcgggaggctgaggcaggagaatggcgtcaatccgggaggtggagcttgcagtgagccgagattgcaccactgcactccagcctgggtgacagagcaagactctgtctcaaaaaaaaatcagctaaatccagccccaaaacatcagcctaatggctaccatcagcataaccagaaacattccaaccctaagataaacccctctctgaccagaaacatgccaacccccagatagcctcccttccgaccagagactttccaaccccacaataaacttttcctcacatgaaaacattccgaacctagataagcacccccttccaaaactcttaaatatccttagtctgtaaaaaaaaaaaaaaaaaagggctctctaacctaactcagccaaaagcccccctcaggttggttttctctaaaataaacctgtccttcaccgtcaagccacatttcatgtttctttccttttcctttttcttttcttttcttttctttttttgagatggagtttcactcttgttgcccaggctggagtgcaatgacacaatctcagctcaccacaacctccacctcctagttcaagggattctcctgcctcagcctcccaagtagctgggattacaggcatgcaccaccacacccggctaattttgtatttttagtagagacagggtttctccatgttgttcaggctggtctcaaactcccaacctcaggtgatctgcccaccttggcctcccaaagtgctaggattacaggcatgagccaccgtgcctggcctcctctttctttaattcttacaaatgcaagcttccagatcacacactgaacactaaccttctagtcttctcctaaacttcaaaggttgcaactattttgttgttctaaggagacatccccacatttcccagcatgctttgggaaaggagacggatagaagataacctgatggccagaactccctgcatgcactgcagtgaggaataaggacaggagtgcacttcccctgatgtgctggggaccggggataaaggctgggctctatttcccgggatgcctcaggactgtcagaaaaagagacagaactaccatttcaatggcactctaggagcacaatattgaaaaattcatgttcttctcatcatttgctaaggcaacccatggagacaaaaattacattccccatcaaatcttgtggctaatgaagaaaaaataagatatcttcggctggctgtggtggttcacgcctgtaatcccagcactttgggaggccgaggtgggcagatcacttgaggcaggagtttgagaccagcctggccaatttggcaaaaccccgtctctactaaaattacaaaaattaaccgggtaaggtggtgggtgcctgtaactccagctactcggaaggctgaggcaggagaatcgcttgaacccaggaggaggaggttgtagtgagccaagatcacaccactgcatgacacagtgagactatccccaaaaaaaaaaaaaaaaaaaaaaagacatcttccatggtatttgggggcaggtgagggacaaggttcttgtttagggctttctctaatgacatatcaccacctgtcactgtagtggcttaaagaagtgaggtctgtacttctgcctcttgaatatgagtgactctgtgactgctttgaccagtagaatgtggtggaagttttgctgtgctatgttctggaaccaagttttaagaaactttcatttttcactttctgaatcttagaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagggtgagaaaggaagatctcttgagctcaggagttcaagatcagcctgggcaacacagtgagacctcatctccactaaaaataaaaaaaaattggctggatgtggtggggcatgcctgtggtcctagttacatgggaggctgaggcaggaggatcccttgagcccgggaggtcaaggctgcagtgagccatgatcccaccactgtactccagcctgggcaacagagccagactctgtctccaaaaaaaaaacactaaaacccaaaaccatattacatatgtcctgtaaatatacaccactattatgtattcataatacttaaaaataaaaaattaaaaacacacacacacaaatcttacaagcaaggtggcttaaaaccacagaaacttggccgggtttggtggctcatgcctgtaatcccagcaattcgggaggctgaggcgggcggatcacgaggtcaggagatcgagaccatcctggctaacatgatgaaaccctgtcactattaaaaatacaaaaaattaactgggcgtggtggtgggtgcctgtagtcccagctactcgggaggctgaggcaggagaatggcgtgaacccgggaggcggagcttgcagtgagtcgagatcatgccactgcactccagcctgggcaacagagcgagactccactcaaaaaaaaaaaaaaaaaaaacaaaacacacacacacacacacagaaacttaggccaggtgtggtggcttacacctgtaatcccagcactttgggaggccaaggcaggcatatcacttgaggccaggaatttgagaccagcctggccaacacagtgaaaccctgtctctactaaaagtacaaaaaaaaaaaaaaaaatagccggctgtgatggcgctcctctgtaattccagctacttgggaggctgaggcataagaatcacttgaatctgagaagcggagtttgcagtgagccgagattgaaccactgcactccagcctgggcaacagaatgagcctctgtctaaaacacatacacacacacacacacacacacacacacacacacacacacacacacactagaaacttgttctctcacagttctgaatgctaaatgtccaaaaccaaggtgttgaagtctcacgggaagagccacgcttttaaagcgtcaggggaagagccatgcttttaaagtctccggggctgacacctgtaatcccagcactttgggaggccgaggcgggtggatcacctgaggtcaggagttcgagaccagcctggccaacagggtgaaatcccatctctactaaaaatgcaaaaactagccaggcatggtggcgggtgcctgtaatctcagttactcgggaggctgaggcaggagaattgctggaacctgggaggcagaggttgcagtgagccgagatcgcgccattgcactccagctgaggctgacagcagtgagactccgtctcaaaaaaaaaaaaaaaagtctcaggggaagaacccttccttgcctctcctttgcttctgagggactgccagcaatctttgccattccttggcttgtagctgcatcactctaatccctacctctgtcttccaatgtccaccttccctgggactgtggctatgtctccaaatatctctccttataaccccatatcaatcattggatttagagcccactctaactcagcatggaaacatttagtcattaattcaactaaatctgcaaagactttctggccgggcgccatggctcacacctataattccagcactctgggaggccgaggcggatgaattgcttgagggtggcaattggagaccgcctgggcaacatggcaaaaccccatctctacaaaaactgcaacaattagccgggtgtggtggcgcttgcccgtagtcccagtgactcgggagactgaggcgggaggatcgcttgagcctcggaggcagaggtttcagtgagctgagattatgcaactgaactccagcctgagcgacaaagtgaaactgtctcaaaaaaaaaaaaaaaaacaagaaaaaaacccaccttatttccaaataaagtcacatgcaaagataccaggggttagaagttaatcacatctgggcaggatgcagtgccccatgcctataatcccagcactttgggaggctgaggtggcagatcatttgaggtcaggagttcgagaccagcctggccaacatggtgaaaccccgtccctactgaaaatacaaaaattagctgggcatggtgacacgtgcctataatcccagctacttgggaggctgaggcaggagaatcgcttgaacccaggaggtgaaggttacagtgagccgagatcatgccactgcactccagcctgggtgacagagcgagactcagtctcgagcaaacaaacaaacaaacaaaaaagtgaattacatttgcaaagattttatttccaaataaggtcacatgtacagataccaggggctagaacttcaacatatattttacttggaggacactattcaaaacccacaacaccaaccaccagccttagatatatggcccttgatgcccctcccctccatctccagctgttccagctagttcatttttggctccagttcatcatgaagcagatacacaccaatcctgctccaattcctgactcacagaatcataaaattaaaaggttgttgtttcacaccactacgttctggggtattttgttattcagcgatggttaaatggaacagtaatttttgtttgtttttagctaactttccccattataattgccagggagggtaaggccgtttatttacttgatgatttattcctagtgcctggaatatggcaggtgatgaagaaagaaaggagagaagggactgggtgcaatggctcttgcctgtaatcccagcactttgggaggccaaggcaggagaactgcttgagcccaggagttcaggaccagcctgggcaacatagcgagagaccctgtctctacataataaaaaaaaaaaaaaagaaagaaagaaagaaaagaaaaaagggaaggaaggaaagactgcatcttctatggcaacttacaacaaaaattgggccagaagtatatctcccatgatgccctacagcagagatgaggctaaaacgacattttctgagatgctctgtattataattgaggataatttcacctttcccataattccctacaacatattgaggctaggactgcattgcctatgaaactctatggcagagattgaaggttaggattatatatcccatgatgccctacagtggggatcagaggatagaaatacttattccatgatgccctccagcagatattgaggctagggacaaatttctcacgtcctataccatagcttgtgatcaggacctcattgttaacggctctgaagttgttgttcaggaatctttgcttgcaagaaataaaatctgtttgtgctgacttaagcaaaaacggtgttattgaaagtttagaaaccaggcaagagctaggtctccgagtctcaccagggacaggcaacaattgaaaagctgtgtgaaataaaggttgtctctctcttgcagaatcttaatcaccccaaatatgaatctggccccaggggtatctgccagccatcttgctacaggaggggagccatgcatccttaggacagagattgacagacctcgccaaagccagccatagaaggactttttgttatgtgtgaaccagttctctttctctcaaaccagttgggttgcacttgctgtcacttgcactaaatccctaatggacagggtaccctgaagtaggatggggacaggaccactattctatttattattattattattattattattattattattattatttagactgagtctcattctgtcacccaggctggagtgcagtggcatgatcttagctcactgcaacctctgcctcccaagttcaggggattctcatgcctcagccttccgaccagctgggattacaggcacgtgccaccacgccttgctaatttttttttttttttttggtaaagatggtgtttcaccatgttggccggttggtcaggctggtctcaaactcctgacctcaagtgatcggcccaccttggcctcccaaagtgctgggattacaggtgtgagccaacgcgcccgtcaggaccactactcttgtgatgtcttcacatggaatggtgggacttaaggatgacaggtgagaaccaaaccaacatctcccaaggttccccttcagctggagcaggagacatctgtcagagcacagagtgagcgggcctattggctcctgcgggaaaaggcaactactagttaccccttggaccagtattccaaaggcagatcaaacattcctctcccatctagcaaaagtcacagaatgtgagccctggaaagaggattagagactatctcttcccaagtctacagaagctgggaagctgaggactgaaaaagaaggaagttgctcagggctatggatctggggacacaggggcagttagaagcttgggctctcaggacagagaggattgctggagccatcgtcctggggacacaggagttgataggagcttggaccctgaggacagagaggatgctgggagccatggtcctgcttcacaggggttgatgggagcttggacctgaaggacagagaggatgctgggagccgtggtcctgaggacacaggagttgatgggagcttggaccctgaggacagagaagacactgggagccatggtcctgggacacaagggttgatggtagctatggttttgaggtcagaaaggatactgggagctgggtactgaggacagaaagggtgtgtgaagctgaagtcccttgtgggactggatgtaaaattttttagtcggaataaaaagtaaggattttcagccaggcatggtggctcacgcctgtaatccagcactttgggaggccagacagatggatcacctgaggtaaggagttcaagaccagcctggccagcatggcaaaactccgtctctactaaaaatataaaaattagctaggcatggtggcgggcgcctgtaatctcagctactcgggaggctgaggcaggagaatcactggaacctgggaggcagaggttgcagtgagtcgagatcgtgccactgcactccagcctgggcaacagagcgagactccgtctgggcggggaggggggaggggggaaggaaagatgttcataattggcacttctggacctcagtttgcctgacaaatgggcatgagagaggtcgaggccttctttccatggtttctcactctttctgggtcccataggtaatgatcccgcatcaggtctacagggtgtcacagaagtgggctcagggaaacccactcccaggagggagaagggacctaagtctggaggggtgagtcaccctcaaagatggggagagaggaagggcagaggcaaatacatgcagagagagggagagaggctggggcagggagacagcagggaggagaggggacgccagggcttggaaggtgttcacaggagcctctccctcctgggacccaggattcaggcttccttccagttagttcactttcagggggcccctcccggagaatgacgcggaaacacggggttttcaggtcaggacaggagagagggagggagggaactgaccccaccccactcctgagccccagcctcgccctgccctgggagatccttgacctgcctcgacctccggaccctccggacctccagctgcagcctcccctgtcccggtggctcagctcacagcctctcgctagactccagacacccacctgcccgcagcacgcctctcacactcacctttcccacgtcgcactccctcccttacgctcccccgtcacgctggccacgctctcccttcgcacacaccgcaccccacgacgcccgcgcccccaccctcgcacagcctccagcaacaccctgccaccctcccctccgcgcagcgcaagcaccctgcatgccagcaactccgcaccctcgcgcgcagcacctgggcccgcacgcagcaccctcacccaacaccctccatttcccgcgctcaccgagatcccccacctgctcccacgccgctgtcgccctcccgcgcaccccttcccgccctcctcacccctctcctctccagctttcgcaccccgcaccgttcccccaccgtgccgtccccccgattgtctccgggcctctcctccgtctccccctcccctccccggccccgccccggcctcggcgccccgcccccgggcgggcagggggcggggcgcggggggcggggcgggcggcgcgggcggtgcaggtgccgggccgggagcgagcggcggcggcggcggcggcggcaccatgggccgggcccggcgcttccagtggccgctgctgctgctgtgggcggccgcggcggggccaggtagggtcgggggccggggtcggccggccgggctggggcggggggcgcgctgtggtgacagcccggcagcctcggggccgcagaggccgaacaatgcgcgcggggccgggccgggccccctccccgggacaaagcgcagcgcgggccgggagccgggagcgacgagcgggggagggggcgcggggcccggccgccgtgccgcagcccccccacccgcgcaggctggatcccggcggggacaaagggcccgagacccccctacacacacaagtccgccctccccaggccggtcccgctgtccttctgtccagtctctgcgtccctctgtccgcccgtctctgaacccccccgtctggctcctcgtccccctacccttgtcctctatccctcagtctcgaagtcctgtccctccttctgtctgtctccctctcttcttgcctcggtgttcctcatctattctgtctttgtcccctacctctgtcccctggtctctgtccccttttcctgggtcactctgtcccctccatcatcctgtctattctctttcccccggatttctgccctccctctctgcccctattcttggtccctgtctctgtctcgctgtcacccttgtttttctgtccctttttctctgtcccctatctgccccatccccttgtctctgtcccctgtctttctgtcactcgtttctctaaccctttctgtcacctgtctctttcccccttctctgtcccactatctccatccctgtctttctgctgtgcctcctctctctacgcttacagcctccatcccgggatctcccattcccatcctaccttcctccctctctctatccctctgtgcccctgaagaggaattcagtcaggcagggcattctaaagagccctggaggggaacatctgtgtgcatgtgtgtggggaagtgagaatgggggaccttggcgtgtaggcacacacgtggattcagcgaatgcctctccaaaccctgctcacccattcacacacccaggcttgactcacagagaagcccctgtccaggacatccagggagccatccacataccctcatcacacactgtgagaagctggagacccccgaggttgggtgaccctgagaatggggacaaggtcaggaaatgtcacccac

SEQ ID NO: 1805 - DNA, 1601 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagtcctggagcttgaaaatctgccgcagaatggccgccagtgttacagctgcaaggggaacagcacccatggatgctcctctgaagagactttcctcattgactgccgaggccccatgaatcaatgtctggtagccaccgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtgg

SEQ ID NO: 1806 - protein, 287 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEVLELENLPQNGRQCYSCKGNSTHGCSSEETFLIDCRGPMNQCLVATEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 1807 - DNA, 119414 bp, Mus musculus
  misc_feature (1)...(119414): n = A,T,C or G
gcggcagctgtatcactgaatcccatctgagcgtggaaacctgcagcacattacaaagtctacaagcagctcaacaggttaaagagtgccctccaggcgctttagttggtctaagcctcttcccaggcagctgctggtttctggttctttaaggcagccctgcctgatcttagagtcctccttgtagcttttctcctctgagagtactcttcccagctcagctcggttacctttcatcttacggggactctttgcttttactgtttactaaggcaggaaggacctacagaatctggttggtcagtttcagggactttctgaagctcttttgagctgtttaccttcctgcttgaggagctgctctgaaggatggaatgtttcagtctggagaaaactgttacataacatatacacacacacacacacacaaatatacttgtccacacacacaaaatgcagacatgtaaaatgtataaatatacatacatacacatatatacatatttaaatatacacatgtacaaacattaacataaccatatatacgtgttaataaatgtgtacacacagattatgtatatgtgtattgttatgtttgcatacatgtgtatttatgtgaatgtccatgtttatatgtatatatttatttgtttgttcatgtatatgtctatgtgtgcatattgcctgtttatattgtacgtctgtatatctatatgtgaacaagggcataattatttttatatgtggacatgtgtatatctttatgtgttaacaaatctgtatgctcatgttggtatgtgtacatgggtatattaatacttgtttacacattaacatttatatatgtgttcacatggtgcacatttgtgtgtatatgtggatatttatgtgtgtattcatttgtaaactcatgtgtgtatatgagtttatatacatttatatgtatgcacatgtgtatttatgtgtatgttgatgtgtatgtttatgtgtttatatcagaatgcttatgcatctgtatatttgtatatttatgcgtgtgcatgtgtattttgtctgtataagtgtgtataactatatttgtacaaatgtgtatattatttgtttacacatgtacatttatgcatgtgtatgtatatatttatgtagttttgtagatatttatttttgtgtatagacttgtatgtatttcattttatgcatatattcatgttttgggtgtgttcatgtatatatttatatgtgtatatattatatgtatgtgtgtacatatgcatgtttttatgtgtatgcatgtatatggtttatgtgtgtacatatgtatgttcataaaggtatatacttgtatatatttatgtgtacatacaggtatatgtttactgtgtacatgttcttatttatatgtgtacatgtacatattcatgtatgtgaacatgtatatatttatgtgtgtacatgtttatatgtgtatatgtgtttatatttatttgtgtgtacaaatattatgcctccctctgatttcagaaagaatattcaatactcagaggctttgcctgaacacagtaaaagtatatctcttcataatcttgtgttattcccttgtaatattgactatggcctctacatatctgtgttattttcccattcatgtgttcatcactggcccctcttgctttgttctaagcatcatgagtgacaagtctcattttgtttgttttataaggagtcactatgtcagtgcttatacattttgatgagcaaatgaatgaatgaatgaatgaacaaattctcttccaccaaacatttgatgcacattttacaggttacatacatacctacaagagactgtgccttcagtctgggagtggtgcagctgggtccacagaattgtggacttttctcaccagaatatttcatctcgaagggaactgattctgggcagcaaacgcagcttggatgaataacagactaagtgcccaatgggaaactggatgacagagattccagtgttcctacctcttaaagaggtagccctgccagcgtgtggctaaggattacatccaactccaaattccaggctgctcttggggcattgcacacaaccggtaaatacccagtgatcatcagaacaggcttgtgattgtttgggcaaggaaaggaaacccataagcttgagaagaggcctgatattttaggacctcctttagaggttgttctaatttgggacagctggaatgacaaagccctttctacttcccttacacagtgtggccggatttggaagatttttgtcatttctcaggcccctactgctgcccacagcagccctcattttcttcactatttaaaatactgccttccccactgataataagctggcagccagaagccctctctgtgattctagaatgacagtttctatagagaaaacttggtgatatgaagagagccctgaaacagaagtcagaagtgggaaggcccatgaacctccagccagacttaaatgctcttactggctcacagctgcctcccatggaaggagggatttgaggttgatgatgatttgggagttgggaggttagaatttgaccctgagtcagctgctattttgcagtgtgagaacttatcaagaccctttattttctggaagtcttggttcatcattcccacatgatgtatttggaggggctagggcttaaggtcatcctaactgtgtaggttccattaagctacctcattaccaagcaaaaacagagatataaagccctgaaccaatccttcctaataatgaccattcaatagtgacctgtcctgttttgacattttttttcctttggtagaccattcaaagaattgcttctttctttgaaattgtatttgcctatcactcagaagtcagcacaaaattaatacagttaccataaaagcatcaatcagaggtcattttagtcttaaagaactatatacactcaaaggcacctcaagtagagagaggaggctggtgctcactgtgccaaatgctcctcagtcctggtactgccctctggcaagtccaggctgtggcgaggaggctcatcagagggcacagagtggaaggaatgtgactgtgctgctggtctagaaattctggcagtggagtctcaaggacattgtactctcctgttcttcacatgaagaaagaccgttgaggaaaaacagatgtataacaatggtttttgaatggtcgtgaaatgttttttgaatggtcatgactagtaaggttttggctcaaacgctttataagattgattttgcttgtgatgttcgtcctaccaagaggcaaatcaggacagtgagccaaaataccttaactgaacctacgcagctggaatgatgagggctgaatctaggattctttattacaaaattgtctgtcctaacaacaacagctataaaaataataataaccaaagtggagagaatcataagaagtgatagaaacctttgtgttcctgagatctaaagtcctccaatacattaccttggtcaccttgggcaaactatttgactaattagagtgacagtacacttcctaatggcaagagaacaaccaatctttacttcacagtataatgttaaaggactgggtatagcaagcgcttcctgttggttcctaacatgtaataaatgctcagtaaaagtcactgttggtgttattgttactagtaccacttccatcttcctcccaggattgttacaaagctgacaggaaaaacagactgggaaagttctatttgctgtgtgcctgtcagtcatccccgtttggacaactatagaagtctaagggaacgcatttattccagaagctcagaccccattcctcctcaaaatggttcaaattctttgctctgctgccaacagtgatgacgagcaagagtttgactcagtgcccactgtgaatgacgtccttcaacatctcaaagaactgtgtagcaaatgcttttttctgagcttattttaacatcacagggactttgtagctggcttttaacgtttaacatcattatttagagatggtgcttttcaatgaatataggtttgtgacacagggcatgctgggaagacacgaccttagaagcaagctaattctgttattggtcgctgattttgagaacagtggatgtgcattgaaaaaaaaatatgggaaaatgcagaaatatgtggagaaaaatttagaacatccataatgcagtcaatcaaaaacaaagaatgcttatagcattctgttattttgactctgtcctttactctgtattgtccttgtccatgtattgcataattttgatcatacctgtcatataatccatgttttccacaattttttaaaactggaatatgacttcacctcatgttctgttttagattcaatttttatttttatgctttagaatgctgtctttgtctctctttatgtctttctttctctctgtctctcttaactccccccacccccaccccctcgtgcaggtatctctccaagcccagaggaagatgtttaatcccttggagctgaagtgaagagcagcaagtactcttaattattgagccatctctgcagtccatagatgctttttgtagatgcttcatattccaaccaagaagcatagagtgcaacatatttaatcaattcctcttcattgtttaggtttttctattttttactaaccttttcccctgtctgaggcaggatatctaggctggtcttaacatctgcctctacctccactgtcttgggatcataagcatctgccatcatgcccagcattccatttttgtacatcactacatatatgtaattatttattttctttgagaagaatcttgaaaatgggaaataagagtcagagaaaatggacaagtttgagacttcctataaggcttcaatttatcggtttctacagtcctaacaactctccgagtgacactctctggtcagttccaagtatatctggtttttagaacttgctgatgccatgcaaatcagaaggtttagaaggaaagcaatccaccatcttgatttgcaatgctgattgcatgcagcacttcatgctttttagttactgtgtgtcctttcctgagagtggtctgccagtgttctttgctggacagacttgattaatggtaactctgttaaccctatggcaaaagatgccaaaccttgcattcagctacatctggtaggagaccaggttcctgcagcactagtaagagtctgtgtcagctctgatgtttcagtaaaaccagaaagggcaaagtgtctgtgctttattacaatatggaagaagctgtatggatgagcctctgctatcagatttttatgctttgtgactctcagtgcctcttttcttaaatgctgctctagcaggagggagaaatgtgtctgacctttctttagtatttgcttttgacctactgctatgtgcaacaccagtagtcacatcaacagactggactatagagaagagaattagctttgaagtcaggcagatcttaggcatgtctaaaccttttagaggtttactttcctctttttttccccccagcataggtgatagttctaaccctaaggaatgaatgtgttcctgtttttgtggtgttgatgatcaaacccaaagtcgtatgcatgcaagcaatcgctctattcagctttcagagtgcaaaacagtaaaaagtgcttgtcccatcacaagactcttatctgcaggatacctaagctggttctgcagatttcatgctgagctggtgccgtgcacaaagtggaatcagactaaaccttcttgagtatttgatcaaacagactgtaagcaggccttctctgaatctttgtgaccattactcccatggtaaaatggcagctccctttggagcaacaggaaaagtactggaagtcattctgatacataatgtcagggccattacttttgtcttctctttcgaacatgatatcatgagcattttctagttacagtttgatgccagtgtgaatccagccactctcacttgctaagggaccttaggcaagctgcttaacttttctttgccttagcttgtttatctgtaagatacagataataaaatgctgcaaagtgaatgctgtgtctctctataacttgtgagatgaaatcctaacattatccctatatgggatctggaggcctttagaaggcaataggtcagcagggtaaagcacttgtgaatgggatcagtgtccttgtaaaaaacaccccagacagctgctttgtcctttcaatcacaagaagacagtgaaaggatggaatctgtgcacttggaagaagtctcttcccagacactcaacaagctggtatcttggtcttgaatttcttagccaccaaaactgtgaggaatatcggcatggtttgtaagtctcctagtttttgttatagtagtccaaacaatctaggacatatatttgggggtggggggttctaaaaattaaatgaagtaattcacgggcctctgttaggactgtgcctggaacttgcaatctctattacatattattgatatctgctacatatccatgatagtagatcctgatagtgatggtatataattaaactgaacagatgtattcctatgtatgatattagatatttatggttatttttctgtttttaaatataaacttacaaactaagtcatgttggtcatgatgtaattcaggaagctaagttagggcactgtcatgagctctaggctaaactggactctatggggagttctaggccagtccagattgtagagtaaagcactgtttcagaaaacacaacaaaataagccatcttgtagtttgtggtatagagataaaagccaagcagtgagtttaaaactttgggctcgttagatggcttacaagataaaggtaagtactacctttatgcctggcaacttgagtttaatatatgaaacccaagtagtagaaagagaggagagtcttcccccaaatgcctctgacttctacatgtgagccaagcatgtctgtgttcatgtatgtacacatacaatcacaaacaaagtgaacaaaattaaaagtaataaaaagactcaatgttgaagtaataataatatatctaagttatcttacaggccttgattattgatggttctttccagtatccacgcgtgtggaaggcacaccgaggccagtctaagctacaaagggagactgtctcaaaaatatcatcttacaaaaattcaacacttcctagacatatttttggctaattnnnnnnnnnnnnnnnnnnnntttctaggcctttattctgggatcctcctggcaggaaaaaaaaaaaaaaaaaaaaaaaaaaaagccaaatcagctttccccctctagcagtgaagaatctctgatacagcacagctcagggccaagccagcagtttttagataccatttggaaatatccagtagagcaaatgtcaagccttgtcacctgatctggagtttttgggacagaggtttctgctgtagtctttcagctaacaaaactcagggttagcaatagcaattgaaacgttaagtgacaatagagtataattggtgtgtcaaaaggctctgtttaaaaaaaaaaaaaaacagttctgtttgatctgtttaaagaattaatggcctcattttaaagacaaggaaactgaggttcagagaggaaacttgatccaagtctgtggctctaaaggacccaagctttccttccctgtgagcacaacaggatctctttcagattaatcagcatgttttactgctcactgctaggcactggaacatagagctgggtgaaatagacaggcaggggtattaatcacaagttctagtcctgaggttgctgagtgcccaggagaagtaattaagtcatgtgggtggttcattttatttgtagtacttatgtctaaaagccatcattaatccttttaggaagaggcaggggttgatagatcagggttataaacaaaggccggtagggaactagggagggattaactcccactcagaaatccaagtcctagaggatgtggcattttggttggggctgaggaaccaaaagaatacaggggagggacacaccatgtccactcccttcctaaaggcaagtaaaaatagaactatggtcaattcttgctaaatatttgtctttagaacagttacatggccctctcatttagtcccttatttcttacataggtaggcctctaaagacacacccagaaacaacctcacattgaaaaacagaaaattcacacaaaacacacaccagtgtgcatgcattaatatcttaaacatatcacatgaaaatacaagttcttatatttgcagactcacacatacaatcttcacagagagacttacaaatgtgtttatgctttcatacacaagctccaacatatcctctccccacccactactcactcaggcaaataaatgcatgcttttgttaacacacaggagttcacacacaaatctcatcctgcctgtctggttagaggagaatgactaatgggaaatcatgcacaaaggcaagcatcctaggagaggccacgactgggtttacagtgaggctgttgggatggaattaagccatcagatgacaaacttgtcctgccagattgcacctaaaagttgctcagctgaggctaccatgtcccgcagcgctggatcctgggtgatggtgcaagtttgcctgcctgatttccaacttcctccagagtttaatgtcatccagggtcaagctctgttatcagcccaaccccaatgcaggcaacaggcaggaatctctggggactcagaggcaatgcgggctgctttccaaccttaggcttgtcctgacatagtgcaaccccaagtggttagcattaatgacggtttacaaccgtgggccaagcattgggttaaacccttcaagtacatgatttcattttcacaactctgtgagggggatggggtgtgccctctcatctcaccatttacgtggttaagaaaactgcttgagccacaaaaccactcagcaagagagacaaggagctgaaattcaacctggtcatattctattctttccgaggttctgagcataaactgtgcatgccagtttgtctcctccacaccctcttgtgctcaggatggggctccaggccgtcccatctggcttagtgcaggcccatgccatcagcaggtgcttagtgggggcacagaagttggcttgctgaagccatcagcaagagctttaatttccccatctctgaaatggggttgacagtgttgataccgcagggccaaggccggctgtcttgagcaacagagtgagagccgagctccatctaatatattagctgccaccaccctcgcccgtcgcggggatgtaacccagcccccgcccgagtccgggtgcggttccggcgcccccattgttcagaagggtggagacgctgtccacaggggactccccgccccgggtccagctcgcagcccagtggaacagatgatttggcctggaatctgccgcgcgggccgcgtcctttgtctgctcggcggcgttggatgcccaaggcccgcgccccgctctgtgggtagacaaagccggagccgcagcgaacccagccggctccaacacctctcgcgcctcccgacgtcccgccctcttcccttggagtcctctgattggtctgcgccgttacaaagaggccggggagcgggcggatcacgtgggccaacgcggcttccgattggccaggcttcgctgcctatcgaggagggcgggcagtgcgcgctccgcccagtcgctccctccgcgttgaggcccgcccgcggggccggccgcctgtcagagggaggtggcgatggtgctcttggtggcggcagcggcggcaacgctttccttggtcggacggcagggaggagaagatgactgaccgatcgactggatgaatgaatgaatggcggagccgagcgcgccatgaggagcctgccgagcctgggcggcctcgccctgttgtgctgcgcggccgccgcagccgcttccacagcctcggcagggaatgtcaccggtggcggcggggccgaggggcaggtggtcccgtcgcccagcccggggcttcgggaccaagccagcagccccttccctaagaccgcggctcccaccgcgcaggccccgcggaccggtcccccgcgcaccacagtccgcaaaaccggggctacaaccccgtcagccggctccccggagatcattcctcctcttcgcaccagcgcacaacccgctgccacccccttcccggctctggacctctcgcccgccaccccttcggaggacggacacactcccaccacggaatcaccaccctccagacccgcgcccaccacccttgcgagcacagttggccagccgccgaccacctctgtagtcaccaccgctcaggcttccagcactccagggaccccaactgccgagtccccggacagaagcagcaacagtagcggagtcccgcccaccgcacctgtcaccgaagcccctacttctcctcccccaggtgagtcctctggaccttcccccaggcactgcctatttacacaccggcctcgtcaccctggccgcttcttgcccaagagcttcccaagggaagatccgagctccagttaaagtaaacccccaatccctccaaatctagaaagtcttttgtcccccaacctggtgccatgctccatccagagggagctgctgctatatggaaggcttagggtctcttcctaaaacagggttttctggcctttgtcagagtcccagaatggacacaaacttttgtattggatccgcccagaaggccaccctacctgggatatttgggggaaagtttgaaagctaggatggtgctttatcaatgcgcaggtaaaaacctttacgggattcccccagatgaacaatgtagtttgcttacaaacagaaacggcattgtagtccgtgttttctctgcaaataagtagattttataggtcatttgggacaggtgtgtatctaggttgagcaagtttataaattaggttaaatcccttccttgcaccacttcattctgtctcagttccaaggtcagtaattgagcaaatgccatttgagcagggatgcccatctttgcccctttttaaagtaggatgttcattactgctgatgctgacatgccaatttctgtttgaactcacaataggaaatgcagctcttctgctggtgaaagtgttcaagcaaagttaagatacaactgctgttctttcacccttttgcatcttaaataggccaggaactcaaccaataaggcctacgtctttaagaaattcagcaagttttctgagatcttttgctttgcattggggtggagatttgcccagagcacttacttgtctagcttgatctgattgttgacctaattcttaggctcagtggtttactgtggagtcaggtatgaagtttggactataattgagttggtagaagattttcccagatggttaagccttgaatcgtatgttggagcttggcaaaggcacaagtaggaatgcagattattcacccccaaaagccacatttggatctcttttagcttcaaggaatgtactaactagctagtttttaaacctttcatgctttttagctttttataaagagagattgacatattactaaaagttagactagtacctaagtctagactctcgagtccatttttaggtttgaattccatcttattgcccccctttgtcaacataagtatggacaggttcttgtgatcttactttcttcaaccttcagatgcaggttatcatagtccttataggtttgctgtgcaaattatgtagaatggactgagtgtgtatactacacatgtactgaggaagcaaatacaagaggatcaggagttcaaagccagcctaggctacataatacatttaatacaacctggagtgaatggcaagactcaagaaagaaagaaaaacagtagagagaggttaggagaagagagaagaaaattcactaagtcaatgtatacctaactagtgcttagaatagttcctgtgcttgataagcacctgtgtgttgtgttttatttatgaccagctctgttttctgattcgaaaaatatggagaagccaagtggggatttgtgacttctataccttgttttagtaaatagaaaaaggatgagttagaatgtctggagttttaagcacataatatttaactagcaattgcttccttttgatagtatctgataaacatacagttaatgtcatttcacttttgacattttaagaacacaaagataatccttattgccaaaaaagataatcagaaacctaaaagaaaatgacaacagtcattcctccactgctctctagttctggttcctagtggacctagaggttactcctcatagcagtttgttccatcttaaaagttttctttctgggcatatatcaacacagttgtattttcaaataagctttagggctcaggggtagaaacttgtttaatatgaataatcaccatcaaaacttaactagttagtaatttgtaaaattaaaatggaaatatatatatatatatttccatcttgatatagtcacttaactatgtaacataatttttaatttttaaaaaatttttttcatgtaagtaccttggttctgcctgtattccttccaatagtatttttcattgtaaatatggacagagaaagtggacttgtttaaccagtttgttattaattcatttaacagttccatatatatatatatatatatatatattgctttgaaaagcacagagaattcatcatgtatttattatattctctgatagtttgataccaaatcagcacttagaatttaaatcaattttaagtgaaaccaaactgggttcatggatatttaccatttgaactgtttttcataatttctataggccataatttctatatggctgtctttctgtagcaaacacttcaggatatcaaattgaggtcattcacctttgtgtaaatagtgtgtcacttagagtcttctgtgaattcatttacagaattgtctgtgtttagttctcagtagcttgactgactttgtggcctactggtattcaattttagccttacagtgatatattcaaggtgactttttaattatcgcatggactccaatatactttagatagtaagtatagctcttcagcagaggaaaaacttctatatgaatttgaaagagctgatttggcttgcaaagctggatttcctgccattgggcaagatggttgtagaattttatttcaacatttctatgagaactggttaccgtctaatatatcttttgattgggaaggtcttttaaactgctataggaatcagtaaaaaaattccttcctagagatttagctgaaagctcttactaccagtcagttgggatcccattgtttacacaggacactgatctacaaactgaaactagttacccagcaagcacttttctctcacaaacctggtataacactatactgattggttggataaagggtggatggaaaagctgtgatcttactggagagttataatcagcagtaaggccctgagctagtgacaaatgctttcgtgtttgttttacatggactaattaggatcctagaacccactaaagcccagcataactctacattttaagaaatacttctataggcttaggtaaaagtctctgccttagctaacatttgactagatggattgtggcctttgaaaacatgtccaagtctgttttcactgtgcacgtcttccgatttgaggggtgtagttgtactcttgagtacaaataatagctttgcttcttcaattcgtctttctttcacatggcttcatatttcttcactatcctggtcacctctattctgaaccttttcagctttctgtaacttccctagaacacagagcagagctgaacccaatagtctagatatactccagcatagctcatagcagagagagcggttaccttgttctttctgggtacaatactgattttgtaattagtcccctaagcacagcatttttttttttttggtttattggcagcaaaattgtgtggttgactcactgaatacatcaagatatctaactattttaacttatgcatttaaaagatacgtgttagataaatcttcttttatctggacttaaaagtgtttgtgatttttctaaaatatctgaaattttccatgctcttcagattgattatgttaaattcagatgcttgttagagctcaaattgtactccacccaggttgttcacatgacctgcagggtgttcctgcaaatcacgtctaaggacgagtcagggcaggctattcttgcctcactgggaagaagaaatccatggacgttaaaacagtttggaagggaagggataatagcgtatgttagttctcaagggtctctttcagctcttaagttctgtgatgattaaatgtgcatgattcaaggcacatttataccttataaggagtcttaattatttacttatgatcaagactacaagaagagactttggttaagcaagcctcagaagccagtttgacgtctctagcttctctgaggtatggctacaatattacaaatggattctatttgatttgctttatttgcttggtttagtataagaaagggtctagctgtagctcaggctgacctagaacttgctctgtggctcaggctgacccctaacttgtcatcctcttgctgctacccccttggtggttggaggtgccactatgcctaacactttagagttcacttgaaaagaaaaaaaaaacattctagaaatgcagggtcctcctagctggacttgaagatggtttcgttagcccaacggtctccactgttaaagccagagtgctattacatgtagttatttgtgactaactaacatttattttctggaaataaaaacgctataggctccaaggagaagacaggttcaaagccttttatcaaaaacctatgtgtataggttatagagagatatactgtgtgtagatatattggagagcttttcagattttaggaagttaacctaatacatcctggtgtagcttggtgaatatctagtaatcagacttatgaagacagtcataataatatgttcaatatcaacaactcagtgtgggctaagaatcttgagtagccttgtctttgatcaagccaggttttattgtcattcatattcaaagcagggcttgcagaatagacagcctggttctttacctatcttgtaatacatacaagcacttccttccctgccttggataaggtttcactatgttacctaggttggccttctattcataggcttaagccatccttctgtttcagtctaagtaactgcaattacaggagctcaccattgtgtctggattcttaataattttcttgaataattgttgggcccagaccttgcatcacctggcccatatttaaaaaacacacctgagcccaagctttgcttgtgggaatttggcaaaagcaaggtgaagcaaagtcctggcttgagcatgctattcctgtggtgaatatttctttatgcctgcctgagaagggaactaggtggtccaaggcaggctcttatgtcttgagagagggactctatgccagtgattctaaaagctgggagctctctataaacactttttaacactttatgggttactgctcatcagagctgcagtttgggtgtctatcctaagccctgtcccttccctagatcagttgtagcttggttctaaaattgaattgcccttgttaccccctttgcatcccaataaatggggtaggttagagggaaaatatgggcatttgtgataagacaggtgggcactaagaacaccctgcacagccttcttatctgaagacagaatgagagtccagtgggttcgctgtctcttctaccttagagacaggagagtaaacgttaacaccataaaaagattaccagtagcggggacctcaccctgctttgttagaaggggttcacctaaggctaataaagcttaaatcccctttgggatctgttctaaattttggtatcttttgctactaagagtagcaggaaaaatacttaattttagattttctactatttagcattaggtttgagggttgtggaccactaaaatagtaattgcaaacatgctgtcttaaattcattatgtggtttcatccttagaacagtgaggtattattagatagtatgatcctcattttttttcctggtgctggagattaaatccaggcccttgcatatgataagtacaactcctcctttgagctgtaacttcaaccctgttttataaataaggaaaatgagacccaattctctttggtatttactgtattgtacactgctcatcgacctttaactttttgttttataatggtttatggctgtgatattaaacaatagctcatccttttgattagggttcatcttgctttgatggatgtatttgtatgaattatctttaggttcagtcataaggacttcttatattcactgtatattattcctggcctaagtgcctactggtgtgtataaatttcttagtctgattagtttctggaaaataagcataaactccataacattagtttagagtcttttgaataatgtctccaggaagccttctggctagttgaaaatttacacattggaataatctgaccaggtctttttatcttgatttaactaaagactcataaaattaaagtgcattacttttcatcttagcattctaaacatgtgtgcattatccttccagacgtcctggcacccttataaaaaaaaagaatggaccgaagtatttcagtgctgtttttactgatgggtaaattatgggtagagagatgactgcttgagggtacttcatagagcagaagcaaatagagagagagaggatcttgtttagtggaaagaaattagatgctattttttaattacatatatctttattttatgccttttaccttggtcttgacttttttttttgttttctttagatataaaattctttattgttaatttcagcattatattacaggtatttctgtggctacatttaggtctttttaaagtatagattttagtttaccatttctttagtagaaacatctataccatctgcataccatctgcacttgcaactttaaaaagagattttgtttatttgtgataaagaaaataatccatatgtgcttgaatcacagtaaatgtttgctcaaaagtagtaacctatcaggtccttttgctcaaatacatccaataaatttatgtcaaaataactgccgttgtgatgccactcttccccaggtagctgtcagagaactcttccacgttcgtctttatctgctcatgtttccagtgcaaactcctccatgtgttgctcttactctgtctcattcatgggccctacccttctttccctgttatttaagaagccaaattaccctctctagtgaacaatttaccactttgtcctccttcaatgcatcctcaaagcctgattcttccaagagatctttctagatgaacaaaaagtccttgaagatgtcttggtatcagggtgcacggagttgaactctttttgtgcagaacaaaacctctctttttttctgtgactgacttttttccatatatatatatatactttttaagcaacaaaatataaagtattttaagtagcaatttcctttttctcttatgaataatattggctattcttgatacactgctttggtatatgaggcttgtgttgagaaacaaattgtgttgttttgatcttttgaatgacagaattttccttgtagaaatacaattaaagttaatagtgaacagaatgcttctaataattaacaattatggttttcaaagtgttcttagaatcttctataactttccatctaccttgaggttaattactttaatttctgagtattatatgagtgtaaaaggcttagcttctgccctctattgattctgttattggtaagttgataagtttcacatttgatcatttttattatctagctgttgtccttggagtttatttgctgagtttaatcctttggctggttttagtgctcatatttaaatagcagaaagatggtaataagagattaggattgtctacatttctttcctagacactagctggtcctcaatgtaataaaaagaacctagtcataattaaaaataaatggtatgggaaatagcaagctatggaatttgattgggaaactcaaataaatttctcttcttttaaaattttttatttagaaataggaatggtaaaaatctgtttggaaatatcttttttaaaattttttattaggtattttcctcatttacattccaagcatcccaaaagtcccccatacccannnnnnnnnnnnnnnnnnnncccacccactccccctttttggccctggcgttcccctgtactggggcatataaagtttgcgtgtccaatgggcctctctttccattgatggccaactaggccatcttttgatacatatgcagctagagacaagagctcccggggtactggttagttcatattgttgttccacctatagggttgcagttccctttagctccttgggtactttctctagctcctccattgggggccctgtgatccatccaatagctgactgtgagcatccacttctgtgtttgctaggccctggcatagtctcacaacagacagctatatctgggtcctttcagcaaaatcttgctaatgtatgcaatggtgtcagcgtttggaagctgattatgggatggatccctggatatggcaacactagatgtccatcctttcgtcacagctccaaattttgtctctgtaactccttccatgggtgtttttttttattaggtattttcctcgtttacattttcaatgctatcccaaaggtcccccatacccacccaccctcaatcccctacccacccactccccctttttggccctggcgttcccctatactggggtatataaagtttgcaagtccaatgggcctctctttgcagtgatggctgactaggccatcttttgatacatatgcagctagagacaagagctccggggtactggttagttcatattgttgttccacctatagggttgcagttcccattagctccttgggtaatttgtctagctcctccattggaggccgtgtggcccatccaatagctgactgtgatcatccacttctatgtttgctaggccccggcatagtctcacaagagagagagctatatctgggtcctttcgcactgataagtggatattagcccagaaacttaggatacccaagatataagatacaacttgccaaacgcatgaaattcaagaagaacgaagaccaaaatgtagacactttaccctttcttagaaatgggaacaaaacacccatggaaggagttacagagacaaaatttggagctgtgacgaaaggatggaccatctagtgattgccatatgcagggatccatcccataatcagcatccaaatgctgacaccattgcatacactagcaagattttatccatgggtgttttgttcccaattctaagaaggagcaaagtatccactttggtcttcgttcttcttgaattgcattccctcttcaattgcattgccccaaattacatgcaattccagcagatttgctggaagaaaaagagacttcagccaggtatggtggctcacgactttaatctcagcacttgggaggcagaggcaggcagatttctgagttcgaggacagcctggtctacaaggtgagttccaggacagccagggttatacagagaaaccctgtctcggaaaaaacaaaataaaacaaaaaaaaaaaaaaaaaaaaaaaaaaaaacccaaaaaaccaaaaaacaaaacaaacctcccctccaaaaaaaaaaaaagaaaagagacttcatttcagctttccgttctagtcagatatttaacactgtggcaacaaatataactgagtacttatatggtcaatttcttgtcaggctttaaaaatatacatcatttgttcttaaacaataaagaagttaaatatcatcatccccaacttatagatggcaaatactgggactcagaaagcttaagagaaaaggagaccagtgagatgactcagatcataaaggtgatactcaccatgcaataacttgggttcattcccttgaacctacatggcagaaggagagcactggctctcatgagttgacctttgactccacatgtatgtataagtgcactctcatatgtaagcatgcttacacaacacatctacctctccagtaataaatatagtaagggggaaggagagaatagactccctcagttgtgattttccccacacatgctgtagtacatatacacaaaattaatacatgtaatttttaaagaagtaatttacatttatatcaccattgaatagcccaaatagattttcagtatttagtggccaaatgaatgaaggaagtgtggtggtaattagagtaagcatgcagtttattcttgaggactataacgtaatcatggccttctctcttaaaatgaacttccctctagtttttcccttttgctcctattaatagagcatgtggaactctgagagcttatatattacactaattattcatttttattacatgacattgtcctttctatttttcttggctaaaagaaaaacaaaatagacaaatgagaatctgataatttggggggaaagaatagctaagttagaaagctgagttcttgtatataagatatggactttggagtcattttactaatctcatgatttgggcaaataatttcatttataaaatgagataagaactttgacttataaactgtgttatttgggtacttgcacttcctcaagttgttttttctgtttgtttactgtatccaattttgattttatagtcatactataaaatgaaaacaatggacaaaagttatgataagcatgctaaatctctatgtacatgagattaagtcaatgatctgacacagagtcatgtaattggcttagcaagtttggtcagcatctgagatacttgctcagtgtcagggaaatgccattctgaagaaagcatctgtagaggatgctgtctgagacaggaagcctcctgaggcctgacaaaaccacacaatttaggcaggcagagatgacggattaaacgtatttttcttctttaggaaagattagctgcagtctttgatgaaaactgaacataggatattgggtcttttctccattttatctaaagaatttgaaccaaacactttaaagttaattttgattaatgtatctgaagaggatatttgattcttatctttcaccttctataaaaaatcaattcaaaatggaccaaagacctgaatttaatacctgaaacaatgcagcttctaggagaaaacataggggatacccttttagattttgggatgggcaagaacattttaatagaacaatgatatcacagaaactaacttcaagtatcaatacgcagggcttttgtgaaaattaaacgtttctatacagcaaaggaaacagcagagcaaacaacccacatagtgggagaaaaaaattttaccagctgcacatcagacaaggggctaaaatccagaatttacaaagaattgctcaaattaaatgccaaggaaataaaagtgccaatcaacaaatgggcaaatgaaaatacatacttttcaagaaaagaaacacaaatggccaatacctatttttaaaaatgctcagtatctctagccattgggaaaatgtaaattaaactattttgaaataccacctcagccttgtcagaatagatatcataaataaatatgacaacaaatattggacaggatgtggggagaaagaaattttattcaccagtgatgaaaactaatacaaccattgtgaaaattagtttgaagatttctcaaaaaaattagaaatagaactaccacatgatcccactatttcattcctgagcatgtacccagagaattctgcatcctaccacagagatatttgcaccctcatgtttattgctactttattcactatagtaatcagcctagttatcaatcaacaaattactgtataaagaaaatttcctatatatatttctattcagctgagaagaaaagtgaaatcacagatttgcaggagaatgaatgcacttagaatctatgcttttaagtgaggtcacaaaatctcagaaagaacagtcaaatatgtccttcctcatgtccagaatctagccaatgatctatggaaatgtctaagcactgtgcacatggggactgtatagcacgtagaaaagaagacaagaatggctaaatatttggggatggggaaagattgaattcaggtaatggacacaagttatgaaagaggatttaaagctaattgtttttctagttccaattttgtgatgtatttttcatttttgatatgtaaatgaataaaaatatatttggtaataagactgtgaaatccagggtgcagctccagagcttccatcccaacgctatgctgactgttcattcagttatacagctgtaaggtctgcttaatattggtatatgcttttttattaaaatacataaataaaactttaaatgagaaaattttaaacttatttaaatagacactgtttaaactgatcaatatttgaattcatggcattttttaaaactatattttgccaataaaaatctgatttttttccccttaaagatacagtgcacactagaagtttggtttcaatatgcccatatgttttgcaattagatcagatggggttgcttttatactggtaatagaacagctgttctatatgctgccttgccagggagacagctaaagctccaaggaaaggagaaatttattcatttgggagaaggaatgtgttctgcctagtcaaagagaaagtgataaggagcaggaatgttttcaacttacaagaggaatgttaaataaattttagttacccaatgttatgcccttgagataactgattttgaaagcttgtttcagtattacattgctcttagcaactagcatatttccagggatctttttatattttcatggtttactttaaatctgcagcttttacttggtgaatgtgggcaaaggggtaagcggtgagcagagcacgagagtccccaggttcttttcattgtaatgctcattaaagctatgtatgtatgcacacacacacacacacacacacacacacacacacacaagtatagtctcagaaatttttggatattggccactctgaaggaaattgggtgaactgaatagctttttaggttttcttcagtcttgtcaatcatttgtagaaatgtagtctaggtgtgaaaatggctactggaaataatggggggcaataggaggggtcagcatttcaacatgccattttaaagtcttatttttctattgaggcctagttaaaagaagatatcaggcctttactgctgtacatttctcatttggctttatgtaccttacagtcttagttctgagcatacaacattaatagtacaaacccaccacccactaacaacgtgtgggataatgaatagctagacagtataccaaacacacaaagcaatttggctgttgggtattattatactgaattgttggtgtattgcctgcaaacctatcccgtttaactggttttaatttctgtgttagtttgttgcttcaacttgtccacaaatgcaggactgagaggttcagctaatcagtggaatggaagtcagaaccaaattccagcccttctttcattgattttacatattattgaaaggactttctaatggtcttatgtcagattctctatctataaaatgaaatatttttccagtctcccaaggtttttgagaagtaacacataacttaatttgggtttttctcaaaaaaaaggctttatagagtttaaactggtttctagtgtttttttttcaaattatatggtttatatttgccttttaaaagcaaacaaaacgaaaaaccaaaaaaaaaaaaaagcaaacaaaaaaccatacacaaatttatatgtgagtttatatatgttacattttataatatttttatttactttcttgaataataaattgtgctgttgtttttaaagtttgggacacttcagtgccattcgttgttgattaccttgatgaaataaaacataataaatcaggctttatatatctttaatattattttaattgatttttgtctgcttgctcatttcaattttgggacaggacctcattatctagcctgaaatttcactgtaggatagccttgaacttaaatcttactgctccagcctcttatgttctgagattataggcatgggccactaggcctggatcatggctgtcctgatttgaatggatccttctttaccattttaatgttcaaatgtataaatatatgttttagaatatgaaagcaattgcaaagttaaaaggtgaactcagatacattttagtggtaactgcagatattttttataccattattattttcctccccttccctgccactgatataattctgtatgtatctcatgcacaaaaaaccattctttcaaataacttcacaaatttgaatattttaaagtgagatggcttctaacagaagttgtaagtagagcctttagtgttattatgttaatttagttaatcaaacactgagagcttggtatgttcaaattaccatattaggtgcttcctaatacttacaggggaaaaattatcctataaacctttttatcgccaactttaatattttattgctatgcatatcactcaatttttcatagcagtaaatgagatcacttatttgttaagagaacaaaaatgcaagttgaatttagcactctggagtcaaacataggacagatccacgtggaaagatttaccacatttaaacgatttatctgatctcgataaagagtacaaatgtactttacatagtgactaagatgatttgcttggtgttctctggcctagccagatcagtgacttgctcttgtgtgtctctccaatacaaacataatacaaacatgctttttttttctgggttcaagtggcccctaaaaacctaaagcattctgacaccaagcctggcatgtaatagtttcagtcctgtggtaagaaaccagggtgcctacctgcccagctcatgtactgccaaaatgtgtaggtgctatgctgaggacatggcttaaaagtagccctggccttccaaaagccgatataccatgatctgtacttactgaattttgaactgtgaagtctatagtgaatcataatactgttgagaaagaatttaatcatttaatgtgtatggcagtgttaaataattggcactgaagttaatagatacctcatattattcactcaaaattgtcattattatttatattgttttataacctatcaataatgttagtgtaacatcaggaaaacgtaattctagattaataaattagttatcttccttgacagtctgacaagacttttataattaggaagacatacattgtcacagatcaaatttctctaatacatgtttttaatatgcagggtagaaccagtgttgttgcaaaggctatgccctgtcctttagaagggcccagttcaaatgagactcatcgccaaatgtgacagcactaggctacctgaaagctaattcaaaaggcaaatgtaagcacttggtgtaaggggcaggaggctcatgatgccaagaccagttagagagagagccagagagagagaaccagagggggggagaaccagagagagaaccagagagagaaccagagagagagagagagagagagagagccagagaaagaaagagaatcagagagagagagnnnnnnnnnnnnnnnnnnnngagagagagggagagagagggagagagagagatatccagaaccaacagcaataaatgcaatatttcaggaatagcaattggcagtctgttaaatgtacatgcctctgggatcttttgttaataccaggctacaaaaggcctagcaaagtgaaagagtctgtgagttcaactgtattggtttcacattgtttcttagaagataccaaatagactctgcatgtacaagttatacaagttacctggccttcaacattaccctgtaacatgaatatagtaatgcttacttaataaccctatcatttaaacccagctcttcctgacttcaaaggctatgcactttttctctgactaaattgtgttgcattgccaaagcagatgggagaagcagaaaatggaataaagcatcaagtgggtacagaacccattttggcttctgatttttctcaccttttctagcctcctccagcaagctcatattttttctttctcagcacttggatccagttgtacatagtgatgcatgtttgctttcagtagctcctacaaaactcaaaattagatcaaagagtctttctcaaagtcagatatgggtggagtgggagtaacgccaggaggttgtggtaagaataagatgaggacaaacaggtggatgagcatggaaaatgtaaactagaagcaaggagtgactaccagatggttggggctgacagatgaccatgtagtgcttgttagaatttggcaagtgaaaccacactgtgaaatggaagtattgattgttcttgactgacaataggacctttcataattaacttaatatgaactctaagatcatgatgctaatgtataataacactatacaaaagtcacaaacggtcagatgtgcaaatgtgaatgagacttctgacagtcactttaggttgcagctctttccccatctaatcaacttcttagtgaaaagttaagtttctttcaatcaaaggaacagttattttcagttataggaccagctcaatctcatccactcaaaagacattattgatgcatcacacgtaaaattttggcgggtttgtttgttaaaaagaatgaacaaatagcttcagtttgtggggaattgatatgtaacaatagtgctatcatacctgctagtggacaagagcaatggtcaggtccaacatgagatatatagggcacatatatacaatgaaaaacctaatcatgtcagtctcctaattaataatttaatatttagactctgatataatagtcctattaagcacagtaagtaaccccatcccataaagcccaagctgtttaatatgacttaaacgtcttcattatctatctttgtcttcatttccttcatccttcaacttgtgctttagactccagtagaatctgactgccatatattccaccatatacatacttactctgatcattaagagtactgaaggaagcagtcatctgtgaaggtctttttctatgtcagacactaagctttagatgagttgtgtgaccttatttaatactcagaaagtataataagaaatagcattatcatccctgctctgttatgctagaatttaagttttaagactttaaagacagtgaacaaaatttcatagctattaaaatgtagaatcttgatttacattcagttctttctagcctcaaagcctgttttcttaatcattaagctaactagactattttgctttgtttatgccattcttctgcctggagtgtctttctctttagtttaaataggagtcttaattgtaagtatcagaaatcaacacactgatttaatcagaaattgagtttattacaaggatttctagggaatcagaaaattgccaggggaacccaatgtaggccataaagctggcagtgatgcctgatgatgccaccaaatgggctgctgacattgctcctgagcgttggctagagcttggtgagaatactagtacctgggttctgaacatgagagtcggcccttctgccctttgtcgtatacatcatctccgcagccaggaggacctcacgctcagtccttggaccttagtttccctgattgcagggaaggccagggatataagactctgacttaaaccatttgatggagaatccgagctaaaaatatgcataaatcctctacatagaaaaagattctgaaatatggagaaattttaatagcagtctgttgaaaagaatgccagatgtcaaatacctctttcagccacctaacaaaattatttgcctttggaaaacaccattcatgctgtcttttatgcattttatgttctaacgttactgaatgtatgttatgattacttgcttttaagggattcttgttttaagtgtcagttgtctctgtactggctctctgtcttcttatttaaacatgcatgctttattgatgtttgcactttgacatcatctcatctttagcatgaaaggttccactgcactgacgtatacttactacctaccactctaggaagtaagttctacaaaggcagaccccctctcaagcacaggctcctacattaggtcctggtgtgtggtagttcctcagtaactgttggagaggagaaaactcctgaaatcaattatttactttgggaaatgaaatagtagtcagaaagacctttgaatgagtggccagttcagagcattgtgtcatactttccaattagaccagaacaataagtgagtggaaagagtcttatttatatttggtcacctcttcctcttatccagaagtataaccagaaaagggtaattggggacttccccagacctgttactatggttggtagccacaaaaatggcctgaggaaactatagttgcacttttatgaacccattttccccttctccattataaccagccacatctgtgattatcatcttttctgggaagaaaagctgttaggcaaactgtcttgaatttatgtttttttttaaataacccattagaaaattaaaaatagttgaagagatatcttaggaaaatgcttgctgtgcaaagatgcaacctgaatgtgatagtcagtaccaatgtaaaaatccaggagtgatggtgtgggagtaagatacaggagaatacctgcagtatactgtgaccgctctagctgaatcatttagttccaagttcagagaggaagtgtctgtctcaaaaagtaatgctgagagtgatcaaggaagacaactgacatcatcctctggaagatacacacatgtacacacacacacacacacacacacacacacacacactcaccctagaagaacatgtatatacacacaaatggtaaaattaaaattaaaaactctatttgaagaaaggaagtttaatactgctgaaattaatttgcataagcgtattgggatagtagaaatgcagactagaatttttagttgttagtttttctaatgaataaaagtaaaatttagtgagactgaaagagagcttttcaagttgatagttattgtcaatgatagttactatctctggatcaaagctgttcggttataatttgggctgtgatacctatagtatcctcatctatataatgggagttattatatggattaaacaataacttatacagcacttatgatttctgacgtaaattggccttgtgttagctgttccttttactactatattttgaatacctgtttccctttactacttccaattctcaattattctgtacttataatccttccaagtctgataattagtgatgtactatctttgcaatggagagccaaaatttaaaatgaggttaggttgcttacccaataatcttgtggctgggaagtgttagttacaggattcaaacccagatgtatcatgtttttgaagtcattctatcatggcaaatttacatgctataaatagattaaacataatgttttctattatagtcttccttccactccagttagttaaatgaaatcattcactccctcaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggaaaggaaaggaaaggaaaggaaaggaaaggagaaaggaaaggaaaaaggaaaggaaaaagaagaaaatggaaaggaaagagaagaaaaaggaaaggaaagagaagagaggaaagaggtaaaggaaaagaaaaggggggaaagagtttcttacatttgctgtttctactctgaagcttttcatagcacactccaacccagtttttagcaagtcttttaatggcttatcagaaagccaacatttgtatttgctgtacttcttttagtttttaatctgtgtaacagagtatacatttataaaaacatacaattaaaatcagtgctcactagttttccaggactaaagtcacaactgtcaagatgtaattaattttttccttattaaccaatttttgatattttcttccttatttgttgttaactgtacaaatttttagatcttttctttctttctttctatatatccatgctcagctataggttgttaacatgattaaacacattgcattcttacttactattactctgacgattgaacccaggatcttcaccatgctcaggattctaccattcagctacaattccagtgctgtatttatttttatttatacaatagggaaacgtgtacacttttgtgagtaacttcacattgccttactcttagttattattggcagttcttttgtccattcttcaggtctgttagttttccactggcactgaatgcctcttaacctattgctggagggacaaataagacaggatttttgtgtttgagaacacagtggaggataaagaaaattagaccacaggctagtatgggcagagaatttagaggagcaaagattcgactctccactcaaacttttagaagttctaggaggagaatgcagaaagctttctgaaggaaagttttcatgagctgagtcttgaaaatacataggaattgtccagatgatagagaaggtgaatctagggaaagtgcatgggaaaaagtagaggtaagagtgcacatggatgggatgtttgggaagtctctagtggctgagacattgtcagggtgatacagggaacagggaacggtgaagcctgaatttggaatgggtcagcagtgttacatcatgaaatgcttcagatatttattccgaaagcaatgacaagttgcagtgtaagccagaaagtaatatggtaagtttttgctttgtaaagattgtgaaaaatgcattgttcttccaaaagtgtgctgttgaccagcaaacataattagaagccactggctattttcttctcttctggctctaatttggattaaaaagcttgaactataacataataatagagggagcatggattagttagttgtctagcttctcttgttaagaaaacatttaaaacatatttggcttgttggtataatgttcagccttagatgaatcaagtaaattacataaaaccaataaaactagcccattgatgttgaaccttgcaaagggcctggtgtttgtttggccaagtgaaagcatctcctatatgtcaggctgaggagagatggtagatgatttaggcatttgcagcttggtgaaagaataggcttgtacactaatttgaatattctaagtacttacatattatattcttttatatacatttcactttctagccttactgcaaacttataggatctggtaagaaaaccaaggagaaataatgaactttctaggagtcacgtgatatttaattatgtgtagtaaataaatacaattcaatatttgattttttcatttacccctctcatatttcattattttccctgacaaggcagtatttctatactttcagcctgaagtgttccccccttttaattatttccagtaccaaccaacaaactaatatatgagaaaatgttaccaaagcacttaaaagtgctcaaagatagaccctaaaagaccttagttgttagaattgccattggaatagcaacttatctatgttccaaacacttaggaaacatgataaaatcgatttaaactattttattttattcagattaatattggtaaaagggctctttcctggcacatactgggtctctggattcttgttcaggttctgagaaaccttatcatcacagatatacatacatccaataaagtatggcatgagtgtaccttaaacacttctttattatggaaaatttggggaatatgccaaagttaacataataggatcatgacttcttttgtgtctattgtctacctgggagacattttctgggccacctggacaaggcattgtctcatagatacctccatctgattaccttatgctgaatttattttgaaataaatgccagtctttctattatctatgaatatttcagaatgtattttttaaagtagtgggttctccattccaaattgtatttaaataaaacctaacatttttcttaatgtaatttaatggagattcaggaaatcattttcttttttgactaaagaattttttttgtttgcttactgttagataaatttagaaacttgattttgaacatagaaaaaaatgcacaaaatagtgaccccattttttttgctaccaatctgaactgccattaccccaagttgagcactgccttatcaacactgccacccatttaccttgctaaagcaaaaattgagctgcttggttaactggtttttgtaatataaattgatggctttgtgtcattgtctcttatgcactgttaaatatctaccatagcccaactgaggatagaggtagcaaggaaccatgggactgttttgatagtacctgctacagattataatataattcctgattgtaaggaatctgtttcaaagagatgatttatcaacatgagatcaatatgttaagtagttattgagatctgttatttgaacaatgcttatccataaatatatattaaatgtgagaaagtatttgtactccttttttgagatattatttaatgtgcataaatgttttgcctgcatgtatctaagagcaccgcaaatgtgcctcctcctatagaggtcagaaggcactgtatccccatgaactggaattacagaaggttgtgagtcacaatgtaggtgctgagaatgaaacccaagtcctctataagaacacccagtattcttaaccacagagccatctttccagtcccttatatttcttttcagatgcttattacacacataatttttacaattatgtggtttttactttaaatatctaatttttatgttcttcttcctctgtcgtaccctaacttgagacactttagagctaataaagaagatattttgatctacaacagaagaccattcgcaactatgaaaacaactcaagcaaatagtctattggtggaagaacttctcattacaaaatgttctttttaaagtccaggatatttgttgctcggtcactgaggagtctggactgccattcattagcaccctgggtgtctgagcagacctggataggaatgtactgttcattttgaatgagagaaaaggatagagaagctgcctcaaacattgcatcatccaaggcaaatattctatttgtttgatacaagccattgatcttaagagtataacctcagatacaaataagtttcattgtgagtggccttatttttcctgatttctctaggtaagcaaaattgttttatgtgtgctaggtctggtgttgtcagaaaatatgcactttgcctacctttttatttctgttgaattttcaaacccttggatctcataattacctgccaacatgtttcatactgtccatttaataagagtgtagtgctgatcgagtatggctttgatattagctcagttatatatctggaatgtttattctccagagctttccgactgagggagcccagcatgaattcctactttggaaaatatctgagtgggcaggcctgtttgccacattaccctcattgtctgtctttgtttactcagctgaaaagcagtacttgcctctacatagccaggcactatctccaggtctgagaagctattaaagtggttaggaaaattgtttggggaagagaaaatatgaaaattgtttttggacaaactgtacaggtgaaggtgctttcttatgtgaaaagtgtaatgatttttgtgaattatgcagcctaaatctgaaagcatttttgtggaatgttatattagggtttttgcttttatatacctccttaccttctggattagaggcactgataatttactgacacgatttatttgtttttactgcccgtaaaaagaaccctaggtttttaagacagaagctgccttcaggtacaggtgatgatgaacttcctgtggccagattagtaggagcatagtcttggccattttctttggtgtgtttgtctcttgagtgaattattttagcaggctgctaaaatttgtttgccttcattctttcccagacattttcaacattgtctccagaggtataattttataatgcaggtttgtgattctaaaattctcccatggctactcagccctcgcaatcaccagttctgctttttcttcttgccctatcagcttccaaacgctgacaccattgcatgcactagcaagattttgctgaaaggacccagatatagctctctcttgtgagactatgccggggcctagcaaacacagaagtggatgatcacagtcagctattggatgggtcacacggcccccaatggaggagctagagaaagtacccaaggagctaaagggaactgcaaccctataggtggaacaacaatatgaactaaccagtacccgggagctcttatctttagctgcatatgtatcaaaagatggcctagtcggccatcactgcaaagagaggcccattggacttgcaaactttatatgccccagtacaggggaacgccagggccaaaaggggggagtgggtgggtaggggattggggggggtgggtatgggggacctttgggatagcattgaaaatgtaaacgaggaaaattcctaataaaaaaaataaaataaaataaaataaaaaagaaagaaaatctctagggtacttttcttgtccccaaatcctattcatgctgtctccttgccttaatcataccttctcattctttgtccccaggtcagatgtttctctttcagcaagcatgagctgtactgtactttcctttaacaccatatgaacatctccatactcttgcctggattttaagactgcctagcttcaaaattggtctggaaaataagcatacttctctcagcttcagcttaagagtagaaaaaaggaagtggtagatgtgagctgatattcaagtggcagcattgagactccctcaaatccttggttggttaagacatgtgtatgggcatagtatataatgttagttttccgctaaaacctttggaatttactaaagtacaatcagtaatattgtattatctcaagaacaactttgtgccccttctaaagctccctattatagttccctaagtcctggtaattcagaggtttgtttttacgaatttaactactgcagataatctccctatgtacaattatacaatagtgtctttttgtggcttcactttatttagtgactgaaagtttcacttatgttaaagcatgccacaacctttcatttttaaaatatgctgttggatctctctctctctctctctctctctctctctctctctctgtgtgtgtgtgtgtgtgtgtgtttgtgtgtgtgtgtgtgtgtgtgtgtgtgtgtgtgtgtgaacacgtgccatgttttagaaatccatttacttatcattgaacagttggattcttatgctttgaaagtgaaatgtcctccacagtcacatgtgtttgaggacttgataccctccctgtcttgggaacttttaagagatggagcctaggggtcactgtagtgtaagtgttgaaggatatacctaatgcctcttctggaccacacactttgcatcctgaaccactgagatattgggagacagcctggattcctgtgcccatagattgtgctaactgttgccatgccttgcctgtcatgttatgctatatttactaaggaaggctcaaaaataaatccccacttcctcaagttgcttctatcaagtagtctgttacagtgacaagggaaggaatctttctgcaaccctgttcagtgcttcaggacatagatactcagaaatattgggtcatcaggaaggtctatttttaatttcttgagaactgccatatgtgatggttaattttgattgttaacttgttgaaatttagaatcactatggaaacacacttctgagtgtgtctgtgagggtgattccagaaaggtttaactaagcaggaaagacccattctacatggtaggtagctggggtacctgactgaaggcaagttgagcagcaccattcacaactctttgattcctgttgcaagggtagtattgaccttcaatttccttgccataatacattgcaacctctcagaacagcccaaaataaatacttcttccgttactttgtcaggtatttgaccatggaaatggagaagcataactaatatacagaacgttttcttcctcctccctcttttctctgtgatgctgggaatcaaatccaggtccttgagcatgttggacaagccttttattactgagctatactctccctgccctaacctcttttagagggatctctctatgtagtccagattggccttatacttgtgatccttatgcttctgacttctaaggtctagaattacagaacagtgccaccacacccagcctgtcatactgttttctatagtgttgcactgtctcatcgtcctactgcgactgttgatacactcaatagaaaatgagagaaatgaaagcagaaatgaagggaaaatacacagttttgttagtaggaaggaaaatatcacttagccaatttagctcgtttagatttttcagctaatactgcttttgttcaggactatcacttcagaaagagaaccattttgagttacggttatccatcattgttcactgagaatttctaaaattactaacttgatagtgccttagcaattattagggggtacttgagagttgagttttacatttttctctgagtttatgttagaatgatggtgacatgaagcctttttaagagttttgatgtctttgtgattacaaattcttactcttgaattgaaatatcgtaatctatagtttagatgctaaaatttaacattgtgacttcttacatcttagttctctctctctttctctctctctctctctctctctctctctctctctctctctgtggtgtgtgtgtgtgtgtgtgtgtgtgtgtgtgtgtgtgtgtgtgtgtgttttgctgaggaagtggttgaattccatcaatgtatgcaagatgaagagcaagtaatgcagtaagaaaaggttgggtttttttaatatgaagtgttatccaaatgcttagtcatgatgataaagtgaagagctttgcagcttgcacagtagaacagtgttacaatgatcatactgagtgtttgacgatacggaaggtggcagcagagtgggaaggatttgtcaacgagtttgggggattaagaggattagatagagaacacaaagtaaggatagccctcttccagttctacagagaaaagtagacccatttaaatggtttttggaatgactcaaagcccagatgttttcttactttaatatcacatcaattaaacttatagcctctttgatgactatagaggtatgctttccggtttgcagcatttactaattcacaaagcatgcaaatagacttaattatattgtataacacaaaagagaaactttactactctgccaaatacatatatcaaaaaatgatttttgctgctggttctatccatacctgaattgtcctttagacagatgaagtaatttactaataaatatattgcctctagtctcttttatccagtcctttccttgcagtgctcctgaagttaatctaatcccatctggagtctgggaccattgagccttgggaaaattaatttctctgtgtctacatttcattgttttattctaagataaatattgtacctctctcttaatttcctagtaaattaacaataattttagtgctggtagaatagatatcatacaatacatggtgtgtaacaaggaataagtaaaacagtaaatagtggtagagatagttactgttgtttttgtttctattatttgtgtttgcttctgaagtcgaattctggctacctgtttcaattttatgtcaacttgacacaagttaaaagtcttctgagaggagggagcctcaaccgagaaaatgtctccataagatttggctataggcaaccctgtaatattttctgcattagtgatgttggggaagggcccagcccattatgagtggttccattcctggactatatatatatttttaaaaaagcaggctgagttagccatgaggagcaagtcagtaagcagcactactccatgtcgtctataccagctcctgccttcagattcctgtcttattgcgttcctgtcctgattcccttccaagatggactatgatattttaagtgtaagccaaataaatcctttcctttccaacttgcttttggtcataatgtttcatcagaacaatagaaaaccaaattaagatatgaccttattacactgatcaagaattttgatttttcctttgcttatgacaaaactttcaggtattttcaagtaattatattgtaatagtatataatcccaagtaccccaaccagatctgatgaacctcaggagtgttctctagctggtggttctgggatcttcagtggcggatagttctatgatcaaatgcaaacttatcctagatgcagggatccaggtaactgttgctccctctgtgcttccttacattttgctgcagccatagtaagtaaattttctctttgctcaaatatttaacactataactcctggtgtctcttaggatagtattctggtatcaaatacatatatcttcagtaagctatccatttaataatatgtttaagaattggttgcatgtgagttctaagctatactatatagtcttctgtaggttatatcactagctgccttaggatggcagcttttaattgacccgtccttttgttctctttgcactcctctgaatgacttttccaggcgttacagtgagtaaatagttccaggccttaagttgctcagctggcttctgtaaacagagagactaaggcagattcagtccaatgacagaagcaataagtagtacttgaaattgcaattcttttttcatcacatttgttttctgttgttaataagattaagacattaatgaaattatttagagtattttaagaatatttaggtatctctgatgatctttttagtctacaattcttgctgtttgtagttgtaactaaggatgctgcttttcagaaagattccttataacaaaaaatggaaggtggagaaaaaactactactgtacattttcttttgccttgtatcttctagttgtcaaggaactccacaattaagtagcaagtttgttaacttacaatcaggcatgaaactcaagattacagagcaataaacagtggtttcaggtttgaccccaagtcccttgacctcatagactgatttctttccagtgttgtctgggccagcattgctgttcaaattcaatttctgtgttaacaatcacttccaactcattaaactcagggctactgtgatcatgctgtcaaaggaaaggcccatatacagtcaaaaacggttactaaggtggaatattggccctgcagatagtaagatagaataccctttcaggcatcaagcaggatgtactagaaagtactaggtcaatcctttaagttcattttaaatttgacaatggcatataagcttaattggaataaaattaattcttattaaatggagaagttttcacataggcttttaaaatgtgtacaaatagagaaatagtaacaacaaaaaaatgagtgtctagtttcaggtagcaggttgttagtccagctaattaaatgaggatgcatttaaaaaagtaaatcaatgacaagtagtaaaacaagaatgtttatctttgattttctgtacaatatattaagactcataagccaaaagcaaatgcaagatgctctgtgtcaccagtcgagacttaattttgtttcttgagcaactgtttcctcccacccaccatttggtaatcattcaacttgatgtcacttgcttacatagggaaagtcaatgaaagagatatattgaacagtactaggtaaatggtccatctcttgtctgaagtaaaaaggttgtgtgatgaagtgaaatgcgtaagaacatcagagtgaaacacgtgtaaatgtgccagcctgggacaagacacagtgccaaggccataccccatttaggtcccaactctgcaatattctctgacacccccccaataataccattgagtgattcatcagtggataaaaccattgattatgtcagcacactaaacatataattatgtgaatagattcaacgaaggatcaaaccttcaacacctgtacctagtggaggatattttatattcatatccaaaccatagtactgggttggagattacactaatagttgtaaataatttgctgacaaggtacggatccaggaaagttagaatatattgttatccagatatgtatgaccttcagtgggtgaacttacttagaaatagaaatcttagagagattcaaggagggaagtcatctggaataagctcatcagaatgtttctgtgtatctcaaagcagagatgtaaataattactatttactaatgctcgatagactgtataatgggaaaagatcagtttttactactgctgataatgattagtttagaagtaatctctacaagatttatatgaaacataatttttagtcataaaattttactaggtgataaaaattattaataaattaattgaaaagtgaaccagtactgataattgggaaatttgaatattataaaagctacttattcttggtttattaatttttaggataaattaaatggtgagaaaaattactatagtattttttggaaggattgtagtaacaatttagaaatataaataattatgaaaaattaaaggcaaatgtggagaacaaattagtagtatgatataaagctgtagctagtaaaaccattttatgcttgcatataaatagatcaacctaataagttaaaaattgattttgatatataggagagagagagacagagagacagagagagagacagagagagagagagagagagagagagagagaatgtgtgtgtatggttttctctgggggtgtgtgcaaatgtgtgtacatggctggatgacatgtcaaccttgtttgtcaattgttaggtgccattcaccttgttttctcaaattggggggggggggtatgtatcttgcccttgttataggaatgggggtaaaaggtggtgcagtgtatcacagatcatcatgtgtctgaccacctccaccaccccacttgccaagaaagcaatgcctatggctcagtaaagggtgctgagattgtctgctttattgcatatgagtaaccacttatatactgaaagcctattgactgtgatgggtagcatattaccttggattagatagtgaggactcatactacctgagtctctatgtagaagaagcacatcaataaaatatatgctacactcaccatgtcttccttaaaaatatatgccatcacaccctgcgttttacatgggttttgttgattgaactcagatcctcacatttgcatggcaggcacttgctctgcttaaatatctatttttgataagattttagaatactttatatatctgtgcaataaatacaatgtgcaaatatcttctcctagtctgtgacttgcaatttcagttctgagcagtctctgaaaaagttcattttgttttattttagcaaagtctagtttaatttgtatgcccttcttttggggttttatttctgttgttatatttaaaagctcttcctataatgtaatgatttgtctaacccaatcaaatttttctgtgttaatgtgttcaaaagaagaaaacgtgaagataaaggacgaactatgtagtcagctcctgtatggaaatacattctattaggatctactaatgtctttgcaaagccctctcccgtgaacacctgaattcctattaaaatttacccttgataatgtcaaaaaaagtgtctttaaaatgaattctaattgtttatttataacatgagggaataaaattgtttttaatatgaaaatattttttaggatttatatttaggtatgtgtctatctgtgtgaggatatgtctctatgggctctgtgaaaacccattaaagaactgtgtattccttggaggtagagttataggcagttgtgtgctacacaatgtgggtgctaggacccatgtttgggtctactggaagatcagcaagccctcttaactgttgagttacttctccagtctacctgattttgaatcattgttgactttgtatcgtaaactctttactgttgtctttgtgaggagtagtagtgtttgtttcccaagctggcctacatttgtggactcaggtggttcccccagagtagctgagacaatgtgcacatgatactatgaccagcataggatcattgatataaaaagagcttggtttctggtattgaattatctcttgatattatgaatagtccctgacttgatgcttttgactttatgatggtgtgaaagcagtatatgtctatagaaattctattttagatttttaatgttgaccttttcctgggtgaacaatatgtgtggtttgacttttttatgatgtgaggcagtggcagtgaatagtaagtagtggtcactctccaatggcctccacagttgccaagctggtgtttgtgaagtttaatatatgttgatataatattttaaaatgtacgtataaactcattgtcagtttaggaacatgcatactttgtaatgtgcttgttctgaatttgaattattaaagttataagttgttatttcctgtaccttaatatattatttgaaagaaacttatttttacataaaaatttaaaaattcccttactgagtaccctccttttgtttattttataataatactgttaaaattattgagacaaagaattaatactaataacaataacattaataatattattataattaatattaataataataataataatattaactaataacaataatagagctattatttgaattttaaaattttccctatcaggctccttatttggtgatagttctagtacaggatctcagattgtattatgtgtctcttcttaggcgcccccgataaggaatagttctatatgagatagtcttttatgacctggatactttcaaataatactgattgctaattttgtccaatatttgagattgagttttgtgtatgcatgtgtgtacacaagtggggtgtgtgtgtgtaaaccagaggctcgtattaagcaccttcctcggtctttatgggcacaggctatgtagttatcctagttatcaaagtaactgccattcactaattttatttccattcttattttcaatcattaccccagataataataaagtttctattgtttttattttcatattggggattgaacccagagtctcctacatgctagctaagtaagtgctcctgttcttgtgctatatccccaggccctgtgattctttttcttaagttgaaaaaggttatctaagctggctttatagatcatttgaagccatggacaaaagattatcggtattatgctttcagactgggtaccttctgtgttatggccagctgttctgaatatatatatacagctttagcatctatttccttgaatggaggctgaaagcttcgcatatttctcctagcttcttgagaggcactttctgtacacattgcgtttactcaaagtgaagcccccaatctgggttcccctgctacattttctagtcttgtaagaacaaactgtaccagccttgcttttgccagagagcgcctggtaaacacagaaaagaattgctagatctatcctgctgactcagctgccaagttctcccacacacttgctgagcccccttctgatgccaagttccacatcttgctgatttctactatcctatcttattaatcagaattttactgtaagcaagcactctcccttcaacctattttttaaaaacatatttagttatttatttagatcattgtggccctgtgacatttgattgttattaaactgctagctctttcaaatctctttttatatgttctgatgtttgaagtaaagacacaaacgagtaaataaataaaatgtagtaaggacagagagagttatttgtaattgtacaaatagtgtaactgtacctaacaataccaaattctagtcttaaaaatgttaaaatgtaagttttgttatatctattttgccacaattagagaaaaaaaactttatatcaaggaactaagaaatcaataagtaagaaaattgtccctaatatccatctagtgacaattacctctttatatactaatcatctttgaataaaatttaaccttgggtatttataaatacaattcaaattaattttgagttaaactcgaattgtattgcataatttattattattctaaaaattaaatcacatggttcatttcccatgatgttctatagggaaaagattatttttttctttttttattagatattttctttatttacatttcaaatgctatcccaaaagttccctgtaaccctcccccactcccgccctgctcccctacccacccactcccatttcttggccctggcgttcccctgtactggggcatataaagtttgcaataccaaggggcctctcttcccagtgatggccaactaggccatcttctgctacatatgcagctagagacatggactctgctgaagggaccctgatatagctgtctcatatgaggctatgccagtgcctggcaaatacagaagttgatgctcacagtcatctataggatggaacacagagccccaatggagaagctagagaaagcatccaaggtgctgaaggggtctgcaaccctataggtggaacaacaaaagattattttatacagccccataaggttgtttcgttgtagttgtcatcatcttcgtcttctccttatccttctgcttctccttctcttcctcttcttcctccttctcctccttcttctttcttcctcttcctcctcctcctcctcttcttccttctctttctctccttccatccatccctccctccctccctttctctctctgtcccttcctctctcatatgtgtgtgggcatctgtgtcattgtgtgtgttgggggtgggtgcagttcagaggacaactttgtggtcagttcactccttccaacttcatatggcttttaggtatcatactcaggtcatcatattgctagcttgtcagtttataaggtgccttttgagaaagtaaaaatgaagtcaaacctagaaagtgtaattaaaacacttcatttattatcttccagtcccacacattttttgagatcagatctcactgtatagctctggctgtcttggaactcacttgagatcagagtggtctcaaacttacagattctctaacctttgcctctaaagtgctgaaattgaaggcataggctacctccaccagcccctttctatatatttcatacaagatcctgtcatgtagtccaggatgaactgaaatgtgtgaagtttctgccttaatctccctagtcctgggatttcaggacatactgaccttgctaagaaagcagtgaattaatgaatccatggagactagttgggtatctataaccagaaaaaccagtaagtacttttaatataattgctgtatgtggtactagggatggaacctatatattagagataagtgcttatcactgaattacatcttcagacctgaagccattttaatatgactggctttgctggaagtatattatttaggccactgggtgtcagctatctattactgtatgacaacaaatcaccacaaaccccagagtcttcaaacataaattagtggtttatttctgtttctggaggagtttgctgggtttggggaggcttattcattattttagtttgcttttcttttgctgtgatagaacactgaccaaaatgaacttaagaaggggggagtttgttttacagctcccaggtcacaatccatcattgagggaagtcaggacaggagttcaagcgggaacctgagagcagaagctggatgagggaccacagaggagtatagcttactggtttgcctatgtttgcttcagtgacttgctcagctacttttcttacatagcccaggaccacttgcctagaagtgattctgcccacaatgggctgggcactcccacatcaattaggacagtctggtggagacattttctcagttgagattctctttttttctgatgactaatttgtgtgaaggcaaaaacaaacaaaaaaccagcatacccatgtagttgcattgttgcatttagtagaaatagagagtctaagatggccttgttcatgtttggtgcccagtcggggatgggtggatagccagatttttaatctgtcaaatttccttagttttttaaaattagatttattcattttactttgtatgtgagacttttgctttagtgtctatatatgtgccctatgcgtgtgactggtgcctgcagaggtcaaaagacgtgatcagatccctgataactgaggtgaagaatgattctgaactaccctgtgggttctgagaattgaacctggctcctctgccagagtaacacgtgctcttaactgttgccctagctctcaagtcctctgtttgtagaatttcttattggatagttctttagatcaggtatctgacctaatttaatctgtcctaaattaatgaagcagaagatgtaagatgctgtgagaccaggtttggaactgtcacctcacttatactacatttataaggccagataggggcttcaaattagactctctcttttgatgaggaaatacagcaacatcacagtgcaaaagaggtttggacacaggaagaattcactgggactcattattataaggatctacaatgaaagaataggaattgatatagtaagttctcagtaaataacgaattgttaggaagaacgggtataagaatgtaggcgagtaatggtacatgtgcttaaaatgtgggtttctgggctcaatacccactccccccaccccccacaaaagaagagataaaaggttagaggtagatggctgaggaaggctcatgttttgcatcaatattttttgagagagcatttttcagaagttcagaaaagattatagaacattaaagaacatgtggtgaagaaagagaaccaagtctatattttagtttgagaaattttatttggaagataagtgcttgatatatggaccaggagattaaggaaaatatgttttaggttcttagagtacatatttaaaggtagaaaaaggtgtaaaaagtgcaagattgaaaagatgtgattggacgtagtgaggatagggcagagtcatgaaagagctgggagaggctgataaagagcacagttggggaactagtagttcatcttgaagcagccggacagtcagaaattacagagaaggcaaggagacaaccagaggaagagaaataacctgtgtctgtgacactggatataaaattatttgcatttcctaacagtagttttagacttcctaggatttctatagaagttgttttctcaattataaagcaaggttttataatccaaaggcagaatatgtaatcagagataatataatcttttatttacttattttgtaatgatgcatgatgattctcagggcacacacataaacacaaatgcacacacacatacatgggcggggggggggggagnnnnnnnnnnnnnnnnnnnnnnnnaccaaaggccacagaactagccagtgagccctacagtatgactttaagtggttatggctttgtctaataatatttgttaatttttctggtcctggatagttatatgatttatttcttttcagggtattagatttctcactcacaatccctatgtctcaagattgtagtggataacaaaggagaccatttgtgtcatttctaaggttgtctgatacatgtagcagatgctcatgaccagaaatatcattttcaatattggttgtaaaggctagctgttacctttttagaacttgtcatcttgtcccattaattagatgcattgtccttgaactgtgggacagtggcaacgagccagacgtaagacacactgatagcacaaccttagctacgagacagaaaaatctgcaaaagttcactcctttattcagaaatattcacaataaaataagttaaattttactataaaaattggggttgggaagttttgtggctacatctctatttttaaaaggaaattttggaacatatctttacaagtggtggcttttaaactttgacatttccgtgatgcctgttttaactcaagaaactcatcagctttaacattgtttgccagattttcaaatatttatgaccctatcctagcataacataaacatgaaatgtaatttgagtgtcagtactatgttaaaataagtcacattattaaagaaaaatctggtgattgttacttttctttataatgaagactttccaagatttattttttttaaatatacaaaaataaaacatagtcctaataaaaagtatagtttgaaacacagggtacctacaagaaatcaggcccatggtcaaaatataagcttttaggtttacatagtaaaaaaaaaaatggccatcttactaaaagctgtctatagattcaatgcaattcccatcagaattccaacatagttctttacagaccttgaaactaaaaactaaaaactaaaaaaagacaggttgatcaatcgaatagaattgaagactcagaaatgaacctacatacctatgcacacttaatttttgacaaagaagccaaaacaatggaaaaaggaagcatcttcaagaaatggtgctggtctaattggatagctgcatgtagaagaatacaagtagatccatatttactcaaatccaagtgggtcaaagacctcaatataaaaccagatatactaaatctcatagaagagaaagtggagaatagccttgaatcataggtacaggagtcaagttcctgaacaaaacaccaatgactatggcactaagatcagcaattaataaataggacattataaaactgaaaagattctggacaccactaccaatagaacaaaagggcagactacagaaagggaaaagatcttaccaaccctacatccatcagaggactaatatccaaaatacataaagaatttaagaaattagacaccaacaaaacaaataactgaattaaaaactggggaacagatctaaacagagatttctcaacaatgtgatctttaatggccaagaagcacttaaagaaatgttcagtagccgtagtcaacagggaaatgtaatcaaatcaactctaagattctatcttatacctgtcagaatggctaagagcaaaaactcaaaggacagctagctcatggtggcaaggatgtggagcaagggaattgcattcctccattgctgggaggagtgcaaacgtgtactgtggaaatcaatttggaagattctcagaaaaatgagaatagttctatctcaagacaactataccactcttaggcatgtatccaaaagttgtcccactataccacagggacacttgtgcaactatgttcatagcagnnnnnnnnnnnnnnnnnnnntatgttcatagcagctttatttgtaatagccagaaactgcaaaaaacctagatatgcctcacctgaaaaatggataaagaaaatatggtacattacagaatataatactattcagctattaaaataagaacatcatgaaatttgcaggcaaatgagtagaactagaaaagatagtcctgagtgagattacccagacccagaaaaacgcacattgtatatccacttataagtggatattagccataaagtacagggtaaccatggtataatccacagacccaaagaagctaagtaacaatggtcccaagggatggtgcttgaatctcactcagaaggggaaataaaatagacatcagaggtaaatggagggagagaactgaatgggacagggggtagagaggggaaatgggctttagatgtgtgggtagagagagctggggaaagagaatgaaaattggttgtggggagtgcatctctaaaagatgtcagagacctatgacagcgagactcctaagagtctatggaagtgaccctacctgagattcctagatgtgggggatagggatatggagcctgaagtggccatctcttgtagccagtggaaggaggacaccaacaaaacctttgactgaaaatttgtcctgcctacgagatgtacacagataaagatgaagcagagattgagggaatggccaactaataactagcccaccttgagaacccattccatgtgagagaaccaatgcctggcaatattaatgatactgtgctatgcttgcagacaggagcctagcataattgttttctgagagacttcgtccagcaactggtgtaaacagatgcagagacccatagccaaacatggggtcttatggaagagtcgggaggtcaattgagggagctggagtggtcaaagtcatcacaagaagtcctaactcacttgggttgatgtgggcttacagagactgaatcgctaccaaagagcatgcattggctggacctaggttcccttcacatatgtagcagatgtccaacttagtcttcttgtggatcccctaacaattagaagggagtctgtttcttacttttttgcacgcctttggatccctttcggctacctggctgcttgatatcccagagcggttgatacctagagggggactagccttctctgagaagtggggagagggtctgaaggtgggacttggaggagaagagggagggggattctgatcagaatgtaaaatgaataaataagaaaaaatcgcttgatatacaggcgtggaatgtagtatcctttgattttgtcagtccccttccctccctcctcattgtaagaaaccagagaaacggttattgtaggcttcttggaaaatggtgacattgtatattggacacactgaatacaccccaagttagtatacttaaatgaattttcctactctttgcatgaactgagttagactttaaaaaaagtctcaaaaggaaatgtataaaaagtgagacagaaatcctgtgatctttctctctaaatagtagccattataatcctaaacataagtttttgttagttcaagtatatatcttagtatctatgtttgaatgaaatgcttactttatgaccaccattttattattatcaacttaacattcttttttctcaaaaatttacatagttaataaaccaaggacagcttttcatttttttattcaaatctttgatttaccacttttatagttctttttcttctataaagtgctaacacactcttctacaaagttgcgtgtacctttgaacatcactagtaattctaagatttataacattcaggaaggactttaaaaggaagtatatggagagggcacacattttctaggtcccactaagttgcctaggttggcctcagattcatgatcctcctgccttagcatgtagaacagcttgggttataggtatgtggtaccactagtagctgagcaaagacatagatgatagaagtttgatggagagaaaaaatgcaagtatgtagagggcccccaaaagcttagttacatactcatgaggataatttctcccagaataggtatttacatataaagaagagttatgggacctacaagataccctcttcccctgcaaagccaaggaagtttcatctcttgatatttggtaaaggaacactggaagaaatacgctgttaggtatagattcagtaatactttcacataaaaatgtttccataaattcgagttctcaggaactctgcccttctctgagcttttataatcttattttcaaacacttagagcagtttggcagcagattttaggcttttaattttttcagggttcaaatcactatagtgcaatgctctttagaaaccagacaacaaaaagattacctaggatagcagtctgtctgtgagcatttgcattactctttctagttatgtctcgatagagtttttcccctaaaactggaagactttggaagataatctgctactcactttataaatagtattccatattcagttcttagaaactgaatgggcttttggcatttcatccatactatccatgattagcttctgttacttcatttccatagtatctgccctggtgacttaccattaatggtgtttttaatgtattgctttgtattgctctggtcgtctgtgtttccacttcattaaaagtcagtacttcccctggtgccttgggcaccccaaagttcttcatattacatttatcaactgagattgtggggtttttttcattttcataaaattttccactaaggtgattgcagtgtttctgtattgactcctatctcgttccacatgaatggtgaaaggtctgagaatttccttacaagctaacaaactaccttgatataatgaatgctcacagtgttttgtatttactgtagttgctcatacctcatttaacattgcgtgttttattgaggaccatcactgagatagagcccaaaaatctgagctatagtttaaaagatgcatataacctctcacatttgctctagctttctttccttcattgttttggaaagattatcatgatattgcatcattgcttttccctatcattggatattttttttttttttgctcaaacatttcattcactctattatggtcaggctgacctaataccacaataccaagggtttctaatcaaatctggggtgtatcatttcttattcctgaaatttctgtcttaaatccttctatccacaccactatatcatagccgtgtgtgtatgtgtgtgtgtgtatgtgtgtgtatgagtattgcatgtaacccactgtatataggatattgtagcagtattaactttgttttctagatattgttcagaaatgatctcacccatagagcatatcgaagctgtggcctatgaatttaccatctgaattacatttgtgctgttctgtgcggtatcaccattcttacattcactattatagtactttcgaccccattctgggactatgacacaaatgctatcactccacactgtttacagataaaaaaaaggaaagcaatatcttgcctgaggccataaagttagtaagttcttaggcaggatgttaaatgttagctgactgcttctacagtctctttgctttattgcctcattaaactactcttgtgtgagagttacagggaggaggtatattttctttcagtgttgaagtaaactttagctttttcttgaattttggtctagcagaggtctttccaggataggttgcaaagcttcattctatacaaaaatattaccagataacaaagtgtgtgtgtgtgtgtgtgtgtgtgtgtgtgtgtgtgtgtgtgtgtgtttactgtggcttgcatccaggcaggaaaatgttccactaagttacaacccccaagccaaaagtaagaatctcaagttttaggtagagttaaatcctttccttaatcttggaactgaaaactgcttgaacgctccgttaggttttatagttcaccagccaatgcttgaaatattaaaaagaaaacaaattacccagtagtatattcattacatctacagattgaaaggaaatggaagaaatgaactgatatcaaagcttagaaactaagaatatatggaaggttggccaaatgtggattttgtgcagagtcctttgtttttctttgcacagatatactatttttaaattgtatttctttctctaaagtacaaaattaaacacctttataaccttctacgttagactctggatttgctgctatctggtaattttttttgaaaacatcgaataatactgaaattaattttccaaattaaatttttatgactttgccgttttatttagtgccttaactatcaacaaatataatttggttgttttgttttgttttgttttttacccagtttttccctatttgggaatggaagaagctgatctgtagaatatacacataattttttacttctacagttcatttaaaggacaccttttgtactagctttcaaagtcatctgttaatattgtattagactcctaaaaatactttccctttgctaacatgaggagaagtactagcaaaaccctcctaaatgcatgtttgcattcaaaggctaaaactgggggctcctaaatcgttttcatccaaagaactgtttgaaatctacttaagaaaacacttaagtttaaaataacttaatttagaaaagagaattgaattgtgattggtcagggtgaactggtacttccttctctgggcttattgttcactttcctccctttatagtttaattctccatttcttctttgatggaacattgaacttctgattccagctgtgacccagttttatatgaccttgtataacttactggatttagtcacctgagccttaagcctttgccgctcatggtagggttatttattatttaacatgttgccatttccagcatgagctccaagcgcctttagttcagaagcatgcatgagtacactgcaaatacacacacacccactacattggcttagaatacgcaagtagacagtgaagagaactgcagaggaaattgagaatgtcagctttataataattacaaactatacatgtgttatgaactctgctgtatatatttcctaatttcaataaactgcatagtctaaacagccaaaactagagttaatcttttctagccctaaaattttatcacaaatattttttaacaaaaactaaagtttgatgatggctttcttttgttttcagagcatatgtgtaactgttctgaggttggaagtttggatgtaaagcgctgcaaccagaccacagggcagtgtgattgtcatgtgggttatcagggtcttcactgtgacacctgcaaagagggcttttacctgaatcacactgttggtctctgcctgccatgtcactgcagtccacatggagctgttagcatcctctgtaacaggtaagcagcagagtgtggatgggaggtctgttgtaaggagaaactgtgttgggaaacttggaggcattgaaagaagagaatagaaggtggggatgactaaaacttcatatatacatcacagaataaaaaaaggctaccctgtggagaatcagttatttaattaaaagagagaaccactgtgatatagatttatacaatgttttgtatattttaattctgtcactttgtatatttgttttttgctttttgatagtttctctgtttcctgaaataaataatgatgaaggattctgttcattggaacggattccctttaggcatttcaagtggaatatctttatctattaacatatgactggatattaaggaaacatattcttggtttactttattctattatcagaagtctcatatttcatataccctttattggttgttgtttttatttttctttctttttgaaaaatattcattgtatttggggggaggggtgcatgccatggtactcatggggtctgaaagcaacttacaggagtcagatctctgcttctaccatatgggttctgggaattgagcttcagtaattagactttgtgggaagtacctgtaccttctgtactgtacctattttttttaaatctttattggatattttatgtatttacatttcaaatattatcccctttcccagtttcccctctagaaacctcctctcccatcccctctccccctgcttctataaaggatgctccccgtcccacccacccactcccacctacccactcccactttcccgccctggcattcccctaccatggagaatcgagccagataatgccatcctctgctacatatgcggttggtgccctgggtccacctgggtccctccatgtgtannnnnnnnnnnnnnnnnnnnattaagttatcttctatttggaagtgaattaatctcctggtatcataccatattatgaaaataattattctttgattatatatacgggaatgcctagctttttgtggacttcaagccaaactctgaagagatagccttacatagtgacaaggacaagaaatttagagttaatgtaacctgaatacagaaccaagatctggtgccgcttctgaactgcactgtgctgttggcaaatactctcatttcagtgactcagttttttctcaaggttgctgtagaagctaaatgagtggttatatatgttataaatgttatatatgttacaaatgggtatggcacacacaaataaagaagtgaagatgtctttatttcaaagacatattgttgaattgagatttttaaaaaatattttaattttaaaatattttaatttttgaaaattttgtacatgcatacaatatattttatcatatttatctcccacttcttgtggtggaatatttttaaggaacttttatagctccttggttaaaaacatgctttaaactaagtgggtggtgatagcacatgctttgaatcccagcacctgggaacacagaggcaggcggacattcagatttgaggccagcttgctctacatagtgaattccaggacagccagggtgatgcagagaaatcctgacatgaaaaacaaaacaaaacaaaaaaaaaacaaattggtaaagtgatttagattttaccaatagatattttagatgttttataaaccatattgtgttattgtacaatattacataatgcacttatattaaaatatagaaaagaaattgagaagtttataacttgaaatgaagcaatgatgaatgtttatgatttttagtaatttcaaagtttttcttaatcttcatagcaactctatatatagagattagtaagtcacaaaaatataaagaattccaaattaggctttccaagtctaagccctggatttaacaccatgccacatatcacctataatgaaacgattaatagtctttattgatattgagactatagtaacttcttttttttttttttttttttgagaaaaggtttcattatgtagccctagctggcttagaactcttaaaacaggctatcctcaaactcatggagttatatctgcctttgctgtctctatatctgccacttctgcctctacttctcaagtgctgggattaaaattgtgtgctactatcactggtggctccatgaagtacttccttaccatgcctcatatacatagccatacaagttatattcactttcttttattgtggtactggtaactgaattcaggatcttgtgcatactagacaggtacttttccagagttatatcctcagcccaacacacctaccattttaaaacaacaggatgctatgaagtagacaatatcatcgccattcttttgttttgttttgttttgttttgttttgtttttttccagacagggtttctctgtatagccctggctgtcctggaactcactttgtagaccaggctggactcgaactcagaaatccgcctgcctctgccccccaagtgctgggattaaaggcgtgcgccaccacacccggcaacatcgctattcttattacattgcaggtttgaacatttatatgagtagtaattagtaagacagaaagatactgctagaatacctgtgttctagaaccaaagtacatattcctgtctactgtgatgatacatcttttctcagaaaatcaagtgctgaaccaagaaagtgagcatggtgttttttagatctgatgtttgactaatacaatcagagtacttgcattgttaaagaatttcttccagttgtcttctgataatcagaccttgaccctggtgagataattcatgctaaatcagagctaatcccagtgtgttgttagtaggtttaggagttaaagatcagccctgttaatagctttcttatgtgatgtttaattgctttcttgttgcattagcaccttggagtaaaagaaaaaggacttttttctcttatcaggcaatatatagtctgtgtaagactaaaggcatagactactaggcaatatcacaaacaagtgtctcaatacatgcctggtttgtaagcagaacattttagctaccaaaggcactgctatgtgtcttttgggttatgatttagggaagtagaaaaataagaccttatgcagggagggagacccagaattctagagaattttctaaaataatgcaagaagatgagagatttcttctcttaaagccagctaaaatattttgtcttggatctccctgttctcattaaaaatgaatagaaatgagttctgtcctgactcacacattgaaggtctatggaacaaacaactgactttaaaaattcattttcccattctctctgtccatatgttttagtgggagttgctccagtgagggtagattttggctctaggagccagatgtgggttgagcaatatctttgtatgcaaacacaaagttctctatgtactgatagaaggtcacgcccttgtgttactattggtgttctagtgtgtttaactggaaaaagttggtcggtaccatctgaactttttatttttttcttttgggtcacattcctagtgttttcctgattcaaattttgatctttcattaattaaagacacaatgttttatccaaaaaagaagtctgctagtgatgtcctgaatgttatcatatatatttcttaagatattgtcatatctaactttaatgctttaataagaagtaacaaaatattcatgccaaattagaatcatgattttgtattttatattatcttagtgaggtaatttctatgataatatagtattcttctcctgaaaatccatttttggtgctttatagtatgtcttagaatatatattactttgctttttcaactattggaagatgttccagatcagaaggcagattataattatgtcataaatgaagggcaaaattaattttcaatagaaaaataacagactcttctaaaacctttatctatatagggcactaaaaatcatttttttgtgtagtgtttaggagcaacagttagtataaaatcgtgctttgtgaatgcagctttcaaagatttaaaaagaaagctatttgattgctagaaacagtaatgtgagaagctttgtcatttcaaccactcatttttcatgtaattcaggcattgtatttgccacccatgtcaaaagatatcctgttctcaagaaactcacaggttagaataatacctatgaaaaccaatgttagagcttataaagtgcacaagttattttaggaaggtcttaggagggaatttatgtttgaaatggaatttcaaaagtgagtagaaatttgtatgagaagaaaggctcactatttctagaaggcaaagtttagtaatggtagtgaggaaggattaaaagagagtaggaaataggactcttgtctgttcattttgtgttgtatctcagagtttggcttaggagaaattcagtaagcatttggtgagtcaacagaatagatgagtgaagaataaacagccagaccaataaggagctactgtgccaccaaattcaccactaatatgcttgactaggaggtgatatcagaaaaattatctgtctggtgaccagaaagagtgtgctcaggcaaaaagaccagtatgaaaactacttaacaatttaatcaagggaagataaggccatatctaaaggacagtaaagggaaccaggttaagggttaaatggttgccttaaacatatgaagtaagtgggagagagatgacaactggatgccttgctggcttggccatagaagtggaagaaaagaaatactccattaaccagatgaaacaatagtggtgaaaattggaggaaagtagtgacgctgttcatttttaatcatatagatattgaaatgactgatataactgtcttgttgatacattctgacatgttctctaacaaactcaagaaatattttgttatttttaaacgaagatttattttaaagtgtatgtgtgtgttcgtgtgagtacaagtgcttgtggaattcagaagagggtattagatctcctagagttggactaacagagccacataccgtaacatgggtactcagaactgaattcaggtcctctgcaaataactatgtactgaaaatactatagtttatgctgttttatagaaaaaaagtacatcactttataattttattctttataccaattattattcctgcaagtcaccaacctcaagtttaaagtctttttttttaatccttcaagataactttcattggaagtggaatttttaaaaataatcagagaggtatgaaaataaacgtaggtatgtaactcagcctgtatcccttaatcatggtgtgtttgttctaataaggatttatccactgctagatagtttatatcttagaaggtagattaaggtcattatgccaaatggtttatggaaaaagaagttggaataaaaaactgactctcaagtggtcagagatagtctcattcaaaaataggctctgagaatactgagatttttacgggaataaggcatatctaaagtcgtctggaaagtgttatctgtattgtatctaaagattccatttcgtatcaggcacaatttgctctcctagtcatctaattattaactagatagcaactgttagcaaatgaatggaaaaaacccctctttccagctactcttgacctttgtaacaaggagtcacagtgagttggtattgttattgcacaaacatgtcactgtttctaaatcttatcgtagactcctattgtttagctttaagtcactttaggactgaaagtagtattttaatgttttattattagtaatattaaatacttattttgcttctaatagtctggtccatctatatgctaatggtaaaatcaaataccacaaagtatgaagatacactaaaatgagaagctgggagagatcagtattatagctgaaaccagtgaaaaccagaactgaattcaccaatgtagtagcattttgtctgttttaaagaaaagaaaggatttagacataaaaaaaaagtataaaaagcctttttgggagagtaaagaggattaatgactcagaaatgcacgcagtatagatgtgaaataaaaaaggagcagggttaagagatgaatctggtaagtccacctggggtcaagtcatagagaacattaaaagccatataatttgacatttactcgctacatattttttaaagacatatcattttaattatatggtatgtatttatgtagtgtgagcactagagtgcagtgttcatggaggccagagaaagggattggatttccctggagttgaagttacaggtgcttgtgagctggccttcattgatgctgggaactgagcatgagtcccctggaagaagaataggtgcttgtaactggtgagccttctcaccaactccttagcaagctatcctcaacaacagaagtaagcatcagaactgtattgtagcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcaagcttcaagcgttgaatggctataccccatggggttttaatctccccaagtcttgcttttgagtatcaaacaaagtctccatatctatgttcattttgtgctgccaagtataaatccaagagcccttcaccttttgagagttttaagagcttttattcattgttaaagagaaacccttggtgtacaaaaataagagatgaggggaagtcaaaagcttgtgtagttaacagttttcataaaatttcaaaaaatcatatttctcttaattactctggtcctcatatgcagtagcagaaagtgcagtgccctccttttgaggtcactcattttttaacaactctggggtcagttcccccatgacagtatgtataaagggaatgattctatcagttcactgatgctgatttttcctgatatgtgacagtctggtccctaaacatattggtacctgaccatctgaccctatccttacaagtagcagtgatttttctgttgttgttgttgttgttgttgttattgttgttgttgttgttgttattttgttttaagggacaacgaatttaatctctcagtgccaggttctcataaggatgctctaaacttaacttcctaagttacagatcttaacaatgagcttctttagtttacacgtgatgcaacatccctttgttgcatggcagagtcagtaacattttttagaatcttcagtagcaaacctgaaataatattctttccctaagggtgaggaacctgtcattgacattcaaactgcaaagggttttgttaaaaccatctctcctaatagtggaacaagttgagtcctcattcacgtcaccaagggaaacctaatttaaacaattcagtttaggcagatcaccgtcaaggttattttcaagttctatttaaatggcaaaacaaacatcagtttctcttgcttaagaagaaagaaactaaaagacaaatttctaggtaaatatctttctcatagacaattttattatacttttaaaggctaacgacttataaacttatagtatatttaatctgtatctgacttctttttaagatgagagaatactacataacttggaaaatactacattctgctattatacatgccattcaacccttctaaaatacttagaaccagaagattgttttacatgatagatatttctataaccattactatttgagcaaccataattctgaaatacaaaatctggtacagagtttccaaacaaagctattcaaaagtttcaagtttataattgacaggaaggaccttgaagttacaaaattgaagagacctgaaacagaaggatataattgaaaagtttacagaaatttaagtgaagtatgtagttcacagcagtgatattattcagggtgctttggaggaacagaacttacagaatgtatacatttacaagggatttattagagtagtttactgactactctatgaatttaaataatttaaattaaaataaatttactccaacaatggccatctactgatggaagttccaataattcagtagtgtttccaatgcatgaggccagatatctcagctggtctttagtattcactataatcctaagcagtgtgctgacttgttttgatcaacttagcccaagccagaatcactggaaaagagggaacctcaactgagaaaacacatccataaagttaagccgtaggcaagcctatggggcattttcttaattagtgtttgatgggggaggctctgtcctttgtgggtgggaccactcctgggcaggtagttctgggttctgtaagaaggaaggatgagaagaaggtcatgtggaataagccagtaagcagcaccgcttcatggcttctgcattagctcctgctctatttgagttcctgtcctgactttcttcagtgactaatagtgatatggagccaaacaacccttttcttccccaacttgctttagttatggtgttataccatagcagtaataaccttaactacagcaaatagacgctaaagccagtgcaggaacggagttgctagcagaaacaagcgcaagcaggcaaagagaaagcttccttccactatgacctttacataagatgccaccataaaggtgtgactcacattaaaggtgtatcctctctcctgacaagatccagataaaagtgatcttcctactcaaaggtttagttaagaaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatcttctggaccttcccattgtggacaattatgctttacacaatatatccactctagcattgcaatttccctaagtcttaaaatcccttcatcaacactaagccacggaatatcaggcatctccaagtcatttccagtaggccatcttttgataaacacctcagccaaccattcaaacaaacttttgacaccttttttaactatgcgagcttccgtattaaacctagaatctctactcagaggacccatgtcaataaactcagcctgctctagttttatgttccttccacccttatcccacacccttaaaatccattcccacacatattcaccaggtttctgcttgaatgaattagcaaactcattaagctccttagtagtgtagcgaatttcctcatggactacactttctacctcccctctaggagcctgttttgctttgagtctggttacaggtctagaagaaactattggtgggccgtgagcagactctgcaaaattaatttcctcatgtggggaaggcattatttcaagaggtggggctgagggtactacttcctcaggtggggcaaacccttgagaatctgaggattcaaaattctcagcttcaacatggtcttcccacacatccccatcccatgttggtaggatcccattctttgccaattagagcccttactttaactgtcgacacactctgaggctgagacttgaattttcgctgtagttcagccaaccttacaatgagagtttctgtttgattttctgcaacttgagctctattgctacaagagagaagattctcctcaaggacacacttagcaacttttagatcgtttacttgtgtctggagcctttcgattttatcacacaactccttcctttcattcatcattttttccacagatactaagagcagccagcctgtaaaatcatttttcgattttttccccatcttgtagaaagctttgtgcactgaatcacctaattcattaagaaaatcaagggcattagcttctttaagttcggaatatagtttcaaccatgggtcttcaaaattctctgagctcccaggagggagagaatctggagaggtttcaatagttgaaagtgctggtggatcaacaagccaattccagaattttaaaagattcatccttgtacttctgttactctagaaccactcctggtaccaacttctgtattagtcagggttctctagagtcacagaacttatggatagtctctagataataaaggaatttattgatgacttacagtcggcagctcaattcccaacaattgttcagtcacagctgtgaatggaagtccaaggatctagcagttactcagtctcacgcagcaagcaggcgaaggagcaggagcaagagcaagagctagactcccttcttccaatgtccttatattgtctccagcaaaaggtgtagcccagattaaaggtgtgttccaccacacctttaatcccagatgaaaggcatagcccagattaaaggtgtgttccttaactcggagattcaatcttctggaatccatagccactatggctcaagatcttcaaaccaagatccagataaggatctccaagcctccagataagggtcactggtgagccttccaattccggattgtagttcattccaaatattgtcaagttgacaaccaggaatagccactacacagataaaagtgaatcttcctacttcaaatggtttagttaagaaaaaatccctcataggtgtatccagatgcctgggttttagttaattcttgatgtacacaggttgacaaacaagaatagctatcacagcaatatatattaacttctcagttttttaaatgttctgtgcctgtataagaagtaaaacattaggtgaagttggatgaaagccacatgagagctttctatactttaaagactcttccttaaatattttatgattaaaagtcaataaaatcattattgggagtggccaaaaaaggtagtatgaatagtattgctgtcttgcgataagagttggtcctagtgatagttcgtaggttaaagagaaacgtgagcacttgcatgcatgtgcatgcaaacataaacactttgcatggacacttgggtgcatagacacttgcaggtttagatatatgatgttgtggtgagaagctgacagcctgatttcatgtccttcctgagattttaaaagacgactttctaaaactatgctaatagaaatagtttgaaatagaaggacttttgttgctacagagaaagctttgtcttcccctgtgtctgaaagcagcatgactttttccatctctgaatttttttccatcacacatagaaaaaaaaaaaaaatgtgtcctaccaggcagaaatacttggctgcagagctttttgttctacccgaatgtaatttccactccagatgcctaaatttgccaagcagaaggatttggatatgacatttcttcagatttcctaagagaaaagcttaagtccatcagcagtattatactgtggccttcaacgtgtatagttgggtcaaaaattaaaagtttttcagtagttctctgatatgatacaatgcactttgacaattatttattttgttacattcttactcgtatataaaaacaaaagttataaattacatgtatatattgttctattcacattgaacatatatgtttgtcctcaaatatttatcatatctttgtggtaaaaaaattcaaaaaccttctttagagcacatacttgataactgtagtcaccttacagtgcagggcccaccagaaattcttacttctagttcccacccacccattcctccatcctcctcatcttcttgaccttctactcttccagaactctgggaaactaccattctatgagtttcccagatcaacttttactctacatatgagtgagatcatgcagtattgtctttctattatgagttctattatgcatactttgtccattctttggctgatggacagttagggtttttggattttttgactcttgtgaatggtgtcacaataaacaagcgaatgcagatgcctcttcagcacgttggtttcatttcctttagttataaaccccatagtggggttgctggattgtatagttgctttataagaaatattctgagaaacttctgcactcttttttcatagctgtattaggatacattgccatcaatagtgcagtgcttcacttttccattgggtttttaaagtttccacttatcatggtaaattcagtaacatttgtaggaatgttaatttatctccatagtagtttacagttaatagtatactcctaatttgatttaatagcaattccaagaaataggtgtgattatacagcaaattacagataataaataacaattgaaaggttatataaacccaagcatgggtgtttattaactactagaattaaaagaatcaatctgatagcttctaacagtgcatgttcttttactactctaaactcttatgaagtttagctagctatggtggcacacaggttgctgatgtaggaagagaccacaagttctagggtagcctgggctaaatagcaagccccagtctcaaggaagaacaacaaaaatgtaagtaacaaaaacctaaaaaacaaaaaaaaaacaaaaaacaaaacaaaactctaaagacgttcatgatacttaatgctgggttagcatgtgtctttgttctctagaccaatagttctcaatgaagagaaaaacacaagagatgtgttgatgagtaaatatacttctcagtagagatgtttcataatgttgaagagattcacaaagataacagggttaaattttattataattactacacagaaatattatatatggcagtgtgggtatatcatgtaagtgtttggttgggtgtgggtgagaatgattcattggtgtaggggttggtcattggagagataaatttagaaatcaattttataccacaatgaaaatgagtatttcaaagatggcaaaatgaagtagtgagagcatattatgagaatcccttgaaaggaaaagactagaagtagatataattctttccatgaaagaatttagaggatatcatgagttaatgaagaaattacatgaatgttggaatcaaatgaagtttgcatatccagctggtactacataccaaactgtgcactggaaatacaaggaagaaagcacagagaactgcttgacatcacaaaagtgacttcatagaggagggaaggaagtgaacaaggtaacaatcaagaaaataaaataggtatttatggaaagtgctatgacaaattagaatttttagtggagtgaggtaagtccctatggagaatatagcatttgaataaggaacagactaaatttgggatatgtcatgtggatctcttgtggaagagtattgccagtgcctttgatgcttaggtatatctgagcagtatagtatcattgtggctacagtggtggaaaattagaagcaggcattaggaaagtggggtgttcagaaagtatatttcagatattttcagagtgcagttatactttcaaaatcctataaaaagcagtggtgagaaatatgataacagtatggccctggctcagagacaggtatatagataaaacagtctgagccctaaagcagaagtacacaaagaaaccaacatgtgactgagcaggtcctcaggtatggaggcaaaggggtttacttctcagtggatccttctagacctttggttagctgatactatgtggaagagagtgtagatagaccagtggtttttaacatacacaaaagtaagtgtcaggtggattaaagacataaatgtgaaagcataaaggtgtaggaaagcatcttaatgaccttgcaggacagagagattgctttaactgtaatataaaaatagtaacaacacatttgtttttatactatgtcagaaactattctgtttatatgtctattcaatatgtttactaagttaacctttatggcattcatatgagatatcgctccatcttataggtaagaaaaggggctaagtgatttgcccagagtttagaaaggagggtaaataatttatacattgctagagagatggctcagcagttaagatcacttgttatttgttttagtctttgttccactgtgaagtgacaccatgaccttggcaactcttataaaggaaaacctttaattggatcttgcatacagtttcaaaggtttaagatcattatctcatggtaggaagcattgcagtactcataaaaacatggtgctggggaagtagatgagagttctacatcaggatccaccaagagtaggaagagagagagcctctgggctggacttggccttttgaaacctcaaagcccacccacagtgacacacttgctccaaccaagccctatctcttaatcttttcaaatagtgctactccctagtgaccaggcattcaaatatatgatcctatagggaccattttcattgaaaccaccacacagtccttccagaggacttgaatttaggtccccataccaatgattgagctgcatataatcgcagccccaggggatcccacaccatcttctgacttttgtcagagtcagtgacttttgtgggtacccatgtgcatgtatacacatgaattaaaaataaaaatcttcaatatttttagggtttattccaatatatatatatggatatatatatatatatatatatatatatatatatgaatatttgcttgtgtgtatgtatgtatcccatatgtgtgtgtagaatccgtagagttcagaagacggtgttggatctcctggaactggagtaaaagcatgtttatgaaccagtggatgctgaaaacttaatccagctcccctgtaagagcagcaagggggttggggatttagctcagtggtagagcgcttgcctagcaagcccaaggccctgggttcggtcctcagctccggaaaaaaaaaaaaaagagcagcaagaagtgcttcttgatgactgttaaaccatctctccagcctcataaaaaaaatctttcaaatatagtttacatggagttatggctggtgagaaaatgaggatttgaacattctaattccagagtttttgttatttttatgtttatttttcattgatacataaaatataaaaattgcacattaatgtaatacatgcaatacactagtccatgttcactttgatttttgtttaaatctggttaaatatatctgtctcctcctcaatatttatccatttctttatggtaaatttttcaaaattctttcagtttttattaactaattttttatgtgtatgggtgttttccctggagagagagagatgcaccacttgcattcagtgttcttcaggacaaaataagtgggagcatctgatcccctgggactggacttacaggaggcttgggacccaccatgcaagtgctgagaataaaactttgatccttcttagaagggggaacaaaatacccatgaaagaagttacaaagtgtggagcagagactgaaggaataaccatccagagactgccccacctggggatctgtgctatatacagtcaccaaacccagaccctattgtggatgcctacaagttcttgctgacaggagcctgatgcagctgtctcctgagaggctctaccagtgcctgacaaatacagaagttgatgctcacagacaaccattggactgagcacaggatccccaatgaaggagcaagagaaagaacccaaggatctgaaggggtttgtagccccataggaagaacaacaatatgaactaaccagtacccccagagctcccagggattaaaccaccaaccaaagaatacacatggagggactcatgactccagctgcatatgtagcagaggatggccaagtcggtcatcaatgggaggagaagcccttggtcctatgaaggttgtatgccccagtgtggggaaatgccagggccaggaagtgggagtgggtgggttggtgagcagggggggggggggtgaggaggggatagggggttttcggaggggaaaccaggaaaggtgataacatttgaaatgtaaataaagaaaatatctaatataaaaaaagaacttggaatcccttgaagagcagccagtgcttgtaactcctaagccatttcaccagccccattagttattttaaaaatgcatgaagcatttttgttgtagtgtttatgttcgtaattttactaaacaaatcttcaaaatattaaaatgaaaattttgaactatttgactattataagtagagatttctgtttatgaaaagatcttataaaaaggtaaagaaaagtcacatactgggaaaggacaattacatatttgaacatggcaggactgctttcccagaaacatttcaagagtttctagaaataaatgtgaaaaatacttgggagaccctttacagaagagcaaagtcacatgacctgcaattatgaaggtgtactacatcactttagtaatcacaagaattccaagcattggtaaagctcagagcaccttcctccatcgcaaaccatgcactccctggtgaagctggttgcctaggaatttagcccttggtacattccttagggaaaattatactcaggagcacaagagatatgaggttcacagaatgcagggcacaacagttaaaaggttgaaagcaatccaagcatggtagcacacctttcattctatcacttgggaggcagaggcagagggatctctgtgaattcagggccagcctagtttgcatagtaagttcaaggtcaattgcttctacataataagaccctgtctcaaaaaaataaagaaatcactgtccaaataatggagtaattgaatgggctgagaattcttagaagcctgtttcttctgttgaagaaaaaaaaggggatgggggtggggaagggaatgagaaataactttcccatctgaattaagccaagctctgagttacagctctgggaatatggtacttttatgtgttttgcctctaatttgcttttgacttttcaaataaggttttaaatttgataatggtaagatcagttatcaaaaatatttttgtacttaggcaatacactttattattaagaatttctgtctgaatttgacttttttctactgtattgtgtaccatgtgtcctcaaaaatacaaggaatgtttggcataatagcccagtgttttcaacaataaagccatcctttttttcctcaagaaaaaggagctttgctcattgtataatggcctttccatgactagaagatagggaacagacagtccttaacgaaaatgtccaatttttggagtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaagaagaagaagaagaagcaagcaagaagaagaagaagaagaagaagaagaagaagaagaaaattgatagacttagttaatggaattttgtttgattgtttgtttgtttcttgttctctatgtctaagtgccaacatgtaacatatctgagaaagaaaaataagtaaggctctttagtgaccaaaaacatgtatttattttgtgcatgtgtgtatgcatgtgtttaaggctgcccatgaaggccgagagggcgctgaatcccctgaaaatggtgttacaggcatttgtaaactgcctgatatagatgctgggaaacaaactctgttcccctacaagaacagcaagtgctcttaaccactgaaaggtccctccagatcctactgaccaaaaatatatcaattaatatatagttagttaaagttaatgacagtatatcttaatgtatacctgaacaggtcatttaaatcctgcaaatcttaagaatcatatagacaaatgttttaatgacaagaaaagtgccaagatatttgatactttaaaaaaataaatgaatcatagctggttgaaacaagtagtctagctggctttgatcttgcataatgtagaactttccagagttttaccttctcacttgtaaaattctctttccagaaactgtatcatgtattcatatgttctttgcctagctacctattgctacaaactagggaaaaaattaagtggttaccctttaatttcatgctatttcttttttattggatattttctttatttacgtttcatgccagttcttaaaagagcatcttaaaaatagaatctagaaagtaaataattctgagacttccctgtatttaaatactgtgcattccaccctatcctagtgagtcctagggggaaagcatgatctaagaatatcattactatcgccacagttgctatcatgtttgagttgaagtttttgcttaggctgtgtatacaatgtatagttttcacaataaccctacaaaagttgtagttatcttcattgcataaagaatagctagggtattgggagagtatatgcgttgtgccaagaactcaccagcaaagctcgatgaaaaccaaggtgtggctccttgggctgtttttccataaagtctgatatcttctttcttgtcttccacttctcccagttaacggatacgattataaaataatggaaattttgaatgttctctatccacacatccgaagcagagcagaatctttaaaaggaaaaagattggatagtacttttttgcatagatatgtgtcatatcttgagatgacagacttttaaggatttttaaaatgttttaaattaaattcatgttggaagacatttgctttaaagaaatacactgttttggctagagattaaccacagggactcgcacatgtttgcatgctctccagattgagctatgacaccagcttgaagaataactttctgtaacacttttactgactttgttttttgaattgatcattcatgtataatgtggattctgattattaacccttcccaaagaaatattttttaagtattaaagccttacaatgtttattgcaccaatgattgggtaaactgtgtaaacattggcactatgagaaaatctcaaaacccatttggatagtttaagaaatgtggggtctatgcatagatttcgcacatatagcaaactgattctctgtagagtgttcaaactttgctagaaattcaagtctctaggaaatgacactggaggaacaaattctactttaaatgtcttgctagcatatcttacagatttctgatttctattcatactgcagtactgtgttcttcctctacagaggagaaactgtgaatcttcagttatttcctttcgaatctgtgaataagcacagtcttttgcagcctcctccctcacatttatatcattgacctttgcatcagaaagcagcagtctgtaacagggagaccatgaaagagagtgttgtacagctttattctataaaagaagtcacacaagcaaagctttatgtttggtgagtgatttaattcttatacattctgaaattggctgtggaccattagaaacatgatgaaaaagcacatttagtgcaatatcacaagcaaactctactccattagggttttttgtttgtttgtttgtttccttttgttttaagtgaaaagaaagcactttctttcctgttatttaaagaaaatctacctaggaaaagtgaattgtggtatctagattcaatcactggcttcatcgagattcctggaattactctggttgattttaaaataagtaactaagggttatattctccaggggaaaagatgccagctgacatcagtgttttgagtgcccagaacagaattctaaagggaaaacatagccagcaacaactcaggaaacatggctgtatcatagctacagggtgtttgtgatttagtgtcccatggtagacgaggcagatcctcagacctcagattcttgatccatttgaatactaagtaaagacttagaggaatgaagagcaagcatgttttcatggatgactgaaatgcttgaaacttggctaataaagtgcagttaaaaatctgcgtaagagtgactttctttgtacttttctcatatgtagaataattatgaccccttcttactgaatcacaatgccttgctttgtttcagacatgatgaatgttcatctttgccagatcatgtagtggctttggggtatgcttgtgtaagactagatatctatcagaatatcttttctgttttgcaaagttacttaagaggcatgcttggtaaatgtctattgaattttttaaaagagtagagctcaccctctatatggacagtacaaaatttaaactttaatctaacttgagtatctaagtacttgatgatgtattctcggagaaccttgtaccttgttaccttatgatagttatcagattatcagattgttcagcttctcttggggaacatttgacttttactggcagtgaaaaagagacattatttattctagatcaggtagaaaagaatcaattgtcagaacctgtaggatggtgagctatgagaaataaacctaactcactgactatagacaatagctcttccttcccaatagcaaattagagattgtgaattctactagaagaattatccagaggattaatgacaatattacttattaacatagttctttaacacagaggttcattgcttattgttattattttattattattattattattattgctatcttgttgctgcctctaggatatctccattttaagtcctttttctgtaaatacaattatttgccaggaaattacatggctgaatagtctatgtagctttgaatagaaatatagttcaatacatgatttttatttaagatacaatatttgagtggtggtaagtatataatattaacacaagactgtctttctttcttttctagattaaatttatttgagtaaagctttaaaaactttccatgtaaaactgagtagatttatttttctacttttctactcctttttgacaattcttcagataaccaagaggaaaagaaaaagaaagctgtctcagctattcttcctgttgttgtgataaaatactcagcaaaggcagcttattgtcaataggatttattttggcatacagctccaagttacaacccatcacagcagggatgtcctgataccagagacctggtcttattgcctagccagccaggaatcagaggaaaatgaatgctcatgcatggctgcccctttcctttttctgcattccagaacacaagccacttttcagatggatcttttcccctcaaataacctattctagataatctctcatgggagtgcctcaaattttgccttctagatgattccagatcctgttaggttgacagtcagcattaaccatcacagaagcaaacttcaactctgaaatattttcgtaggggtagaacataaaactttttggttgtagtagtggtatagtaaactgagaagcataactcattaaaaaatatcttggatttgtaaactacaagtagagtagatttttaaactgcaactagagtatacatggttagaagttctattacttctacaaaattcatttcagagtcccagtatctccaaatttagaactttcattttttattatagtaatagaaagtggggatgacagggaattgcattaagtgatatgttaagggccatttaagtattaatagttttaacttggcctcctgtcctgaatcagttcctttagggagtcactgttagcaactaaatctctaagaaaattatttttaaatgcagcttttggtttaaccatctcctatgtagtgtgactgctgccaagatttcataaagtctaaacttctgagctctacaatgaacatgtaaagaaacatttaaaatatgtaaagaaaggcattttcctctgagccttgtggtgcacaactgtacgtacttagagcagtcagacggctgagagttaaggatcagcctagactggatgacattctgaatgcccatctttaaaaaacaaaacaaaacaaaacaaagacagcatccctattgaggacaagtgtaggcaaagagaaaatttggtttttttccccctgaaaataccctggcaattagtgtttttaatcttttcctcttccctgtgcctaatgccaaaacttagtctgtatatttattgaaaattcatgggggtgttaatattaagtatgtacaacaaaccaaacctttactttcttgacatttttgaggttgtcacgttggtaacatatcatccctgaattaagaacccactcatcaaggtgtacaacattagaacagtctgttccaaaacacagtctctggacttgtgctaggtcttgtcaataggaaaccacatgataggcctttgtctcaggactttgataatggactgggggaagaagctttacatggtgaaagagtacagaataaattacctttgggattggataatgcaagtagatctctgagtttgaagacagccaggactatatagagaaagcctgtctcaaaacaaaacaaaaattacatttggtattaaaatgtaaatgtgagaagacacaagatctctgtggaccagctaaagaaaagtcttattggaagaagccctgaaagcaggaaaaattttagaggtaaagaggaacatggactattctaggaaagtgtacagaagaaataactctaccaagagttacttgaggaaaatgtgagagaagtagatggcatattggacataatggatgactgtaagagcatggggtagacaaaatgaattgaaagttacccagagaaacgaccgtgagtggactaaatgctgtgagaattacacctgacgcagcccttttgaactgttgtgctttgcgccatgtgttatggtcactttgatgacttctgtttcattgaatagagtctaccaggctgtggttttacttagacatacctagaatagggtattgggtcccctagaattggaattatgggttgtgagcctcagtgcaggtgctggaaattgagcttgggtccactgtaagatcaaaagtactgttaattactgagccaactctctaacacattactgtgtatatttctgcacctagaaacagactagctctggtcttcctaaagcccatgtcttcatttctccacgaaccactgaagtctttgttcaacccacttcctatttcttgccataggagtacaacaagacccaactgatgttcccaacaacttgtaatagtcagatgttgaaagcaacctaaattctgtcaggggaattaagtaagagattgtgcatttgagtaatgccattatatgctgctatgaaatggttctttaaggggtgtgatgtagtgcaatggtaaagtgtttgcctggcatatatcatccctttggtttgaatcctcaaaactgcaaaagaaacctgtatgctgttatgggccttctctgctagatgttcatatagatgacaaccgcaggacatcttccttttgtcccttcagttcactgttaaccctgccctgcctgtgtttggtgggaggctgtcttacgtgggtcacagcaaggaattttctactgtgtgacagaagactgttttgtataggtcacagcaatgaatgttcttgccctttgagttctgttttgattcattggatgggagtccctaactaaaacaaaacaaacaaacaaacaaacaaacaaacaaaaacctgggttcggtagcacaatcctttaagtccagaatttagaagacagaggtaggtggatctctgtgtgtttcagactggccaggtctacatagtgaattctaggacaggactacaccagagcggtggttcccaaccttcctgatgctggggccctttaatatagtttctcatgttgtgctgaccccacccataaaattatcttcactgctgttcttaactgaaattttgctactattatgaatcataatataaatatctgatatgtggcaccctgaaagtgttgttcaacccacaaagtggttgtgacccacagcttgagaaccactgacataggaattctcgctcaaaacaaaaaaaaaaaattaaacaattttaaaagaaaataacacaaaagttttatattttaatgattgaggcattgttattattattattgttgttattgccatttaagaaatgaatataaataaaaattgataggaactaaataaatttttaagtctttatttactttaacttttggggtagttaacagcctaaaatttttatggaaattaatgcaggagttagagagatggtttggtacttaagagtgattattgctcttacagaggactagagctcagttcctagtactccagactggcagctcacaattgcctgtaactttagctccaggatatccaaaatcctctaatgcctttatttttttttaatttttattggatattttctttatttacatttcaaatattatcccctttcccagtttccctctctcccagaaacatcctatcacatcctctctccctctgcttctatgagggtgtttctccacccacctacccactcctacctccctgcccttgattctcctacactggggcatctattgagccttcataggaccaaggacctctcctcccattgatacataacaaggccatcctctgctacatatgcagctgagccatatgtactcctttgttgatggcttagtccctggagttctggggggtctggttggttgatattgttgtttttcctatggagttgcaaatcccttcaactccttcagtctcttctctaattcctctattagggactgtattagtcagggttctctagagtcacagaacttacggatagtctctatatagtaaaggaatttattgatgacttacagtcggcagcccaattcccaacaatggttcagtcgcagctgtgaatggaagtccaaggatctagcagttactcagtctcacgcagcaagcaggcgaagaagcaggagcaagagctagactcccttcttccaatgtccttatattgtctccagcagaaggtgtatccaatggctggctgctaacatctgcttctgtatttgtaaggctctggcaaggtctctcaggagacagccatattcaagctcctttcagcatgtacttcttggcatccatatagtatatggatttgataactgtatatgggatgaatccccaggtggaacagtttctgggtggcctttcctttagtctctactctacactttatctccatatttgctcctgtgagtgttttgttctccttctaagaaggaccaaagtatccacactttggtcttccttcttcttgagtttaatgtgttttgccaattgtatcttggctatgctgagtttctgggctaatatccacttatcagtgagtgcataccatgtgttttattttgcagttgggttacctcactcaggatgatattttctagttctatccatttgcctaagaatttcatggatttttaatagctgagtatattccattgtgtaaaagtaccacattttctgtatccattcctctgctgaaggacatctggtttctttcaggctcctggctattataaataaggctgctatgagcatagtggggcaacctaaaattttcatagaaattaatgcaggagttagatggtttggtacttaagagtgattattgctcttacagaggactagagctcagtttctagtactccagactaacagctcacaattgcctgtaactttagctccagggtatccaataccctcttctggcttctgtcagtacccacaaacatgttcacagacaaacacacagacacataaataaaaataacctcttcagaatttaatgtgaaattcactaggcatccccattctagtcatacttacttaattgtgtactccaccttacatcccagaactatgatttaaatactttttagactcaaaatagagaataatatcaagtagctagtctagaaattggtgtgaaatgattcatctatcaagttcttattcttcatatttgtgagacaggagctaggtaaagtctgattcttttctccaatttgaaaggatatctgcagagctatgggataatcctagaatgagaaatagcgtgatatgtgttctaaattctagtgttcagtaaagaaaggttttacactatgaacatctactctccatgagtcctttgtcatgtattttaaacattccaagcacagagaatagaattgtcataaattgttattaatactattagctaaaatataaccataaatttctctagtttaagtggctggggcaatgggtttatgaatttgaggacagcctaagctacatggtaagttccagggcagactatgctaggaagcaagtctaggactctagaaaacaaaaccctacaataataataatccctcttacgtgttttaataatgtattattgttgatttatgagcactggtggtttgactgcatatatctgtttgagggtgtcggatcccccagaataggagttacagagagttgtgagctgcagtgtggatgctgggaactgaacatgggccctctggaaagaacagccaatactcttaaccactaagccatctctcaagtccccttttattcttggaagtagactctagtagaaattcttggctgtgttgagataatttatggagcattaagctacagttttcaaaatcacttacttttattcactgtctttgcttttatttgcagttctgggaattgccaatgcaaagtgggtgtcaccggctccatgtgtgacaaatgccaagatggacattatggctttggtaagacaggctgcttgccttgccagtgcaacaaccggtctgatagttgtgatgttcacacaggtatgtatttttttaatagtatcatgaaattattctttattccttaaatcttgaagccttaatgcattgattcttttcaaatagtttataaggccttgaaattttaagtagatataataaggcatatggcaagtcagacttttataacaacttaaaatatttcatgaatttcaaaaatcatatagattgaagattggagaacaacacaaagtgttgactttgacttcacagtgacagacattgaaaaataagttagagctcttccaagcaagccacaatcacttgggaattcctgtgtgaaagaactgagactccatagcacttagaaagagagaggcagatacaagattgctgagtgaaatttactgtggggttacttacacaactaaagtcaagagtggcagctactctggccaatcctcacaacttgaatcagcaaataaagaattgtggatttaaaggtcaaaggttactttcattaaatctagaatgtagttaatttatctcaaactaacatcaaagatgtctcgcatgttcctggtgccagtagagaagttctagtcataaagttccattaccctaccactctttttcttgtaatctgcagtgtgcaggaaggctatataaggaaaggtataggattgcttagacatagtcataaaagttatggcccaagatgtcttcagctaagttaggctgcatgtatacaccacatgatttctttccagtagagatttgctgattctgagcacagggtatggagtaagggttggccaaaggaaaggttttatacttgaaggagagcttttgacagccatctggagcctgggtggtaggtggaaactagaggagccccaaacacaaggccagttctcccaaccctgactaagacgtctgggccagaagatgttttatgctgaggagacaaaaatccttttaaagagaagagggcttgtcataacatgcagccagctcttccttaatacattgccaaactctaaagattcatggaatgggtatgaatggtggaacccccaatgtcaagacaaaggtctgccaaattcttaatccaaaaggtcatgccaagaaatagtgaagaactagtgttgagctggtagataagaaaacagccatcatgcctgattgaatcgaggccgtcattttctcatatttgcctattagaagaaatgagagcccttttcccttctagtttagtttagttttattttattttgttttttttttttttccaagacagggtttctctgtgtaatagccctgtatgtcctggagctaactatagactaggctggtctcaaactcacagagatctgattgctactgctaggactaaagatgtgtagcaccacacaggtgtgataaacaataaagaacagagactacaaaaatggaaaaatgtggctagtaataaaaatataaataatggaaacagaactacaataatattgttattagaattaaaactgaaatttcaaaataagtgaaactattatattgaggaattagaagaaaaataagacaaaatgattaaaaagatagaatttcaccagagaatagcactacaatgcatgtgcacacacactcacacacaaacacacacgggggggggggggtcatggggtcacagggagattatgaagactagggagatagctcagttagtaaagtgcttgccatgcaagcaaagggacctgagtttaaatcccatgttaaaatgcggggcatagttttataatgtgggtgctgtctaatgtatgtctgtgtaccagtatctaagagggcatctgatcccctgtaactaaagttacaaacagttgtgagccattgtgggtgctgagaggtaaatgtgggtcctctagaagagcagccagtattcttttttttttcaattttttattagatattttctttatttacatctcaaatgctatctcgactaggccatcttctattacatatatagctagagacatgagctctgggggtactggttagttcatattgttattccacctatagggttgcacaccccttcagctccttgggtactttcaagcagccagtattcttaaacacagccgtgtatttctctagccccagtgccatgtagttgtaatctgagctcagggggattcctggaactagctgatgatcatccagtctaccctaattgctgaagtccaggtcattgagactctcctctcaaaagaactggaaagcattcttgaggataacacttgagattgtcctctgacttccacacatacatatgtacttgcatgcatataaagctgccaactcatacacatgcattttcaaaacagcaatctataggttcgtaagatggctccgtggttaagaacactggctgttctaccagaggttctgcgttcaattccaagcaaccatatggtggctcatgaccatatataaagggatttgatgtcctcttccggcatgcaggtacacatgcagacagaatactcatgcattaaaaaagaatacataggtaaataaaaatttttaaatagaagggacctaaaactaaaaattatggtatttgaagttaataacttgttatatgagctaagagaaggcttttagtcaatgaaggcaagatatccacataggataccataaaaactgtctaacctgaagcatccttataacaaggtagtaggaaaggcaggagggatgagacacgcacagccagagtctaacgtaagtgtaagggggctcaggaactgatggccaaacctttctaaatgatggaaaacattcagcctacacgtcagaaagctcagcaaatgcccagccagataataccagaaaacacacacacacacacacacacacacacacagctaagcaaactcagattgtatcaaagtgaacacaagtccctctgatcttcgaaagccctcaacgtaagattggaggaccttcctggaaagtcttttaacatccacatggaaaacaatcaggacatatatgactttaatacgtacatgagatttcatgagaccaggtcatcagactaaatgtaaactgaatggatcccagaagaatcgacactggaagcttattccttttgtccagtgaagtgtgtgtagcgaaatctgtttagacattgtgtcatctgtctgtaatgttctttttctttactgttgcatgtgtcccaaagttactatgcatgttccttcccctgacaagaatggcctttccaactcagctccatccacaccgcagacccctttgccttattaaatcatagatttttttcaggtcttcaacaaaaggtgacttcttagcatttcctgtcgctcctcactaaatgcaaagcctcactacacactgtcacatgcatctgcaagttttcagagtacttggcataaccgatgtttctatgtttacttgtggccattactctcatgtgcacactcactgcatggcagctccatggggcaggaacaggaacggcttcatccttgctgtttgtacaggctctactccaggtattggcacagagtgagcacccacttattctttgttggataaatgaacaaactaatggtaaaatatgaaaaagaatggtgagagtcagcattggataacaagaagaatattttattgggtcaaatcatcagttattccctggatgatttaaagtaccagaaagccatctacaagacttttttttcttcatagcaggtggcagttatcacactgacctgcaggtgctctggagataaagtaaaatgaatccattgaataattcttatttctagaagaaataaatggttcaccatatgaaaagtataaatccaatgtgaaggagtgagcaccttactgaaaacagccagttcacatacaatttttagcacagatgagttttcaagagtactgtggtaccgtcgccctctagtggccactttgtatgtttgcatggttattcttcccattatgtctggaatttctgttttaggtagtttcagagtttcaaagttctcattttgtagtaaaatatattggaaaaaatatcacagggaaaaatttgacagtaggtattaaaaggccctttaaaaatatttaagccagaaattctgttttccggaaccttctgaaaaaataattctaaattcataaaaaaatctttatgaaaatgcttaccagaatgatagttatgacacaaaaaacacttagacactataatttataacaatgcataattaatattgttacattgataatacatggttagaatctcagaaaattaaattttgactatatcttgggcaagttatttaatatgtttctgtatccataaacttgggttaaccacctagtagtttgctgtaaaattaaatacatttgtgcttctctacaaatcatcagaagcagtctggaagtaatagctattagaatgatttcataacaatgtttttatgaatggcttatgtgaatagttgggctttaaaacaacaagtgccatataattaggcagtttcagtgacaaaacccaaatctctataactaaggtaagaggtcacggaaggtatcccaaatgctaatgagattacggaggcacttctcttctccttttacttgttttccaaattttctttattgagcacatttttcttaaatggaagtgcaagagagtcaactattttttaactgcaaactttgttttcgggtagcagacttatgttaagaactcaaggcactcttgtgtcttggtcgtctcccatgggagtgagactcgagcagcctgattcactgactgccttgactgctgagctgctgctctgcttcaggatctcacactctcccggcttctgtcctgtgtggctgcattgccttttctgtcagttgtgttccatctccctagatcagcgctatactggtgcctcctctgcactcagagagagcttagcacgtttgtcccttccacttgagtgatctcacccaggccccagatttagttgaaatgccacttgagttttagctaattctagatgtacttaagttgaaaaacaagaatagccattacaacacatatttgaattggaaaatttcaaaagagttgagcaggtgttttctcagatatattttctttcccctgtttacagagacaataatccataaaattttttaactgtctctgtccatatttaaagtttttactatgtacatatttttggtttgatgtattatgtatttttgtataagcttagtgttgctttttggggtctgttttactagttgcttcagtatcaacttttatttaatagttaaggctacagtatcagtcttcagaagcatgcatataaatatagtcacagaccatgaatacccattggacaggatgtctaccttcgggggaaaaaaaaaaacctcaaagtaaacaaccttaatgctgaggcccactaactactgagggaacttcatccaaagtgacaagccatatgacacccttcccatggtcacaagacccttgtctcaggacaaaaatgaaacagatacacatgctgaaagtaaacaaaaatatttaaattatatataggtaaaataaatattattcctggtaaaactcaatcatgtgattctttctccaatttttttgggacagtctttagttttagtcaactgacaagttaaatatgtttatgggcttagtttcaatacctggaaccccggggaaagatcacacaggtattagcacgtcccatcacttctggtaggcatcaagaccttgttgttgtcaaatatacatcagttgtagtcacctcacactgtaaaagaacagaacttacttccagattttaccctaaaactgattgactcttttctcatctctccccgtccccccattaatgttgctttttttattatactttattttatatatatgacttttttctgaatgcatgtctgtgcaccatatgcatgcagtgcccttgaaggccagaagagggtgccagatctcctggatctggagaaagatgattgtgagctgccatgtggtgataggaatttaaatgggggcctctgaaagaatatgcagtgttcttaaccactgagccatctctccaacccctactgtggctttctgaaattctacaaaattaattttctctatatatgccattctttgtttttcaaccaatgctgtctttaagatgcatgtttgtatgcataagtagttcattatagttcatagaagtatccaaagtatgaaagtgccgcagttatatactcttctattaatatatattatcttattgttttatttgcacaaagttagtctgtttttagtatatagccaatcaatgagtgcatattgtgactataatcacatacccaacttttctcttatagaacattgaattcctagacatagctagttcagaaataaatcaggatgggctggaagaatgactcagcagttaaaagcatttactgttcttgcagaggctacacggtgggttcccagcacctgtattgggcagttcacaagcacctggaactccaattgattagagttccaattcctgttgctggttgccaagggcacttacacaaacatgttacacagaaacacacataggcatatacacgcaagtaataaatctttttaaaaaatagatctacttattttatccatttatgtgtataagtgttttgtctccgtgtatccccaaaaaggtcagaagaaggtatagagaatccctttgggctgcagtgacagttgtgaggtggcacacagatgctgggagtcccagattgtctgtgaaagctataaaggcatttaaagatgagctatctctttatctctaaatctctcctctcctctcctctcctctcctctcctctcctctcctctcctgtcctctcccttcctttcagaaaataacacagaataaaaactaaatagtactcctgcttctttttctgtataatctgtggtcttcctgaagcaggcaggattctaaagtttgctaactctgaaacaataattcttttaggtgcttgtctaaactgccaggaaaatagtaaaggggaacactgtgaagaatgcaaagaaggattttatccgagtcctgatgccgcaaaacagtgccatcgctgcccgtgttccgcagtgacttctacaggcaattgcaccattggtaaggtctttctttaggtctttacttccttctccgaagtaaactgtattgatgaattaggttctagagggtatatgtgaaagggagttattaaaaatcacaacagtttactttctaagaatttatatcaaattctaatccgcatgtgaaatgagaattcagatgtcctagccaacactgtgcactgtgtatctggattctctcatgtggcatactttcagagttcatcatattgaaaaaggtatcagtaatgcatactttttttgtaaattgcatagaagctacattttatttattctttcctgaattggtggacatttaaaagtgatctgctataagtaatgcagctatgaacatttctgttcatggttttgtgtatataaatgttgccaatacaccctcaagttttccccactactggagattgagtttgggaacttatttgttgggctagcaaagcgctctgcctctgaattgtattccccagtgtttgtgtgtacaaggctgttcatttctctggggcatgtcactaggagtggaatttgctatgtcatttattaattctgtttaactctatgaggaaatatcagatgattttccaaaataagaacacaattttatattatcattttgtgggggtggaataagtatattttgtatgagtttgtttggacagagcatgttatatattaaaagcaaagatgaacatcatgtgtcttcaacctccctccaccccatatgtttaagagttttttgtttgtttttagttatgtgtatacatatgtgtctgtggactatcatgtacatatgagtgtagtgcctgtggagaccagaggagcatacaatcctctgtgttgagatgtctccctgtcctccgacattattatttttaggaagaataaatgagggttctaaattgtcgacagacttaaaacacttactagctatcttttttatacttaaagccatcctagtagatgtgaaatgacattcactgcattatggttttaatttttctgtctctgatagctaattttatggttatttaccaatttagaatttcttttaagaaaatactttttgatattcttttgttcatcttaaaattatattttttatcgttgtgtttatagagtagtatacacaaatcacttgttagatatttgatttgtaagaaatgagtatataattctatggaaaagtcattgcctagtaaatagaagatcctgggtttgatctctatttagttataaaatatttaaataaaaaggttttaaaaataatttataaatattcccatgacccaatttttcacttggtttatctcctttttaacaaaaatgatttttgtttgtttacttgcataatttcagaggcattcagttcaattttctttcattgtttatattggcttggaatttctcatgagactgtcgtcaagattttaggactgtagtcagtactttgaaggcttaattgggactatagaatctgctttcattatggctaactcatatggctctctaggggcaaaaaggctctgttagtcatcataaggacattttcattaagctaattaatatccttgcaacatggtaacaggcatctgctacaatgaatgatccaaaaacgggaaaaatataagccgtggtatgttttatcatgtagtctctaaagtcacaggggtgtttgcaataccccattaacttattcatgcctattctgtcaagtatgaacatgtgatcccaggagttgggaacatttggcagcatctgggaagtcagttgttacgcctagaaataggaactggcatgtttctcttttcataggaagctattaaaaatctttcatttattccacagatagtaattaagaacctagcacatgcttttttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatccatgggactagatgttttcctatttttcctaaagaagatgattctttcacatagcatacactgttatttgtcactgtataagtatgtatatattgaattgttagaataagttaggattgttattttgaatcaggaatataaaaattgaatattaatatctaaatgtcatctgcaataaaataattctagagaatataagaattctttgtattggcatgctgttagcaacaatttaagacctttataagatttgtatatcagaactgtggctgctcaagttcttggctcatcctttacacacagggctttacttaaggtgctactttctttagttgagtgattcactgggttctctttcatacaatgaatttaaaatgtagaaaatttccatgaaaagaaaatccctgtgaaaagtaatgtttgaaagcctgtgtttctatatgccttttctatacactatatactgcattagaatagagatgatatctgtatttctaatcatttaatctctagtcccattgtcttattgttggatgagtagaaaaggagataactatctcaggggagagactaattacttatataaaactgaattgggagccctttggagagacttactgggaaagacagaaaaagaaaagtctttatggaacagcttacatttaaatggagccttggaaagtaaggactgggacacttggagatgtatctatgtagaggtaatagatcacagctagagactgcactgggacatgagcaatccagttaggcatgcatgtgcctataggggttgaaagtactaagccagttcagtttgagacttacagagaccactgtaagcagtggcttagctaaactgctttgtgttcctgacaggtcgcatgggcacacccgcccaagagccatctggatttgcgaatgaaagacacactcatacagcagttaattttaaatgtatgttcactagctcaaaggatgagcagttctaatccttcctgaggctagcacacatttctctccaatattcctggcttaacgctctaattctgtattttatctttgttgccctggctccttctaggcggcccactagtctttgctgcccaagacgcttctagtagctcttctcggggccacattcctttgagattttttttgggggggggggtaactctaagtctgatctgccaccctccgaatcctggtgattttcttcttttttctcttccagtccttagaccacacaaatctaaaggtcttgtcttattcaacctgtctagctggctggctgttggttatttacttacttatttcactaattatttttatttgtttacatttcacatgatatccctgttccaagttcctcctccacaaacctcccatcccattccccttcttccacctcccctttgcctctataagggtgttcccccacccagtcatccacacctgcatcaatgtccaaacatcccccttgatgctgtggtattattaagcctatacaggaacaaggaacttccctcctattgatgtcagataaggcaatcctctgttacttatgtacctggagccatagttccctccatgtatactctttggttggtggcttagtccctgggagctctgagagatccagttagttgaaatcattcttcctatgggttgcaatccccttcaggcccttcagtcctttctctagttcttcaatggggtccccttgcttagtccaattgttgactgtgagtatctgcatctgtattagtcatgtgctaacaggaaccataccaggctcctctcagcaagtgcttcttgtcatcagcaatactgtctgggtttggtgtctgcatatgggatggatccatttttttccccgtctttcctttggacaggaatatttctgggttaaaaattttgagatgtgtgggtagctccatccctcaacttgggtccatgtcaatctactagaggaggtctctacaggttgtatctcccctttgttgggtattttggctgaagttatccctgttggtcctggtagcttcttgcttccctggcagccaggactttctagtggctacccccagttccccatcctacactgctacatatttctattcaatttcatgatcttctgtatttctctcctgtcccttctaatacttgattctgctctccctttttccctctccctactttttccctctcagatccctccctcctgtgattattttgttcccccttctatgtaggattgaagcattcacactttgggcttccttctttttttttttaattaggtattttcctcgtttacattttcaatgctatcccaaaggtcccccatacccatccccccaatcccctactcacccactccccctttttggccctggcgttcccctgtactggggcatataaagtttgcaagttcagtgggcctctctttccagtgatggccgactaggccatcttttgatacatatgcagctaaagacaagagctcccgggtactggttagttcatattgttgttccacctataggattgcagttccctttagctccttgggtaatttctctagctcctccattaggggccgtgtgacccatccaatagctgactgtgatcatccacttctgtgtttgctaggccccggcatagtctcacaagagagagctatatctgggtcctttcagcgaaatcttgctagtgtatgcaatggtgttagcatttggaagctgattatgggatggatccctgcatatggcaatcactagatggtccattctttcgtcacagctccaaattttgtctctgtaactccttctatgggtgttttgttcccatttctaagaaagggtaaagtgtccacactttggtcttcgttcttcttgaatttcatgcgtttggcaagttgtatcttatatcttgggtatcctaagtttctgggctaatatccacttatcagtgagtacatagtgtgcgagttcctttgtgattgggttacttcactcaggatgataccctccaggtccatccatttgcctaggaatttcataaattcatttttttaaatagccgagtagtattccattgtgtaaatgtaccacagtttctgtatccattcctctgttgaggggcatctgggttctttccagcttctggctattataaacaaggctgctatgaacatagtggagcatgtgttcttcttactggttgggacatcttctggatatatgcccaggagaagtattgcgggatcctccgatagtactatgtccaattttctgaggaaccgccagactgatttccagagtggttgtacaagcttgcaatcccaccaacaatggaggagtgttcccttcttaagctctatatggtttgtaagttgtatcatggacactctgagctttggtgctaatatgtacttatcagtgaatatatactatgtgtgttcttttgtgactgggatacatcactcaggatattttctagttccatccatttgcctgcaaatttcatgaagtcattgtttttaatagctgagtagtacttcattgtataaatgtatcacattttctgtatccattcctctgtttaggtatgtctgggttgtttccagcttctggctattgtaaatgagactgctataaacataggggagcatgtgtcctatgttggacatatgtgtccatatgttggagcatcttttggttatatgcccaggagtagtatagcttggtcttcaggtttatttccaatttactaaggaactgccagattgatttccaaagtggttttactgttggctctttattgattaatcaaaaactaattggagacaaggaccagcatttagcatttggacatatagatttttgatttggggtgctggattaattcaaagcattagaatcaatccccaacatttcaccttttccggctaatttttttttaaaggctcttctcgcagacataaattgagcataaccataacaattatgtaaattataaagtatggtatacaattaacatctggtccatcatatttgtcaattagataaagtactagatcacctattctaactaaagagcttataattctatacctgaattatgttttgattttagccagtatcaccatataaaaactatctttttaactctatatcatctttctcaatgctaagtaacttgagtttgattttaagactataactagcaaccacatcagaaatccaagaacaaatattacctgaatatttaggaagcacaaaagcatcgcttccaaaacttaaattgtagagacagctgactacctagacagtcttctattcctcaaaacatcaaagaatctgtctttagtattttggctcagagccatctggcagaccttgaaatgaagcatgaacttgaaggactagcttaccctgtattggcagagcttagcagtgtgactattccacatctgtttgttctctttggacagtatttttttctgtagatgaatagggcaaattttgtctagtggctaccttgtcattattggaacaactctatatggaagttttgatgctcagtttcttctttggaaaaaaattgagaagctgtcaggaacagacctgtctcattttcaaatgaaccttaattatgtaataacattaaatgtcatattctgtggattttttgatgtttttgaagactatctttttatgtaaagtatatctgaactgttaaaccttaactactcttagccatttctatttgaataaattgaaaacaaattattataattcaatcaaaatctgacataaccatgagttcactatctggccctttaacttgggttacttgatcatcctaaatggtttgtaatagcagctattagaatgaatgggaagccttgtattcgtaaatgagtttcatagggataatccctatctaagagtaacaatattaatttcaaattttgtatcaacataaagatttctatcaatgaaaaccttaattctatatgaatatataaattctgtaccaatataagaaattataaccttaattttgtatcaattataaggatttctattaatgtaagattatggctatataatgctttaagaataaatttagtaatccatcccatgtatttcctccctgttcaaaattatgaccatttccaagttatcttttacaaagacaacctatctataatttataaaataatcatacccaggctcccaaacccaagggatcaggatgatgactttccgtggcttcttcctgctgaataggggtcatgagaaattctttaaagcggtggggggagtaggaaaattagaaaaataggttagaattaagaaagctagcttctgcatctgttacccagcctctgtatgcttagaagactcagggcttgggggagatttttcactggatctgtctgagaggttggatgaaaccagatcatctggaatcaagtagggattccttaagctcatctggaagcaagcaggaagcagggtgttggaacagcaggtcagtttatcatctctaaagttgaatcttgtcaaagctgtacattctgtagtatatgaatctcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctttctcctttcctgtcaccaatacgagcctctctcccaaatactatatccttggtctagtgattagaaatcattaaaggtgtagcttgtcctctctcccggagaaattttaaagtaaccaccaaattcataaccatatgtattttgataattaaaacaattcaaagcaattaaagcaatctaaacaaatattatttgttgaggcaatgtgtcttcactgtcccctgtcttgttctatatgagatcaaggcctaagttatttatacatctatgtaaacttaatcctctcttctatggacattatgaaattctatggaaatctgtgggtacatatggtagtatgtcattttctttttatataattatctaggcctaagtttttttttttgtctgatataggttaggctccctagcccttgcttttcggtcaaatttttaaagatcaaaagcctcagtcatttatacattcatgtattcttactgtacatgccaatttccaggcgctattcttgtcatgccaggcaaaatcaatcccagaaatcccatgtagatcatgttcaaagatcccaagtatttgccctggcaagactcttaaatttctttaaagcatttttttttcatttaatctccctaaattcttccttttgcctttattttctacatttgagatcaaaggcttggatttcttaatttgatatatatttaagaacattttagcaattatcattctattttcttttatccttaaaaataattaaatcaatttttatttatccctgtctattgattctttgtttgtaggaataggctgtgtctatcatctgactctgtttcagagcagtcatcttgtctctttgtatagcaggggctcccagcatcttagctaaggctctctgaggaagctagaactcttttaaaagggcttagggtaaatcccagcaggaggctgtgttcctttgttctagtttcatggcttgtgtgggaaccacatgtgactcagcttctcttgctgagaagccagttcttcccctcctcataaacttatctcttatggtgcatgtatattccattcagaaatctaaattatttttaatagtgagggtttgcctatcgtgttgcatccatctgaatgatgaggattggttctaatgctctgaattaatccagccccccaaatcagaaatcagcatgtccaaatgctaaaggttcttgtccccaattggtgtttgaccaatcaataaagagccaatggccaatgagtgggcaggtagactgaggcatgacttggggatttgcatgggctaggaactataagagaagagagagataaccatgtctcagagggagacagatcagatttagagtggcagaagaaaattcatccaaaatgtaggtgcaaagggaaactggccctatggaaggggctgcccagaaagtaatagggcatcaaagatgaaacatggatttagaaggtgttgagccaggactacttgagggtaatgtaggctagcctggtgaaggattagaactgcccagccattgagctaggcaaaacatatttaaaattaactggtgtgtgtgtgtgtgtgtgtgtgtgtgtgtgtgtgtgtgtttcatttgtgaatccagtaaatgcttgtgcaggtacatgcatgcaactcatcaggaacacaaagcagtttagctaaactgccactacagatcactgggtataatgctcaaacaacttataaataaattcagtacagttagtaagtttataatataatgggtgcactaaaaagtgtcttagggtttctattactatgataaaacaccattaccacaagcaacttggagaggaagggtatatttcattgtaaactttcaggtgacagtgcatctgtgagcaaagttgagccagacctcaaatcaggagcctggatgcaagaactgaagcagaagccacagaagagtgctgcttactggcttgctcctggtgacttatcagtctgcttttttcatagcatctaagactttaaggtgtgctaacaccatagtgatctgggccctccctctgccccatagtcttgcccatagaccaatctatggggacattttctcagttgaagttgcattttcccaaatgactctagcttgtgacaagttgacataaaattagccagcacagaggggaacattcgatactagtgagggagagtcagtgatagtttctgaaagagatggtcttgtgatgagaaccaatgagagcaaggacatttcaattcatgaaatcattatcccagtcagcagtaggaaggaagagtcagaagaatcaaagttcaaggttagcctgggctacacagtgggacactctctaaaaacgaacaaacaagaacaaaagcataacaggaatgttaaaaatcactgatctgagcaaagaatatcttagatgtggcagaagcaaagtgcaagggaggaggaataaagcaggagacagattctgaatatcatctcatgaggtccacagaggatacatatcagagagatgaaatactctcacaagcctccatttcagcccttcaatctattctatctacaaggttttgaaatgagtttttgttgcctataagaatgaaaacatggcaccatagtgagttataagcttcttaaaaggaatgtatttttttgagtatttttctaatatatcatctgttacaagcattctgaattcattctgttttcattgatttttatgcaaattaatttaagaatttctggctcaaagtccttgtttgaaatatagataatcaaggttctgagtttattacctttagttgatccctcatgacctactgagactataaatactaaactaaatttgtttatcacttatacaactctgtggcttatactcaaaacactggacttgtatactttagatgacacattaagaattgtttctcaaatgaaactcttaataacatagacagatggattcactttttatccaaagtctgaggagcagtccgtgctgcagcttttatgccaactgtaaattattctttctgtaatgaaatactgtgtttagagagcattattattctgtaagtaaatttgtaaattctaagaaattaagaaatcacttatcagccaggcatggtggcgcatgactttaatcccagcactcgggaggcagagacagaggcaggcagatttctgaattcgaggccagcctggtctacaaaatgagttccaggacagccagagctatacagagaaaccctgcctggaaaaaaaaatcacttatcaaatctaattgagaagcctaaactaaaatcatgtagagatttgaaaagagcagttaagtatgaaccaatatgttctcactatgtaagatgaaattgtgtaagtagcaaacatttattgaacaaagagtatatgtcagatattacaaaaatactggaggtaaaggtggaacacaagtagcttatagtttagttggtgaaataaacaataatctaattattgcatcttaaatgttaagtgttataggtgaagatagaataacactaacctaaacagaaaataaggaacaaacttttttgcttctgagaattgatatatgaattgctgcagtttatctctataaggtgactaatggtagggggcaagaggatgctgcatatagcagaaacagtatatatgaaatgttagagagaagaaagcaagcattctttgggagtgtcctaaagcatcagacaagcttgaaacaaagtagataatgaagtgtgaagagatatgagaggagttaagaaaagtaggcagggcttacaaaattttcagtagaagattgtattaaattttcacttagttccagagccattagaactgtagcaagttctctagggagacagtgtgtgtattcagaattactttgaagatcatagagactgtaggactatactgcagtaaagacgccttaggaagtattgagagatctagaagtaagaaatgattacagccttaaccaggtgcagaatattggagttgaaacgtcagtaggttgggaatattttaatatatcactgaattgaactgataactgcccaaaagcaaataggagatgggggctgagatttccttcttagctttggtacctaagcaagtggatgtatgttgggaccattcactaaaatacaggaaacttgtttggacaatcatctatgttaaatttgaaatgcttgtagacccagatatacaggcaaattgtatatcatatacagtttgtaatttaagacagagagatggactggagataatacaatttccattgttgattatacaagtgagtgaactcacccatggaaaatttatagaatgaaaggggaaagaaaccaagcgtagcactctgagaataatggtcttgggtgtagctcagtggcagaaggtatttgccctccatggaagaggcctcagattaatacccagcaccacacaaaagaaagagatgcctaggagtatcaacgtttagggaagcaagagatggaaaaagtttctccttaacccatattctatggagtcttttatgcctcaaaggaaaaaacattttaaaaataacaaataaacatacaagcaaaaactttttaaggaactgtgaggtggttcagtgggtaaagatacaagctagtataactgacaatctttgagtttggtccccagaacctacacaatggatggaaaggacaccagcaagatgtcctctgacatacaaacacatagtattgcccatgtggatcagcgtatatgcaatatacacacactcacactctatgcaagtgacaatacttcacagttattgaaacttctagtcaaagcatattttttttaccctttacttcagtaggctttgtggataagcccatcattccttcaatacattggaaagttaataaactatatagactattggttctgtatgtctcttgaaagaagataccagggaggatttttaaaaaacttttggtgggcaaatagttttctatcttttaatgtagcttgagactttactaaattattttaatgttcttcctatttctatttctattattctattagaatctggagagttggagcctacatgtgaccaatgtaaagatggttacacaggccagaactgcaataaatgtgaaaatggctattacaattctgacagcatctgcacacagtgcgaatgtcatggccatgtggacccaattaaaactccaaagatttgcaagcctgagagtggtgagtgcatcaactgccttcataacaccactgggttctggtgcgagaaatgcctagaaggctatgttcgagatcttcagagaaactgcatcaagcaaggtaaaactccaactaagattacacactgagtatctgaggctagcattgaatgttgcaagacagcttccattagctttgtacaccttccagtcctaccagagaagtttctggaaataaattttgataggtatttgcctaaagagggttctttcccatcttactgtcttctgatcctccagcatcaattccagaaacatgaagaccaagaccaagtcgttgtgacaatgagaccgagtacactcatatttcccttcttctatctgtctgttagaactgaaaggtcctgaaagttcttttcctttgcttcttgacacatcatttcagtgatcatcaaagaccttttcagggacggacctatactcaagtctatcttgaagttccatctgggaaactgcagttctttctagcctcttcacacttttgagctgacatggctctgtgtgtgatagatgaaatcttattaatattcactttgaattttaaaataaaaagcatatgatgaaatgttccttggaggagtattcagtgagaatttagaaaaggttaagttatgacttcaggaggagctagggatattcagggattactattccacagagaaattaaatcccacaatgtacaaactgcaccttgatattccaatatacactgattactgaactgaggtacaattggcctctgaccagtggcatctttttggtattctactacagtgataagattgaaccacatcactagcttaaaatgctgtcacttagcatgtgtccaaacaaaagtgcccagaagataggattgtgatgggatttttttttttttttgccatgaaggaatacaagctttggctatttttaggctaactaatgtagtagactgaagtgatgaacagtaatagctatttttattataattttattgagtacctataatgatcactaatatacacataaagtttcccaagaactctgtgaagtagacattattattcgtatttaacagatgaagaatctaaaattctaagagattaacttacttgtagcccaaaccactccaaaacctagcccaaagcttttcagccttccactgagctatgctatctatcataagaggtctaaaatgtagctccttgatcataaagtaattcaacaacacacaaagcaagagctctctacacatggaattaaaggaaacctcttttctcttttggctgacaataactctgagcattaaattctgttttctggaatataattttatagtttctttaaggataattttactttcataaaattccatcagatgtgatggatatattctatgtcagaaaattttcattttaaaccatatgatttagagcttaatggtgacatatttacagcctttgcagaaatgtccatgatagataagaagggtggaaaacgtccatgttagaatttttctaaaggtttggtgtaggtgttatacacattaaagaacagacctggatgtaagatgtaataaatgagctttccagactccatttcttatcattgtatttatttaaaaattatttttaacttgcattcctctaagcagagtaccatgtcaacattccatatcaactttcactttcatgtgtatttcttttattgtttctcaaaactagataattttgtcttttacatttcattctctgtttttattttcagaagttattgttccaactcctgaaggttctaccattttggtttccaatgcctctttgaccacatcagtgcccacccctgttataaatagtacttttgcccccacaaccctgcagactatctttgcagtaagctcttctgaaaacagcacctcagctcttgctgatgtatcatggacccagtttaacatcatcattttgacagtcatcatcattgtggtagtgctgctaatgggatttgtaggagctgtgtacatgtaccgagagtaccaaaatcggaaactcaatgctcccttttggaccatcgagctgaaagaagacaatatcagtttcagcagctaccatgacagcatccccaatgcagatgtgtcgggattgttagaggacgatgccaatgaagtggctcccaatgggcagctgaccctgacaacacctattcataactacaaagcctgagaagctgagttgtcctcctggattgtcagaaaacagtgctcacttaaacagcacctgacctctggctgcacagagcctaggtagagtttgttgagaaaggtattgtgcaaatgttcaggtacaaactgtagtgcgcttagcctgtctgttgctctgaattcccccatgaagatctgaagcactcatcatcgaggacttgaagtaaagtatatttttgtagcaaaccacatgtatatatggaaaggctgaatcccacagagcagcctaagtctacctggcctctcaaaggactgctcggaaagtgttcacctcaccagatgtgatagaatgttgatgtggaggggaaagactgatggaagaattcatctccactttggaaacatattttataaaagagaggcagggattgtgttcattttactgtactaagagatgtaacttaggaagagatgatatctaggctaataaaaaaaatcttggttgtgtgtagactaagggtagaaaggtgccaagaagttctgtagaagggcttggctttccttctaagagtctccttcaaaaatggagttaaagcacaggataagcttccttggtgagggtaggcacagcaggcagagagcagaaagctgatggtctcctcaaagaggttcctgcctctaaagaaacaaggtgtacataattaatgtagcattatctggtcaacattgtacttgtatctatttgtaaaaaatcatgtcctattttatcatctagactttatctgtatagcagttaatggtgttgtaaaaagaagatatgggaacttggttaaaatactgtaaaataggtgacaatattgctagagctgggactctggtgagcatcagtcattttagtccctatttggacactgttgaaattgataagaggtcaaatgtttctaatctttcctctctcaacctagagtcatatgctctttgacttaccatagattcaagcaatagattttgaagtctgcaatttcgaaactggaacacaggctgcattctccagacacacctaattagccactctgttttacactgctcagtgtaaactcctcaggaaaagacttctttcctgaatgtaaaagacagtcttccaaaggacagaaattttaaattaaaaagaaaagccatcacatcacttcggggttcttgtttttgtgcccataaaatatttatgtgcctcccatatctgccaaaataaaggcctctgacatttgagcataacctgtcacccatgcaccatgaggactgtttggcttcttcagtgctggagttcatccatcttcatatctgggcagagggtcactatgggtgtgtatttagtccttgctttttgatgccattttccctgaggccaagtactgctgctttcatttgttatgcatccataggttgtagattgagagccaagaaaggtgactcagactatgaagtaggggaaaacaaaacagagtagacctaggaagctcagactccttttcttacttcctcagaaaaataaagacgttggtcatcctttgtaggagaccccacctttttctcagggtttagaaatgactgtatagaggatccataggtaacctgggtgtgctctgcatttttggctgtctttataaaggtagacattacatctcattgtactaaaacaatttacaagtgactgattgcctagcatatgagtctatgggtttaatccttagaattacaaaatatattaataatattttgccctttgtcatttaaaaaacacctttccatgtgttctttgatcctcaccctagcctccttaggaagtagtcttgtgctcatttcatagatgaagtaactgaggcacagagagtctaagttgttcagcgctataccatgcacatcatcattattattcctggaatcagttctcacctctacttcattgtcattttgctatgtgatacatataaatctactagccatgggccctagaagactggaatggaaattcccatttgtggatgcttctaatagagcccttgtatgctctctagaatactaccccccccccccaccccgccataccatgtgtatatattggggtaggggaagtatgtaactcacaggcacaattcagggccacatagatactaaggactttgttgaaagaacacacatggatttctacctaaagacaagattaatgacgagaaggtaaagctgccagttcattaaaatgaatgaattcctgaattggggaggggagcagagagacttttcctagcagttgcagcacaggtgtgtattgactatacatcacagagttccaaagtgctgagcacaatggctgcctcccagataccccatctcctgccaaaataagtggaaaggagataaaagccaaacgtttgttaaacagttcacacaataaataaatgtttatatgagtttaagagccaaagtaaacagtcgagattccagctaaatagagattccatgatacagatcttaagagataacacagaaactaaaccacaaatttatcaagtacctgttaattgctcctaaatcatgtttttcacaatgaaaaaaggtatagccttaaaatgtgttgtaaataacatcatttagtgaccccgttgctctgcttatacaaattattttgttgtacagatcaaccatgaggtgatctctccttgaaagtagagtaggaaaccagaataaaacatgctgggttttcattcctctggagacattatcacccaatgccacgagtcctctgcaaagcccgatgctggaacaatttttgtctaagcataaagaaaatgttgtttttaaaatatactacatacatgaccttaatgagaaatggatgtcagtgctaggaaggaactaatgcttgcgccttcaatagctcccctgattaagccctgtgcatttctgaaggtggatgttgtacttgtcaaccatgcctttgttcccttatcaccaccatcccctacattgcctccaaggactctcctatttacagtctctccagagaaagcaaaatgataattaaaatctcttatttatatgaacatggtgtggacccagtacattatttttcccagggatacttagattttaagggagagcaacaggacagacatgggctgggagggtaggtttttattgttgttttgatttggtttttagttgttattgtttcatttttttcttttaacaagactatctaaatcccaaattatattacttttccctagtcccaatatttccagaatcattagtcatcaaagcaatactcactggtctaccagttaatttgagttatctgatcatcaagatgttgtggtttagaataagagtcagttagagctttattattcaccattcaccctggtcctctgctttttttatgtttataaacataaaagtaattctgatgattctctctgacttggtgtagtttgaagtggtgtgtgggtaggaggtgggtttctgcatctttcaaggaaagctctctgacaaaatattcatattcagaataagttaaaagaattcagtgaaatcattaggacaacagaagttgtgacctaatccatacacaaataaataaatgaataaataaataaatacctttagtctgttggtacttttgacagcaaatggtttaggacttaagaggtttggtgtctgtctgtgttgtagagctggggaaggtgacagacggttaatttgtcttttgctatcactctgagcaaatggctaagcagcaggaacatggtgattaacctgaagaagtcaaataatattgaatggctaaagattgtggatcattaaaacattagtggtttgaatgatactttttcaaagacattgagaatcttccttgttacttatgcatacacggaaagttcagcagccttggagtgagcccagagcttcagattcaagcttgcccaaagctaaatgacttctagtccacttttaatgctaggcacaagcattctttactcttaaatgtcagtccaatcaattagggtatgtttctaaaaattaaacttgtatttatgtcactaaaatcctaacccaaaatttaaaaacatgtctcatatgtgtgctgtactaggcttcatgatgcatttctaaatttgtgtatgatttgaatatatgaaagaatttatacaagagtgttatttaaaattattaataaatgtatataatttgtaccaattgtagattcgtttcacttttttatgtagtgagagatttaagaagtctacaggtaagtgctaaagaccacttgtcagttcattccatagaagtctttacatcctttctgtactgaccaatattttgtttaagttcatcaaaggagtgtctactacttggggagaaaataccatatggaacaatgcattctcatacagcaaaattcacaccagagatgaaaatatatatgaacatttattactgggccggggatatggcttaggtgtaggtcacttgcataccaagcccaagtccccaagttccatcctcagcacttataataaacaatagcatatatttttgttcacaacattttttgtcttctgtgccacttcctgagatttctatcaaacttatgtgctgttcactgagatttctatcaaaatatgttgagactgattccctttggatttctgacttatacatgtgaatattttctttttttaaatgatttttgttagatattttctttatttgcatttcaaatgttatcccctttcttagtttcccctccaaaaattccctatcctctccccctgctcaccagcccacccactcctgcttccttgccctggcattcccccatactggggcatagaaccgtcacaggaccaagggtctctcctcccactgttgagtgactaggccatcctctgctacatatgcagctagagccatgcgtctcaccatgtgttttctttgattggtggtttagttagtcccagggagctctgagagtactggtcagttcatattattgttcctcctatgagtctgcaaatcccttcagctccttgggtactttctctagctccttcattggggaccctgtgctccatccaatggttggctgtgaccatccacttctgtacttgtcaggcactggcagagcctctcaggagtcagcagtatcaggctcctgtcagcaagctcttgttggcatccattcatctggaataacaaaaaacctaggatagcaaaagctattctcaacaataaaagaacctctgatgaagattttctgaactctggaaatgaagtacattctatgttttttaggttacccataaaagagtgcatctttctattattttaaggttccattgaagaagtttggttgtgtttttgtttttttcctgttaaactgtgtttaatgagatgccatctggttatcccattaaacatccaagggtgttttgaaaacatgcagcaagaagtctctttgcactgagaactttaaaaccttaagtcaatttattctacctcagctgctcatgatagcgcacccctgtgatctcagcacatggaaggtgaaagcaggagaatcaggaggttaagatcagccctgactacatagtcacctctaggctagcccgggctacgagagtctctatcttaaaaagaaaattacatttcagttgaaaaattttaaatatgctttataaacaaaccttcagtagttagcatcatatgtctgtatgatatatatttggtatgttaagggaacaaaataattatgccagttttcaagagaaaaaatatgcaaacaacacactaggagaaataccactaaaagtataaagtatttttatatttctgatgaaagtctataaagacatctccattgcattatcacaactgattgtattaattttcttcaggggagtagaacatgttccaaaagttcaaatgctctattgtaatttaaatgtgacaacaattgtaaataaaaccattataatcagttttgtcttgctgatttttcttatggtgtaggacttcagaagactctgatcctcatacatgctagacaaggtctctagaacttcttctctaccgcttgcttatttagagcttcaaaattaaactaggaatggtgatgtgattcaatcagctgatagaggtacttattgcacaatcctggagactggcgttcagtcgccagaacccaagtaaaggtggagtcagagaactgactccactgagttgtcctcttgactccaacccatacacaaaataatatttttttattaaaaacaacttttatgcaaattgatagtgttaggagtgtgaactaacagatggaaaagcagcaatctatgttagtattaaaaccagtgttagctgtaaatttttaaaagacataagaacaattacagtatgtagtgacaatttttgatttttatttcttaaaaacacacacacacaaaatcacaagtattatcttagggttttactgctctgaacagacaccatgaccaaggcaactcttataaagtataacattaaattgaggctggcttacaggttcagaggttcagtacaaggcagaagcatggcagtgtccagccagatgtagggctggaggagctgagagttccacctgttgtttcaaagacggctaggagaagactggcttccaggcaggtaggatgaggctcttaaagcccatgctcacagtgacatacttcctccaacaggggaatacctccaaatagtgccactctcctggccaagcatatacaaaccatcacaaatattataagaatatgttttcattttaatcccaggtatgcaatatgggactgtttcagattgtccactgcagcttactatgcttagcttcatgctctaacagggctgtgattttaccagctgcagatagcttctgtgattctgtcttttggagttctggagactctttagaaggtaaataaaagttagggcccctagaagtggggtgggttgattggtggtgatggtggtgagggttggttatggtttgttaagtagttgtgtgcaaagaagagattagatatcttaatctaagatcaaacttgtaccaaggaattcaacacagtcagcaggattatgatattgtttccccctttctgacacctgttaccttttttctctcctgtctagtataagggggttgaaagggtaggagaaaaggggtggaagagggtggaggaaaaaagaaccacaaagtagcaaaagacacctacagattttctaatgcttctctttataaaatgaaagccattgtacaatgtcaaatggtattgttcacttcattatattaataaataattttaaaacattcgggatagggctggggagatgattctatcagtgttcgttgtacatgcatgagcacttgggctcagattcccagaactcacagaacaaccacatatggcagtatatgtctgtgacaccagtgttgtacagccagattaggcagctcccagtagctctctggccagtcaatgctgccagtcaatgcagtggcttacagaatcagtgagagaccatgtctcaaaaacagaaaaaacagtagagacgcatgatactaacctctaggactacacacacacacacacacacacacacacacacacattcctgaatacgtatgtgcacaggcatgcacatacaaactactgaacaagtagacatgcataggcatgtgcatgcgcacgcacaaacacacacaccaaatgaaaaacattgtatgctgctgaattgagcactgcactccacatagtgcactccatatgctgtacatgttactttctgccttcctctgtagactctgttttccttacaactagggcgttttaaggaaacctggtatgtgacatattgctgatacttcatgacctcttactatgtggtggtttaaaacaaatggtacttgatgataccaacatagtcggtttatgaactttccaggcaaagtatggtaaacttacatgcagtgggtagaatgctagaggtcagatagggcttctctaggtattcttgtactgttttggtccccaggatggcaatatggaagtagtgaatatttttagacatgacctagtgggaggtgaccaggtctgaggagggattgatgcctttgtcatgggagtatatgtttcctctcacagggagctcctaagagagcaggtactcctattctttctccatggcgctgctggccactcttgaatgttctcccacaatttttatgcatctactgtgagactctccctagaagcaagcaaaagccaatcatactctaaagtgtcctgaaatgtgagctaaataaagctttttttaaaatcaagtactctgccttgtgtattttattatagcaacacagatggactaagaggacagtatttcttattcaataatatatcaacatgcaggcttcaaagggtttgaataacccttcaaattgttatatatttagttcttagtttgtttgtttcatttttctttttttcttagtgtaaagtacttttaattatattctcataaggattaacaactagggattgttttacattttttagcaatagaaagcctcccatagaatgtaaatggttttcagttggtaaattggtccttacaaagaaaaaaatccactcttacaaaatctagacctcaaaacaaaacaagacacaaaatttcggaccaaaagggcagagaattctacacaggtattgttttattttctagacttgtgggcaaagttccttaaaatgggagaaaattatatgtgttcaacaacagagaggaatgcatacacttgtgataatatagagccaagtaaatgattaagatgagttgtttaaaatggaatcaagattaagaaaaatgggatatttaaagacaagcatgacattctactcctgggaactcaattaaagaaccacttgtgtacatgcaccacaagccaaatgtcagattcggttgcaacattgttatagaagataaatagaaacagccatatggctgtcattataagaattgatagattgcagtctctttatagtctcatagaactctatgcagttgtgagagatgcatggataataactattaatcagcttgattagtatgtccaaaaacaacattgaggagaagaaaaaaaaaagcatgtcgtgggaaatgtaaatatagtataatttatcttataaaagagctaagaactgggaaataagatgtgttgtatagaagtatatgcgtatgaaaataaagtaatgagcagcacaaaagtgtaactttcgaaggaaataggagctgcaccaatggctgtgaaggtattagagttgctcatttcagaaaccacacatctatgtgttctcatgctgctcttcctactcatagggaattggtttcaggactctgagcatgtcaaaatctgcaggtgcttgtgtagtataatataacagatattgttatatatgaaacattgttgtctgagttggggtttctagtgctgcagcaaaacactatgaccaaaaagcaagttggggaggaaagggtttattcaggttacatttctacatttctgctcatcactgaggggagtcaggataggaactacaacaggagaggcaccgtgagacaggagttgatacagaggctatggaggggtgccgcttactggtttgctttccatagctttctcagcctgctttcttatagaaccaaggaccatcagccctaggatggaactacccacaatacactgggccctccccaatcaatcactaagaagatgccttacaactggatctcatggagacattttctcaattaaggttctctcctttcagataacagtgcatagtgaaattttttacaaattacacttgtatttatttatttgggttgaggatatatgctggtgtggtgtggtgtggtgtggtgtgttgtgttgtggtgtgtgtgggtgtaggttagagaacaatgtctgaaactcagttctcttnnnnnnnnnnnnnnnnnnnntcattacacttggttgacaagtacctttccccactgagccatctcacttatagggaaaacttaacagagtcagtagataaacatgatttcatctgtgctggtttgaatgagaatgtctctcatatgctcatatatttgagtgttcgagtcccaattgatgcaactatttgagtaggattaggaggtgtggccctattgaaagaggtgtgtcggtttcaaaagctatcaggctcagtctctctctctctctctctttctctctctctctctctctctctctctctctctctctctctctctcccccctacattgccaatcaaatgttatctctcaactacttctgtaacagcatgcatgcctgcttgcttgcttgccacctaccatgaaggagcaggagaaatataggtgcaaaaggatagcggccccatgggagggctgcccagaagaaaccaggacatcaaagacaaaatataaatttagaaagaattaactcagggatatcaaagatgagtgtgctagccttggagaggtttggaagtgcccagtcattgacctagttaaggcatattaaaagataaaggttgcatgtgcatgtctttcattagtgaatccaggggtcttgggaggagggatgcagaggaggcac

SEQ ID NO: 1808 - DNA, 2490 bp, Mus musculus
atgaggagcctgccgagcctgggcggcctcgccctgttgtgctgcgcggccgccgcagccgcttccacagcctcggcagggaatgtcaccggtggcggcggggccgaggggcaggtggtcccgtcgcccagcccggggcttcgggaccaagccagcagccccttccctaagaccgcggctcccaccgcgcaggccccgcggaccggtcccccgcgcaccacagtccgcaaaaccggggctacaaccccgtcagccggctccccggagatcattcctcctcttcgcaccagcgcacaacccgctgccacccccttcccggctctggacctctcgcccgccaccccttcggaggacggacacactcccaccacggaatcaccaccctccagacccgcgcccaccacccttgcgagcacagttggccagccgccgaccacctctgtagtcaccaccgctcaggcttccagcactccagggaccccaactgccgagtccccggacagaagcagcaacagtagcggagtcccgcccaccgcacctgtcaccgaagcccctacttctcctcccccagagcatatgtgtaactgttctgaggttggaagtttggatgtaaagcgctgcaaccagaccacagggcagtgtgattgtcatgtgggttatcagggtcttcactgtgacacctgcaaagagggcttttacctgaatcacactgttggtctctgcctgccatgtcactgcagtccacatggagctgttagcatcctctgtaacagttctgggaattgccaatgcaaagtgggtgtcaccggctccatgtgtgacaaatgccaagatggacattatggctttggtaagacaggctgcttgccttgccagtgcaacaaccggtctgatagttgtgatgttcacacaggtgcttgtctaaactgccaggaaaatagtaaaggggaacactgtgaagaatgcaaagaaggattttatccgagtcctgatgccgcaaaacagtgccatcgctgcccgtgttccgcagtgacttctacaggcaattgcaccattgaatctggagagttggagcctacatgtgaccaatgtaaagatggttacacaggccagaactgcaataaatgtgaaaatggctattacaattctgacagcatctgcacacagtgcgaatgtcatggccatgtggacccaattaaaactccaaagatttgcaagcctgagagtggtgagtgcatcaactgccttcataacaccactgggttctggtgcgagaaatgcctagaaggctatgttcgagatcttcagagaaactgcatcaagcaagaagttattgttccaactcctgaaggttctaccattttggtttccaatgcctctttgaccacatcagtgcccacccctgttataaatagtacttttgcccccacaaccctgcagactatctttgcagtaagctcttctgaaaacagcacctcagctcttgctgatgtatcatggacccagtttaacatcatcattttgacagtcatcatcattgtggtagtgctgctaatgggatttgtaggagctgtgtacatgtaccgagagtaccaaaatcggaaactcaatgctcccttttggaccatcgagctgaaagaagacaatatcagtttcagcagctaccatgacagcatccccaatgcagatgtgtcgggattgttagaggacgatgccaatgaagtggctcccaatgggcagctgaccctgacaacacctattcataactacaaagcctgagaagctgagttgtcctcctggattgtcagaaaacagtgctcacttaaacagcacctgacctctggctgcacagagcctaggtagagtttgttgagaaaggtattgtgcaaatgttcaggtacaaactgtagtgcgcttagcctgtctgttgctctgaattcccccatgaagatctgaagcactcatcatcgaggacttgaagtaaagtatatttttgtagcaaaccacatgtatatatggaaaggctgaatcccacagagcagcctaagtctacctggcctctcaaaggactgctcggaaagtgttcacctcaccagatgtgatagaatgttgatgtggaggggaaagactgatggaagaattcatctccactttggaaacatattttataaaagagaggcagggattgtgttcattttactgtactaagagatgtaacttaggaagagatgatatctaggctaataaaaaaaatcttggttgtgtgtagactaagggtagaaaggtgccaagaagttctgtagaagggcttggctttccttctaagagtctccttcaaaaatggagttaaagcacaggataagcttccttggtgagggtaggcacagcaggcagagagcagaaagctgatggtctcctcaaagaggttcctgcctctaaagaaacaaggtgtacataattaatgtagcattatctggtcaacattgtact

SEQ ID NO: 1809 - protein, 592 aa, Mus musculus
MRSLPSLGGLALLCCAAAAAASTASAGNVTGGGGAEGQVVPSPSPGLRDQASSPFPKTAAPTAQAPRTGPPRTTVRKTGATTPSAGSPEIIPPLRTSAQPAATPFPALDLSPATPSEDGHTPTTESPPSRPAPTTLASTVGQPPTTSVVTTAQASSTPGTPTAESPDRSSNSSGVPPTAPVTEAPTSPPPEHMCNCSEVGSLDVKRCNQTTGQCDCHVGYQGLHCDTCKEGFYLNHTVGLCLPCHCSPHGAVSILCNSSGNCQCKVGVTGSMCDKCQDGHYGFGKTGCLPCQCNNRSDSCDVHTGACLNCQENSKGEHCEECKEGFYPSPDAAKQCHRCPCSAVTSTGNCTIESGELEPTCDQCKDGYTGQNCNKCENGYYNSDSICTQCECHGHVDPIKTPKICKPESGECINCLHNTTGFWCEKCLEGYVRDLQRNCIKQEVIVPTPEGSTILVSNASLTTSVPTPVINSTFAPTTLQTIFAVSSSENSTSALADVSWTQFNIIILTVIIIVVVLLMGFVGAVYMYREYQNRKLNAPFWTIELKEDNISFSSYHDSIPNADVSGLLEDDANEVAPNGQLTLTTPIHNYKA

SEQ ID NO: 1810 - DNA, 133632 bp, Homo sapiens
cggacaagtcatttgactactttgagtgacaacatactggcttgcaaagtgggggtaatcactctttctacttcacagataaggctaaaaagattaaaaggggaatgcacagtggttcaagcctgaaatcccaacactttgggaggctgaggggaagattgcttgagaccaggagttgaagaccagcctgggcaacatagcaagaccccaactctacaaaaaaattttaaaaggtaatgtgcacctgtagtcccagctactcgggagtttgaggcaggaggatcacttaagcctaggagtttgaggctgcagtgagctatgattatgtcactgcaattaagcttgggtgacagagcaagtccctgtttttgttttgttttgtgtttgctttttaattaagaggcacaatgtatgtgaagtgtttagaattgattcctgacacataataagtattcagtaaatgttaagtctccatcattgttgttattgttgttgttactatcaacgtctttcctccagagttgttgccaagttcacatgagatgatgcctgggaaagctctgtgctgtgcacctgtcagtaatcccctttattacaatgatagcaacctaagggatagagttatttgtgaaggtctaaccctattcctcccccaaatggttcaaattctttgtattgcagccaacactgatgacgagtgagggtttgacttggtgcccactgtgaatgacgtccttcagtagatctccaagaactgcagcaaatgcttttctgggcttattttagcatcagagggcctttgaagcaggatttcaacatttagcttcattgtttggggatggtgccttgcatttaatgtaggtttacaacttgagccttccttcctctcatcatcttgagataccatgaaggcaggtcagggatgtggttggcagagacatatcttcagattcaaatgaattctgttgttgattgttattgattttgagagtaataagtgctcactattaaaaaaactggaaaatgtagaaaactatgaaggagaaaaaagttaaatatccataatgcagtcactcagaaaaaaagaatgttaacattttggtgtatttccttttggtattttattctctgcacatattatcatttacacaatttgggaatcatggcataaatagttatattaatgattttttccacaattttataagaatttccttcataagtatcttttttttttttttttttttttttttttgagacagggtctcactctgtcacccaggctggagtgcagtggcaccatctccactcactgcaacctccacctcccgggtttaagtgattcttccacctcagcctctagagtagctcaaactacaggtgcaacgacgatgccaggcaaatttttctgtatttttggtagagatggggtttcaccattttgccaggctggtctcgaactcctgagctcaagcaatccacccgcctgggcctcccaaagtgtcaggattataggcatgagccactgtgcttgagtatcatctttttttttttttttttttttcaggcaccaagatttttatttacccaccttcctgctttcttttaacattaaaaccatattattctctttttgaaccagggttgtgataggaaccatcttgttacaaagtagtagcagatctatgcttgcttttatgtttttatagcccctctggctgtcacttctctgtcctttctcagttatccctttacagtctattctgacccctgtaaaacagggactaaaagtaccaacctcattgttatgaggtttaagagaaggcccagccctaagccaggctctcaggaaaattcaaacaacagttcctctttgcctttcaatatagctccttctcatctgtcatgggctggggaaccactgaacctgtaaaccacgggtataagtccacagaccaggaacacggtataagtccacagaccaggaaccttacctgaatggtaaggtacatgggctttgtgactccactaccaacttccaaactaaggaaggactgactgggcgccagtggctcatgcctgtaatcccagcactttgggaggccgaggcatgagggcaagagatcgagaccatcctggcccacatggtgaaaccccgtctctaccaaaaataccaaaaaaaaaaaaaaaaaaaaggaaggactgacttagtgagcagttccaagaccactcaactcatggttccttgtggatgcctcccttgtacctccatcatgaccagggcttgaggaggggcctctcaatttccccgccacacttgatatagtgttagggatgcagcagaggccaaaaactgagtgaccagccccatcgatgggggacactaaccaaccaatcacaaagttggtgccatttgctcttagggagaagaggcggggcctgagcaaggacagcagctggaaagtgaagggcaggcctgactctcagcagcagtagtgatccggcttgaaggggccatcacgggacgtgctcagctactgggcttgcttctcagttagcttggtcaatttcacgttcagcttgcccaggggggcgcctcagccactgcctcatccagcttcttgggcaggaagtgaaccccaatggggtacttgtctgggtgggtccacagcgcaatctgcaccatcacctggttgaaggagttactccccacaaagctggggcggcccatagcacagcccaggttgaccagccaaccctcagccagcacgatgatgtggcacccattcttcagccagtaccagtccgcctgggcttgatgtttgccttctccacagcattgttgttgaggcacctgacatcgatctccacgtcaaattgttcagtattacataagatggcatcatccttcatctgctcaaagtgccggccaaggatgatattgacacaggttgtggtggtgacaaagatgttgccctcctgacaggcctcgtccatggtggtcacctcatagccttccatggcagcctgcagtgcactgatggggtcagtctcggtgatgattacgcaggccccaaaaccctgcaaggcctgggcacagcccttgcccacatcaccatagcctgctaccactgctaccttgctggcaatcatcacgtcttggtccacttggtgtcatctataagggactcctggcagccatagaggttgtcaaattttgctcttggtgacggagtcattgacgttgatggtaggcaccttcaggattgcactggccatcatcttgtgtaggttgtggaccccggttttggtctcctcagagatgcctcagatgcccgacatgagctgtgggtacgtacttggtgtggatgaggttggtaaggtcacccccatcatccagaatcatgttgaggggcccgtccttgaagtacagtgtctgttcaatgcaccacgggtacccctctttcattttgcccttccaggtgaacactggcatgccagcctcggcaaagacagccactgcatgttcctgggtggagaagatgctgcagctagaccactgctcctgaacacccagggagaaaagggtctcaatgaggatggccgtctccacagttatttgcaggcagtcagcaatgcaggcacccttcagtggcctggaggccgagtaaagctcctgcatgcccatcaaacccggcatccattctccacaatgtctagggccttgtgtccccaggtggccaggccgatgtcagcaactttgtagggcagtttgtcagacatgctggcggcacctttgatggacaagggcaaagggggctgggccatagtctggggacaggcactgggtgggcagtgttgggcaggcagtgctaggcaggtgagtatcattttttatagatgtatagtgtttctacatagaaacatcatacagcacaaagtactcaactaatcctttgttaactgtttagatttttctaatttttgtaattatataacactctggtgaacatttttgtacatacatatttacatctgattatttatttcctttggatagattcttttttttttctctttttgggacagggtcttactctgttgcccaggctggagtacagtggcatgatcatggctcactgcagcctcgacttcccaagctcaggtgatctcccacctcagcctcccaggtagctgggactacagctgcataccaccatgctaatttttagtaattttttttttttttttagtagagacggggtttcaccatgttgcccaggctggtcttgaactcctgggctcaagtgatctgcccacctaagcctcccaaagtgttgggatcacaggcatgatctcctgtgcctggcctttggctagattattaaaagtagaaataatgagccgggtgcagtggctcacgcctgtaatcccagcactttgggagcccgaggcaggcagatcacctgaggtcgggaattcgagaccagcctgaccaacatggagaaaccccatctctactaaaaataccaaatttgctgggcatggtggcacatgcctgtaatctcagctaattgagaggctgaggcaggagaatcgcttgaacccgggaggtagagagtgcggtgagccaagatcatgccattgccctccagcctgggcaaaaagagtgagactccgtctcaaaaaaaaaaaaaaaaagtggaaataatgggtcaaagagtataaacacttttaaggctttctggaaaggttgtatcactttatatttctatcaacagtgagagaccataacaagtattaccagtttgtaaaaatttttgccaaatcaataggttaaaaaaatggcaactccttatctcaacttgcaatgctttaattactcaagttgcatatgcagtatttcatattttttagtcatttgtattcctttctgtggcttgtctgttagtgtcctttgctgggccgactttgtgaacagtggccccagtaatcctacagttgtctgcagaagatgccaaaccttgcatttagccacatctgataggaggccagcctccagcaggattagaaatagtccatgtcagcattgctgtttcaatgaaaccagaaaggggaaaggtgtctgtgttttattggaatctgggagatgaagttattttgctgagcccctatgtatcatatcattataccttcttttctcactcccaaagcttctgttttcttaaatgcttttctagcagaagggttaaatttggtgcatgtgtgtcctttccttcagtatgtgttcactgacctcctagtatgtgcaacacatagcggccacattaacgactgtagtgtatagagaagagcctgggcttttgagtcacaagggccttgggcaagtcccttaagctcttggaggctcagtttcttcttctttgaagtgcagatgacagccctgtctttgaggaataaacgtgttccgaatataaaactcccggaacagcatctgccacatcataagacttcacagacaattttttaaaaaaattttttcaagatggagtcttgctctgtcgcccaggctggagtgcagtggcacgatctcggctcactgcaacctctgcttcccaggttcaagcaattctcctgcctcagcctcccaagtagctgggattacaggcgtccgccaccacgcctggctaacttttttgtatttttagtagaaacgggatttcaccatgttggccaggctagtcttgaattcctgaccttgtgatccacccacctcggcctcccaaagtgctatgattacaggcataagccaccgtgcctggctcacagacaattcttgagccatttctgtgtatttgacactgtgctcggtgctgactaataaagtgagaaatcagttggggccctttagagcacctcatttgcctaggagaaaagtcaggctgcacattggctccaacaaggcccactctgacccctgctgttctgtggtccttccctaagcctttggctccaggtctcatgggccttagctacagttctggggcaaataggaaaagtgccagtcaatgttctgttacacagagtgtcacagctataatttttattttttcttttcttcttaccattatgaggattttccatttatagttaagggtgtcagtgggagccagccagcctcagtttgatttctagctctattatttactaagtgaccatgggcaagttgcttaacctgtgacctagtttccttagctgtaaaatgcagataataatagactatagactgaatgtttgtgtccccctaaaattcacacgttgaaatcctaactccccatgtaaaagtatttggaagcgtttgggagatgattaggttataagggcagcgccatcatgaatggaattagtgtccttttaaaggacacccagggagctcactgaatctgctggtgccttgatcttggacttcccaggcaccagagctgggagagatatattttttgttgtctacaagccacaatctacagtactttgttgcagcagcccaaatggactaagacataatagtacctatttcctggggtttttaggattaaacaaaacaattcatatgtagctcttggtatagtgtctagcatagactatgagctcaattatttactattaatatttgctatactgtcttcatagctacacttacaatgactttctaggattaaatttaacaggtataataatacctttctttgatgacagatatgtaaggtatttccaatttttaaacacaaacataattcctaagaaagtcatcttgtagtttagagattaaggaagatttaagattaaggaaatttaaaaattaaatgttgaatggacattaacacatttaaattactggtatctttcaaaaaaattcaatattttctatacatatgacaggctaatatcccatcttaaaagccccggcatggatgatccttgcctaaggcagagagctgacctgaatcactcgacaaggtctcctagtcatttgctctgtggctctcctggccaagaagctgcatcagcttttttccccttgccagagaacctctgatacagcaaagctcagggccaacccagcatttttcagatatcatttggaaatatcaggtagggcaagtgtcaggccatgtcacctgatggggaacttatggggcaggggtttctgctctggtccttcagccaacaagtctcaaagttagcaatggtataacaaaaatatgaacctacacagcttgagcaccgtctgtgtgctaggctctgtaaaaacattctcctcaatcctagtcaacaaatgagagactatttattggccccatttaatagatgagaaaagtggcctggcgcggcggctcatgtctgtaatcccagcactttgggaggtctaggccggaggataacttgagctcaggagttcgagaccagcctggccaacatggtgaaaccccgtctgtactaaaaatacaagaattaactgggcctggtggcaagtgcctgtaatcccggctactcgggaggctgaggcaggagaatcgattgaacctgggaggcggaggttgcagtgagccaagatcaccccactgcactccagcctgggcgacaagggtgaaacactgtctcaaaaaaaaaaaagtgggggggaaaactgaggctcagagaggtgaaaggtttcctccaaggtcacagagttggcagtcatgacccaagtctgtctgactctaaagacacaagctcctcccacaagcacgacaagacctcaattaattcaatttaaccagcatgggttggcacttacatgtgttgcccctgctaggttctcagaacagggagaacatctgacgtaagagacagacacataaataacaagttctagtattaaggctgatgcatgcctatgagaagtaataaagccatgtgggcaatacaatttatcctgttgtatatatttctgaaagccatccttaatccttttaggaagaggcaacggagaggtagattggtagatcagggctgtaatcaatgcataaacaaggggtggtggggaaatgagaagggagagattaattcccactcaaatccaggaatgtcttttagagaatgtgacattttggttggggtttgaagggccagggagggtcagcaagggaatatgggggactggcatgacctgtccaccctcccaaagcaaagtaaaaatagaaccttggttagtgcttgctaaatattggtcctgaagacagaacactcacattctccctcattcccgctgtcttatatacatagacctatcaagacacacccatagataaccacaaatgcaaaaacacagaaaatacacaaaaacacacaccagtacacatgcacagattattaagacacaatatatgaaaatagatactagctcccatactcataaactcacacagatacatacaacactcatacacacagactcacaaacatgtttatgcattcatacacagcctcccccacccactactcatgcaggaaaataaatgcatgctttaattaacatacacgggttcacacataaatctcatcctgctggtctggttgaagaccaatgactaatgggaaaccatgcacaaagccaaacatcacgtaggggaggccgggattgggttagcagtggggcttgaattaagccccatcagatgacaaacccgccctgcctggcttcctctggaagctgctgagccgaagcagcagcgcctgacctagctctggatcctgggcggatgatgcgaggctgcgtgcccgaattccagcttgattcagggtttagtgtcatccagggtcaagctcggctattagccccaccccaacccctgcaaccagccggaggctctgggggcactgaagggctgtggcctggggctgctttctaatcctgggcttgccctggcgcaaatgctgagaatagttagcattaatgagggttacaacagtgggccaggctctgggctaagccctttacgtccatgacttaattctcacaacagctctgtgaggggggtggggggtgaggggtgtcctatcatctccattttagtggtgaaaaaaccgcgctcaggccacaaaaccattcagcaaaagacatcaagttgaggttcaaccctgtctgatcctattcttcccggggtttaggtaagtgtgcttgcgagcctgtctcctccacgcaggaagcttgcaccttctgccctcaggggtctccaccgcccggtcccgcccccttgtccagtctggcacaacacctggcccacagcaggtttctggtgagggcgtgggtctcggttcagggaggccctcagcaagggcctcagcttccccatctctgaaatgggaatggcggcagagacctcgcaaggctgcgaccaggctctctggagcagcagagggcatgccaagctctacatcgtcgctgccgctgccctctcccatcgcggggttcccgcgcggtccccgcccgagctggggtgcggcgctggcgccccattgttcaggagggcggggatgctcccgagtgctgattccaccccccgctcgtgctcgcagcccggtggagcagatgactaggcccggcgtctgccgcgcggggcgcatcctttgtctgctccgcggcgcccggtgcccgaggcccgcgccccactctttgggcagacaaagccggggccgccgcgagcccggcgggctagagctgggctcgcaccacccttctctcgcctcacggaccgccccctctcctggacgtcctctgattggcctacggggctacaaagaggccgggaagcgggcggatcacgtgggcgactgtggcttcccattggttaggcgcggctgccaatcgaggagggcgggcggtccgcgctcggtccggtcgctccctccgcgctggggcccgcccgcggggccggccgcctgtcagagggaggtggcgatggtgcgcccggtggcggtggcggcggcggttgcggaggcttccttggtcggattgcaacgaggagaagatgactgaccaaccgactggctgaatgaatgaatggcggagccgagcgcgccatgaggagcctgccgagcctgggcggcctcgccctgttgtgctgcgccgccgccgccgccgccgccgccgtcgcctcagccgcctcggcggggaatgtcaccggtggcggcggggccgcggggcaggtggacgcgtcgccgggccccgggttgcggggcgagcccagccaccccttccctagggcgacggctcccacggcccaggccccgaggaccgggcccccgcgcgccaccgtccaccgacccctggctgcgacttctccagcccagtccccggagaccacccctctttgggcgactgctggaccctcttccaccacctttcaggcgccgctcggcccctcgccgaccacccctccggcggcggaacgcacttcgaccacctctcaggcgccgaccagacccgcgccgaccaccctttcgacgaccactggcccggcgccgaccacccctgtagcgaccaccgtaccggcgcccacgactccccggaccccgacccccgatctccccagcagcagcaacagcagcgtcctccccaccccacctgccaccgaggccccctcttcgcctcctccaggtgagtccggcgctccctctcgggcaggacccgtcctcacctcagccccggcaatctagggttgggctcttgcctataatttatcgtttgttaccccaaagacaccccaggttccggctcccgaggggggatcccaggtccagctagtctccctcccgcccccgatcaatctggaaagtcttttgtcccccgtgggctgtgctccctcgggagggggtggctgctgggtggaaggcatctcatcttcttcccaacagggctttctggcctttttcagagaccagaatgggcgcaaacttttgggttgggttcgcgcacccagcctctctgcctgggttatttggggaagtttgaaagcccgcatagtacctccttcaaccactgggtcaaaagctgagggtaaggaattcctcccaaagctccagtttccctgttcatttcttcttgtttatgtaaatatcagatgtgtgtgtatgacaggtggaagagaggtagtgagaggattttgtttacaaacagtagtatggaccacttgagggcaaaaaataaaaacaaaaaaggcattgtaatccatgttgtccctgcaaataagtggattcagtaggtcatttgggacaggtgtgtatctaggctgagcacatttacaaattaggttaaatctcttcctcgcaccatttttttcttccacaattataaggtcaacatgtttggccaaatacaccatttaagcaaggatgcctatttttgtctccttaagccaggatgttcaactttgctgatgctgatatatgccaatttctgtttgagcccacgtagaaaaggcttttcttgctgaagtcttcaagcaaagttaaagacaactcgtattctttccccgtttaaatcttaagtgggcctaggactaaaacaaaacaaaacaaaagcctactttgtcagaacgtttggacaaaagtttctgaattgtcttgctttgagttggggtggaggtttgtccaaatcctttgtctagctgggtctctgacctaaatcttaggcttagtgatttactgtggagtcaggtatggactttggactataattgagtgtgtagagaattttcccacatggttatgaaccttaatacagtcttgatccttgggttggagcttggcaatgacataagtaggattattcacccataaaaagccaagtgtgcatctcttccagcttcaaggaatgcattagctagctgggttttacctgtaaccccttttggctttcatatagagagattgacatattactgagagacaggaagcatagtggttgagagtatggactctggagtttattcttaggtttgaatcctagctcttccccttgttagctgtgtaagcttaggcggctcactgaagctctttggactcagtttctttgattgtgaaatgaagataatattatagtagtacttaactcataaggttgctgtgaagactttttttgtttttgtttttgttttttgagacagggtctggctctgttgcccaggctgaagtgcagtggcacaatcttggctcactgcaacctctgcctcccaggctcaagcgatcctcccacctcagcttcctgagcagctgagactacaggcgtgggtcaccacacccagctaattttttgtattttttgtagagatgagggctcactatattgcccaggctagtcttgagttcctgaactcaagcagtcctcctgcctcggcctcccaaagttctaggatttcaggcatgattcacttcaccaggcctgctgggaagattaaataagttaacacttactgtgcttacaacagttcctagtgtagaataagcaccgtgtgtgttagctatgcttatgaccaggcctgtgggtgtgtgtgtgtgtgtgtgtgtgtgtgtatgtatgtatgtatagaaagcatttgagaaaactagtagggacttggggtgatttttatttgttttagtaaaatataatagaaaaagaatgaattagattctctggagttttaagcatacagtagcatttaagtagaaagatcacttactttggttagtatctgataaataaatctgtgtaattcatgttattttacttttactatttttgtgttgttatttttcaaccccaaaggtaacccctactggcaaaaaaatataaacaaccagaagtccacaaaggaaaaagggaaagtcactccttcactgcctcctagtttcagtcagtccctagaggttactactgttagcaatttgtcagatcttttttcagctgtttttgctgggcatatatgaacatacacacagggtatttaaaaatagattttaaaaaatcaaaatggaataattctatacatgttttgcaacttgtggtattcacttaactatgtatcatggacttttaaaaaaaatatcggtatctagggtctactttattctttttaatagttgcattttccagggtaagaatgtatcataatttatttaaccaagcccttatttatggacacttagattgcttctaggcttcactttaaaaagcagagaggaagcagcacagagtatttttgttaaatccatcatctatttactatattctctaatactttcactggagttgcttagaatccaattcagtatacactgcagtaaagctggattgagtaatatttgtcatctgaactgttgttcaaggcttttaataattttcatgaactaacattatacttacgtctgtgatggtctttgggtgaaaaaatcttggaaggatgtccaatttcgataactttcctgtgttttaaatattaggtagtttgtacttctctgtgaattcactctagattgccaatatctagttctcagcagctaaattgactttacagtgatctgatcaagtatggagcatgggctccagtctactttaaacagaaaacatatctctttggcagaaggaaaacttataattgaatttgagacaactggtttggcttgcaaagttggattccctggcatttgagaagatggttgtacagtattttttaatttcaacgttcctgtaagaactaatgccactgataatatattatttgattgaataggtcttatagatgctttttgaattaataataatttctttcatggagatctagctgagagctcttgcctgcccctcagttagggcccttttttgtttacaaggacactgatctgcaaactgaaactaattgcccagcaagcaggcactttttctcccacaaacccagcaaaacattcactgattggttggctgggtaggacttttttttttttttttttttttaagacggagtttcgctcttgttgcccaggctggagtgcaatggtgctatctcggctcaccacaacctccacctcccgggttcaagcgattctcctcagtcttccaagtagctgggattacaggcatgtgccaccatgcccagctaattttgtgtttttagtaaagacagtgtttctccatgttggtcaggctggtctcggattcccgacctcaggtgatctgtccaccttggcctcccaaagtactgtaattacaggtgtaagccaccgtgcctggccctgggtaggacattttaagcagggtgaagagagatgctgtgataccagaggtaataataatcagtaagacactaaggtaatgacaaatgtttgattttttttttttttttttttgagacggagtttcgctctttttgcccaggctagattggctcactgcaacctccacctccgggttcaagcgattctcttgcctcagcttcccaagtagctgggattacaggtgcgcaccaccatgcctggctaatttttgtatttttagtagagatggggtttcaccatgttggccaggctggtctcgaacttctgacctcaggtaatctgcccaccgcggcctcccaaagtgctgggattataggtgtgagctgccgcacgctggcccaaatgtttgattttaaaaattatggacccttaggggtagataggactttaaatgccactacctcctaatgtggctctacatttgaagaaatatttccataggcttagctgaaatttcttactttagttaactgattgatctggctctgcccgttggggccatgcagaaaaagttggctgtctctgtgccatgacagctcttacaggttaggggacagggatcatgatccctctctgtcttggccaaataatttcagctccttcaactgatctttatgtgacatggtttcaaattttcttactgtcttggttacttctcttctagtttttttttgttttttgtttttttttttgagatggagttccactctgttgcccaggctggaatgcagtggcaccatctcagcccactgcaacctccgcctcgtggtttcaggcaattctgcctcagcctcctgcctagctggaattatggtgcatgccaccacaccctgctactttttgtatttttagtacagacagggtttcaccatgttggccaggctggtctcgaactcctgatctacccgcttcagcctccgaaagtgctgggattacaggcatgagccactgtgcctggccctcttctagtctttttcagtctttctgtgtctaccaaaatgtgaaacagagctgaacataatactccagatgtgctctaaccagcttgtagcagagagggcagttgcctcattccttctggatggggtactgatgttgatgtggttagttcctaatcacagtagctttttggcagccgcattatgttgttgactcattgagcccattaagattgctaagctctattaaaatttatttatttttaaatatgtgctaggtgagtcttctttcattctggacttggaaattcttataattttctaaagtgtaatctgagacattaactaaatttataagattgattgtgttaaattcagttatccttttagatcccaggtttgtcagtgtactccacccagtttatttgcatttacctgcggtgtgttcctatagacagagtctacggacaagttagggcagattattcttacctcatagggcagaataaatttacagatgataaaacaatttggaagataaaggataataatttagattagttttaaagggtctctttcagctctaaagttctgtgatgatttggtctgcatgattcaaggcatatttatgtcccccaaagaaccttaattatttatttgttatctgagtgatgagaatagactttgtttaagcaagccctagaatttagaacttgaaaactctgactaccatgacatgtaaacaaaatattacagatggattatttatttttgtttgtttgttttgttttgttttgtttttggagacggagttttgctctgttgccaggctggagtgcagtggtgccatctcggatcactacaacctccacctccccggttcaagtgattctcctgcctcagcctcccgagtaactgggactacaggcgcatgccgccacgcccagctaatttatttttctttgtattttagaagaaacagggtttcaccatgttgcccaggctagtctcaaactcccaacctcaggcaatccgcccacctcggcctcccaaagtgctaggattacaggcatgagctaccatgcccagcctgtttttgtttgtttgtttgtttgtttgtttgagacagagtctcacttagttgcccaggctggagtgcagtggcaccgtctgggctcactgcaacctccgcctcccaagttcaagcagttctcctgcttcagcctccctagtagctgggactacaggcatgcgcaaccatacccagctaactttcttgtatttttagtagagatggggtttcaccatgttggtcaggctggtcttgaactcctgacctcaaatgatctgcctgcctcagcttcccaaagtgctgggattacaggtgtgagccaccacgcccagccaagatggattatatttgaaaagaacatcctaggaatataggactctcttaactgtactggaaaatgttttcatcatcctaatattctctaatactagattcaggatcttacttactcgtgtttctttaagaagatgccatttattttaaggaaatacaaactgtctaggcttcaaagttaatatagaccccacagtcttttatctaaaacctctgggttggatgtgtttcagaatttagattttttcattttttcataaatacattccagtgaattgggagcagcatcctgtaatcaaacacattaagatatctgcagcaaactgcacgtatctttacagtgagtgtgataaataaagactttcagtagcctttgctcaggtcaggttttatttgcatttgctcaggtcaggttttgttgccaaatgtattcggagtaggtcagatatttgccaccaagtgagttacaggaaaatttgtagtttcatagcttctggtattgagcatcagatttgagggattgtggactactataatagtaattacaagcacacttactatgttcctggcactgttctatgtgccttatatatattaagtcatttaatctccaaaacaggaactactaagttagttactattattatcctcattttatagataaggaaattgagttccatagaagcccagctctggcagaacctacattcaaacctagtgggtctggctccagaatccatattattggcatttaaagaaatacagctacctagaagagtaggaaaccattttgctaaaaataattggtccttggatattaatctgggaaaacttctactcttccttggcgtttactgtcttcattccactgtgtgctattcattcatctcccagaattttcttttcttctttctgtttttttcttttgagacagggtctcactctgtgtcccgggctggagtgcggtggcacaatcatggctcactgcagcctcaacctcctgggctcaaatgattctctcacctcaatctccagagtagctgggactacaggtgtgcaccaccacgcctagctagtttttgtatttttagtagagttgggattttgccatgttgcccaggctagtctcgaactcctgaactcaagtaatccacccaccttggccttccaaagtactgggattacaggtgtgagacaccgtgcccagccacctccctgaattttctgtttgacaacgttttacaattgttatattaaattatagctcttattgtttcattaattaggttctaagtttttctgtgatggagagatttgttcatattttttggggggccaggccccccaaatttatcataccttatgcctgacctaagtgcctaggtttttgtagaaattccttagtctgattagtttctggagcagcataaactccagaacattagtttcaaatcttctgtattatgtccccaggaagcctcctggctagttgaaaatttacacattgaaataatctaggtctttttatcttgatttttaaaaaagacccctaaaatttaagtgtgcataatttctcatcttagcatttctaaacatgtgtattaacttccagacattctggcacccttataaaaagaatagaagaaaagtattgcagtgctgtttttactgatgagtaaattatgggtggagagaattctgctctagggtacttaatagagcagaagaaaataaaaatgtaagaccttgtttagctgaaagacagtgttagatgatattttaagttataaatagctttaatccttgctttttcctttatcttgatttttgtgtggttttttttaggtgtgatataaaaatccttattagtaatgttgacattatattacagggacctcttctgtgatcacttaggctttttttcaagtatacattttgatttatctgtttttcactagaaatgactaccctgactgccctggtaactttaaaggaggatttctaaaaatgtgatgaagaagataaagattatgtctggatacctaggtttgaatcatagtaaaggtttactaaaaatatttatccttttagatgtatccatgtgagtacatgtgataaatttgtatcaaaataatctctctaataatgccactgttctacagataattatggtcagaaaaatctttccctattattttgtcttcattgaaaaaaaaaaaaacctttcttccattctccttgctcattttttttcaatttaaagccttctatgcgttcctctcactcatatcttttatttttagccccaaccattctttccatgatctttaaggaaccaaattaccctctctgtttaacaatttaccactttgtcctccttcagtgcttcctcaaagcttaattcttccaagacgtctttctagatgaacaaaaagtccttaaagatgtgttagtgtcagcatgcatggcgttgaacagtttgcactgagaacaaaatctgtctttctctgtgactttcacttttttcctattgatttgtttttggtctatgtaatttagattatgaagccttcttaatatgaaaatgtcatcctttatacaatattcagaatgcggtattctctctttttgaaaaaaaatggagaaaagattttctttttccactggggtcttctttattgtccaacttatgccccacctaccccctgccaccttcttctgaggaacaataaagaaaaaactttcataatagaagttatctggctctaaaaaaaaatcaagaactttgaataagtagcaaatttattttcctatttatgaataacatgacctgtttttgttggtaggtggttttgagatgcataccagtatataattaatttcgttaagaaacaaatgtttgatcttttgaatgacagaatttccccattagaaatataattaaagttaatagtgaacagagtgcttttaatattagcaattaacaagtgtgcagtgcattatggcttacaaggtgctcttagaatgtctaagaccttgcaattcacattttgttgatttctgcatattatatgaatgaaaaaggcttatgtcctctgtacttttattggtgaatattgatcaaacctttataggttttgttgggtttcagatttgatattttgtattttaaaccattgtcttttaagtttattttgttaagtgtaaatcttgtcttgtttagctgcccatatttatatgatgaataaatggtatttggagaagaggactgtttgctttatattttctttcctagacactatacagggctgaatgttgtggaaagagcccagaagtaactgaaagtaaatggtcatggagataacaaggtgaatcacagaacttgactgtgagggctcatgtgaatttcatctcttttttttttttttgagacacagtctcgctctgtcgcccaggctgggatgcagtggcggattctcagctcactgcaacctctgcctcataggttctagcagttctcctgcctcagcctcccgagtagctgggattacaggtgcctgccaccatgcccagctaatttttatatttttagaagaggtggggttttgccatgttggccaggttggtcttgaacttctgacctcaagtgatccgcccgccttggcctcccaaagtgctgggattacaggtgtgagccaccgcgcccaacctcaatttcatttcttcgtattgaaatatttacttctttcctagtgtaagaatctctttggcattatcttttttttttttgagatagagtctcactctgtctcccaggctggagtgcagtggtgccatcttggctcactgcaacctctgcctcttaggttgaagtgattctcctgcctcagcctcccaagtagctgggattacaggcacccaccaccacacccagctaatttttgtattttcagtagagacagggtttcaccatattggttaggctggtctcaacctcctgaccttaggtgatccacccgtctcagcctcccaaagtgctgggattacaggcatgagccactgcacctggcccagaatctctttggaattatcttaacctgctatttcagttgtactacttcaaatcattgttttaatagcaaagagacttacactgttacctttcatttttaatctgatatttaacactttggcagggaaggtaactaatattaactgagcacatattatatgcctgattacctataaggatttttttacgtacatcgtgtcatttaattcttaaacaatgcagtagttaaatcttattaaccttactttatgactggcaaacactgggattcagaaagttaaagtagtttgctcaagcctgtcaggcttacagactccatgagggcaggacttccatttgttttgttcacagttatacctctgctgtccagcccagatagattcttaataaatatttagtgattgaattagtgaaaaagaaggaacagtttgtaggtatactagacatgcattgtattcttgaggaaaataatgtaatcatgcctttctttttagtttagaaatcaatgtttctctcactcatagtaatatgaggaatagtttgagaacctgcttaggacaagtggaactccttgagatccagcttattatattaatgattcattttttgtttgtaacattttcccttgtatttttcttaaaggaagaacaacaatggacaaatgaacatttgatgacttttgtagaaagggtagctaagttgcagaagctgagcacttgtctgtaagatgtgggatcctaagttctttcattagttcttttactagttatctgtctagtaaaagcaagtagttttatctgttaaatgagttagactagatttgtgatttttaaacagtattatttggggacccagggttcctcagatgtgtttgggagccattatagggactggagaggccaacaggtctacttctggacctttcacacccaactctcacctctcacctccacatcaccacccccacttacatcagctcttctttcatttggcttatattttggatttgtcctttcagtaaagatttttgaaagaggaattctcctactctaacattttatgataaagaaatttggtaatttatgaacttacattaaaatgtttacattatattaagcagcaatatacatatgaggagagaaatataccaaaatattaattagttaaacctaagtaatgggattatgggtaattttaattaccttctttgtgtttttctgaatttttaaagttttttcgtgactatatccaattctaattttatagtcttaaaaataaatgaataacatttaaaaatgaataaaaagttctgataagcttggtaagtctttacttatataagatcaagtcagatgatattacccagggccacttaactataatttctgtcattgactaagcaagtttgatctatatcagggtatttgtttagtctaagtgagtcagggttttgaataaaggagactattcatgcagactgacaaatcttgaacatacagtaggaatgacatatctaagatttggtacctttaggcaaaatttaactgagaccttcagcagaggctgaaaattgagagctggctctttctccatttcattttgtctaggtaatttttttaattaattaattttttatttttttttttagagacagagtcttgctctgtcgcctaggctggagagcagtggcgtgatctcggctcactgcaagctccgcctcccgggttcacgctattcgcctgcctcagcctcccaagtagctgggactacaggcgccggccaccacacctggctaatttttgtatttttagtagagacggggtttcagcatattagccaggatggtctcgatctcctgacctcgtgatccgcccgccttggcctcccaaagtgctaggattacaggcgtgagccactgctccccaccttgtctaggtaatttaaagcattcacttgaacattacttaaagtagcttattgaaatagatcttgtttagattgtgcaaaatttgaattcatggcattgttcatagtctttatcaatatatttgattatttcttctttaaagttactgagcctccaaaagtttggtttcagtctgtccatatgttttccaattagatcagacgggattgctgttatactggtaatataacagctgttctatatgataccttgccagggagacagctaagcattaagggaagggaaaatttattcatttggaaaaaggaatacattctgcctagtcatagggaaaaagataaggagtaggaatgttgtcagcctggctggagaatgttaaataacctttatttactaaattttagaccctttagataactgagtctgaaaacttatttcagtcttacatgcttccaagaaactggcatattatcacagatcttattagatttttatcatttatttttaataatctagtgcttttacttgatacatgtgagcaaaaagaagagatgagaagtagtagcattgttaactacaaggaggatatcatatttcctactcctttttaattttggaaattgttttttttttttcttttttttgagacagggtcacactctgtcacccagcctggagtgcagtggcgtgattgtggctcacggtagccttgacctcccgggttcaaatgatccactcacctcagcctcccaagtagctgggactacaggcgtgcaccaccatgcccggctaattttttttaaactaattttttaaattaattattattattattattatttttggtagagacagggtttcaccacgttgtccaggctggtctcgaattcctgggctcaagccatctgcccacctcagcctcccaagtgttgagtttacaggcgtgagccaccgtgcctggcctggaaacggtctttaaagatgaaatttctttaaaaatattctaggaaaagtgtagatgttattcactctgaaggaaattggataacttgaatagatttttagattctcttaagtcctattaatcattatagggattgggaagggttattggaaataacggggggggaaggacttgcattccaatatatttatcctgttgtgtttgtttattgagtcttgatgagaggaaggcattgggctttttctgctgtagatttttcatgtgattttatatttattgtaatcctacagtgtgttttatcagttctatatgaatagcactaacattatagtcccaccatctattgatgttatgtgagttattgaatagttataaagtgtaccaaaaacccaaagcaatctagttgttgggtattattatactgaattgttggtgtattgcctgcaaacctatcctgttcaactggttttagtttttaagttagtttgttgcttcaacttgtccgcaaaggcagggctggatggtccagctaatcagtagaatcgaagtcagaagaactaaattctagtctttctattcactttttgagttattgagtatattttttgatgactctatgactcagtttcccagactataaaatgaaacttccagtcaccaaaggtttttgagaagtaacacatgtaaactactttgggctttctcagacataaaggctttaatattctttccaagttacatggtttatattagcttataatggaatgtgaccaagatagctttgattaaacacaacaaagaaataaacacattcatttatatatggcttctttacacaaaatatatttttatgctattttgtagttgacatatttgtataatttaacaattatggtgttttccaaaggtttgaggtcctttagtattatttttcttccccactaccttgagaaaacaaaataatctttatctcatattaaactcacaacatatataagttgtgctttatgtaatattatttttggttgatctgtttagaatgggttctacttacttttttttttttttttttttaagaaacacggtctcactctttcacccgggttagagtgcagtagtgtgattgtagctcactgcagcctcgaactcctgggctcaggtgatcctcccatatcagcctcctgagtagttgggactacaggcatgtgccaccatgctcagctaatttaaaaaaaaaaaaaattgtagacatgcagtctcgctatattgcccaggctgatactatactcctggcttcaaacaatcttcctatcgcagcctcacaaagtgttggcattacaggtgtgagccactgcacctggccagtttttttacaattataaaaataatctatgttcattttctacaataaacattgtagaaaatgaaaaatagagaaaaaagctgtcccataaagcttttttaaaatcactgattgagtttaatattttattactgcatatattgcttcatttctcatgataataaatgagatcacttgcttgttatgaaaacagaggtgcaagtaggatttaacagtcttctgaagaccaatataagacagatcaaaatgtgaaaaaattcaccacatttaaattatttatcatgtcaccaaaaagaaagtaaatctattttgatctaagaccccatatgatgctttacttgagacttggtactccctggcagaatcaagtcagtgactgtttttcttgtgtctgatccagcacaaacatgatttgtctttggttcacgtggcccctgaaagcccaaagcagcctggaacaaagccagacatttggtatttttcaatactgtgatgagagaagacaaggtgcccatctgcctggcttgtacgttgccaaaaggcctaggtgctaccctaaagaatatgccagagaatgactctggcctttaggaaactggtaatgattactcttctctgaattttgaactttgaaatccaagcagtaatgaatcatagtgttattgagaggggattaaattgatcaatgcatgtaaaacccttaattcagcagtgcttaatagtcagcacatacattaataatcagcacatagtaaacactcaaaacagtttttgaaaaacagggatttttcaaagacagcagtgagaactttgtctgttaattctggattaattaatttaccaacttccgtcatataatctgtagactggtaacacattggtaatcagaaagacttgcatattgtcacagatcaactctctaataggtggttctaaggtgcagggtagtaacaatatgcttgaggcaaaggctacctcctatccttccagaatggcccaggtcaagctagaattatcctgtgtcatgttgccagttacagcagtaatggtactgctcagaactggactaaatagaagacattttaaaaaggcaaatgcaaagatggaaatccccaaaacagccattgtccagttctggtgagtatatactccttgggatcttatgtaggccctagctacaaatgacctagtaaagtaaaaataaaattgggctcgtagaaagatgtgaccactctattttatgttggtagcacattgatatacacctattataacctattataacttatactttctaacattacatagttgcatacaggtgcaagtcacataatcttcctgggcttctatactatcttctgtaacatgagtataatagtaacctaccaaatagggttcttgggtgttgggcctggaattcaaaactagccctctgactcaaatctgtgccccttttttcctttgattaaactgtgctgcattgccaaagcagatgggagtagcagaaaatgaaataaagcatttagtagttacagagcacattttgggttctgtttttttttcacctcccctatcctcccccagcaaactcatacattttctgtctcagcactggttctgagatgtacacagtgatccaggttcgctttcagtagctactgtgaaaatcaaaattagatcaaagagtgtttcttgaaggcagatatgggtgtggagtggaggttgggagaggagataatggtggaaattaaatgagggtaagcaggtagaaaagcatggcaaatgtaaagcagaactgaatagtaactatgtgattgtctattcagcacaaagaggatcggtgctaacaagagacaatgtcatgcttattagcatttagcaagtaataccacatactgtgaaatggtagtattgattgtttttgacttgactataaaacctttcatctttaacttaatatggactctagaccaagatgctaatgcataacaatattttgtaaaaaaaaaaaaaaatagcagatgacgtttgattatataaaagtcatagaatagactgggcgcggtagctcacgcctgtaatcccagcactttgggaggctgagagggccagatcacttgagcccaggagtttgagacccgcctgggcaacatgatgaaagtccttctctacaaaaaatgcaaaaactagctgggtataatggcttgtgcctgtattcccagctacttgggaagctgaggtgggaggattgcttgtgcccaagaggcagaggttgcagtgagccaagctcatcccactgtactccagcctgggcgacagagcgagaccctgtctccaaaaaaagaaagaaaggtcatagagtatcagacttgcaaatgtgattcatactctgccagtcatttcagggtgcattccccttccttattttgtaaacttctctccttactcaaaggttagttatctctcagatcagacaaaggagcagctgttattcaactatagatccaactagattcgaatatgttttccaactagattacatcctacaggtacataagtacagtggtcagatcatactatacaactatagatgtggagaatacatatataaagtaaaacctcatcatatttgcctagttaatcatttaatatactatttatgtttcactataattctcctattactcactgttaaagtgagcccagcccatagagctcaagttctttggtatgatttaaaactccaagatgtctgccatcctcatttcttgtacttttccccttgtgctttaaactctagcagactgaaatggcttatattttccttcaaatactatgcttattttcattatcattattaataaagcaatcatctgtgaaggttactctttgtcagatactaagagcgttaaatgaatttccatgacctcatttaattatcaaaagaacctaataaaaagtttgtattattatccccactctaccaagcaggaattgaggttttgagagtttgaatacacaaagcagggtttcatagctagtacaatgtagaaccttgattcaaattcagatctgtttagctttagagctgcctctcctaatcactaagttaactagattctccttattttgcatgtgctgttccctctacctgggatgccctactcttcagtttcaataggggtcttaattctaagcaacagaaatcatttattgattcaatcaggattgaaatttattaaaaggatattgaggagttcacagaatctccagaggtaccaaattcaggccacggagttagaggtaatagtcagttgtgtccattgaatatatgccactgacatcaccactcacactgctaaccttgggtattggatgtaagaacaagtgctactgccacttgtcatactccatccatctccctgtttgccaccagagagagggcctcctgttcattcctttgaatcattagtttctaattccaagccaggtaaaggtgcatctgattgttggaacctcaatgactggcccatgccctggctgcaggggaggccagaaaaacaagaatctgacattatgaacctacgtgatgcggtatcaaggcttaaaatatggagaattcctccaaataggaagggattctgagaatggtgggaaattatactatgatactaggctgacaaaaagaatgacacgtgtctacccacaccctttctttggctacctgcaaacttatttgtcctttaaaaacatccttacagcctcctattatacttcctaacattacatagtttttgattatttgcttttttttttttttttttttttttttgagatggggtctcacactgtcacccaggctggagtgcagtggtgtgatctgggctcactgcaacctccgcctcccagattcaagcgattctcctgccttagcctcccaagtagctggattacaggcacccaccaccactcccagctaattttttgtatttttagtagagacggggtttcaccattttggccaggctgctcttgaactcctgaccttgtgatttgcctgccttggcttcccaaagtgttgggattacaggcgtgagctaccgcgcctgaccttttgattacttgctttttaaggacccttattttaagtattacttgtctatgtaactgactcctctttaccttttctcaagtagcctataggctgtgtcttattgatgttggcactccctaacatgtacataggatagtgttcagcatgtagtaaatactaaataaatcattgaacagcattggtgcataaattgtccctattcaccaccagcactagaatgtaaggtccataagaggcaggggtttttgtctttgtctctctctctctctctttttttttttttttaaaccactatatggccagcacctagattaattcctagcatgtggtaggtctgtggtaaatatttgttaaataagtgaatacccctaaatagtaaattatctctgggagtgatgctgtcaaaaaggcctttgaatgtgaatgggaaattcaaagcaccatattataatatacaactagaccacaaacagtgaggacagaaactgccttattcatctttggttacctcttcttcctatctagaaacataaccagaaaagggcaatttgaaattttttcctagacctaccatgatagtcactagccacaaaaattgcctgaagtacctaccatacctgctaaacatgaaactttctttttggcctccttttgtgtataaccagctgtatcatgagattgcatctactctgggaagaaaaggctgttgggcaaactgtcttgtacttatgtttaaaaaagtagaataacctagggcagtagaatctcactttgaagaaatgaagaagtggaggcccataattatgaaatgattcgtataaatgtaaaacacttagaattcctggcataaattggccttctaaatattagctgtactttttattgcatattgaaaacttagtccttcggactttttacttcactgcttccaatccttttaaattcttcattacctctaatcctctcaattctgttgataagcagtgttacccaactttacaaataaagaacctgaatctaagatgaggttaagttgtttgcccaaaggtcacagccaagtgctagttagctgggattcaaacccagatctatcttatttcttaagctctttctaggatggcaaaatgacatgctaaatgtaggttgagtttaatgtgttctattatatccttctaaccactgttagttgtaatgcatcttttgcccctgccacctttgcttctcttttctgatttgtagtcattattttactgtccatatcatatatctgtttactactctcttcagtttttctcctgattctttggagtagaaagtatgcattttacccaaaagaaaaagtacatcctcacatactgctctgtccattttacttttacctttatttttttttttttagcctaattgatttgtacagtggattggtttccagaggagaagacttggatgtctgttatgagtcagatgagtaaagttatacattagccaggatgacatttaagggctaatagcctacatccccaaactaacagtcattttagccagtgtaaaacatgaaacacaagttggtcagaaatagagacaatagcaaataatggtattgagttgctacaaatgctttgcaacctagtaatgtacttttatatgtatcaattatttttaacttgtgaataatactgaaaaattccaaatggattccagacatttattgccaacaaaaatgtttacttaaacttgctgttttagagaattatttttcttagcatatggtctttcttgttaatagcaagccttttaacagtttatcagaatgtaagcatttctctttgctatacttcttttagttgatgatcttgtgtaatagagcactcatttagaaatacacacacttaaaatctgtgattaaatggtcttcagggactaaagccacaagcagcaggatgctgttgctttctgtttccttattgcttaaccaatctgcaatggtatcatcctctttttcctttttcttcttcttcttcttcttctttttttttttttttttttggttaaccagacaaaatttcaaatcctctttattttttcttgccatgctcaaattggtctttaacagtgcttcactaagatgcttctgtttgactttacattcacttttatttaagtaacaaagaaaagggtgtgcttttgtcaataagtttacactgggctttctgttatacaaaataaggttcttttacattcatcagatctttgttaatcacccactgtgcacctagctgggctagatagatactggaaagacaaataagacctggtttctgtcattgagaacatagcgaaggatatggaaaattagactacagaatggtaagttctatcatagtggtatgtactacagaagcaaagagaggactccttacccagacttttaggggatgaaggacaatgtcaggaaaggctttctgtgggatgttttctctcagtggagtcttgagaacaaataggaattattcaggtagaagaggggaaggacactctaggaaaagggagcagcagcctgttgaaaaagtacagaagtaagagagcacatacatggcccatttagggaactgaagtcctgagtggctcgagtaggggaggaaaaggtacatgaaggtggaacagggaatgaagagatttgtggctgggatggtccaaagttgtcaaatcatgatgtgctttccatgtcatgctcagaaattgattctaagagccatgaagaagtataagccaggaagtgacatggtgagatttgtgtttggaaagatcagtctagaaactgcaacatacttctataagtgtaaatgatcatcagagaagataattagagggcacttactgtctctttaaatcttttccatcattaattttggattaaatgctagataacataataatagagggtttatgaattagtttcctgtcttctgttattaagcaaacatttgaaacctattttacttgttggtataacacatagacttagataattaaaattagagacttgacaaagctaccaattggtgctggacctcttgatggatctgatgttaggttaaacaaacacaagtgccttctgtatgccaggcagtgtgctaggaactgaagagagaatggtgaatgacttaggcattcacaatctagtggagagacagattcatacacaaatgcaagtgctctagaatacttatgtattagattccttaatgtacattttcactttcagtccttaccttaaacttaaatatggatgaggaaaccgaagataagaagtatttaacttactcaagatcatgtaataatgagtggtacatagccacaattcagtattcgaagtacctaactcaatttattccgtaccatattatactgcttctcttgacaaggcaatgcatatgtacttttgagcctgaagtagttttcttcctctcttttcttaattctttctaatgctacccaaaccggtaatgttcagccttgaagtatccagtcattgttggttaaaagtgcaggctctgaagtcagattgtctggattccaatcccagctccatcacttactccctgtctgtcagcctacatcatagaattatgagatgatgttggtaaagcacttaaaacagtgaaagcacagggaaagaattcaattgatgttacttaaaattgtcattggaatagcaattcatctactttccaaacattcaggaaattttgataaaatgcgtttaaactatccaactttattgaagttaatcttggtgaagagcttttgcctagtgtgcatatttgaaatctgacttcttgttcagggcatcagtggcctgtggcaaagatgccccaaaagtatctaggaaaatatgcctgtgagagtaacgtaaagatacttaaaaacttttgtattgtggaaaattttgaatatataccaaaattaacagagtagggttatgacctttctcatatctctcacccacctgcacaaccaactatcactccatggccagtcctgcctcatccacacccctatccatttatgttgctagagctaaatctagagacttgattgattgattgatcattttttgagacaagtaatgaaaaatggtggctttttttgttgttatttctggcattgttaaatacctagtaactcaactgaggatgaaaactggcaacataaatactcctggaattgtttggatagggtaggatacagattattacccagtttctacatgtgaagaaactatgactcaaagaaatgcttatcaatggtcatattaactgcaaacaacttgtgctaaaatgtgtcattggaaccatgctcattccatacatatttattgagttcaataaaatatttatatttctttttaaatgtctgtggccaacattatttttataacaagggcatttttattttgattacctaatttcttcttttgttatgttagaatttaaagtacttccctcctcctctgtcctatcctaatttttagctagtggagtgactttagggataatacagaggaaattttggtctccagcagagggtcagttgcaactatgaaaacaactcaggcaaatggtctattgatagtggaacttttcattataaaaagttcttttcaaattccaggatattggttgcttggtcactgaagagtctgtactaccattcagtagcaccctgggtgtctgagcagacctggttaggaatgtactgctcattttgaatgaaataaataaaaaggatagagaagctgccccaagcattgccaaacattctacatctgatgtatcattgatacaaaacattagtcttttagagtataccctaaaatacaaatagttttcattttgaatgttgccatctttgactatagccacatatcctttaatatatacacacacacacactgactccagggcattgatgaaagttcattgctttcttggtctctgggtgagtaaagttgttttaatatgtcaggtttggttttgtcaacaaaataccccagtgtacttaccttctttattcccattctttaatttttatgtccttggacctcgtaatttccccaaagttttgtatgccattccctcagcagcagaagtaatagtgcttgatgaagtatgactttgatattagtttagttatatatctggaatgtttattcccctgggctttccaactgagggagcccagcgtgaactccttctttggaaaatatctgagtgggcagacccatttgccacattaccctcattgtctgtctttgtttattcagctgaaaagcaagtacttgcctcttacacagccagtcatgaatcttagagtctcagaagctgttaaaacgggtagaaaaattgttatgggaagggagaggatgaaaattgttatcaggtattgacataatgtgcaagtaaaggtgctgtcttagagaagagcataatgactttaggtggttataaagcacaactctggcaacatttttatgggcccaatttattagggtctttgatttttatacaattttcctaccttctgagtaagagacaatgataattcattggcacacatgattcatttttactacaataggggaaaaactaggtttttaggatatgagcctaccatctggtgcacaggtaatgataaatatcctgtggtcataataacatgcacatgctcttggcatttatttttctggctatcttcatctctcaattggattttttttagcaggctgctaaaaagtctctttgcattcattctttccctggtccattttcacactgtagccagaattatgtttctaagatgtagatctgattattcttcctctcttgtataaaattcttccatggctatccagttgctcttaggaaagtccttcacctgtcaccacttcttaccccattctgtgtcccagccacaatgcactttttccagttctctatagtactatgctctcttttgccttgatgttgttacacatgctgctccttgccttggggatactcctctcctctacccttagcttagctatacctcctcattcttcacgtccatgcttagatatttcttcctctagaaagtctgaattaggtggttctccatgtgcaaacacatgtaccataatgttctattcatatttctgtttcaatacttatcacacgatattgcttctttgtttttctctctgctataagacattaagctgtataagaacaatgaccacgtctgtctttctcattgttgtatctccagcacctagaaattgtagtctgtatttctggcacaacactagtttgttgatgattgaaccagtgattaatgtgctttgccaggaatcttttctctagaaacctcagagaagaattacagttctctggttttgtgctctgcatatttttctatcttctattcatactaattcaattatcaacagaacattgctttgaaccttttaaacctctctaccttgcccagaagcacgtgtaaagaacatgtaaaatgaaaaactcctgcatatacttaccatacgcttcctatgtccatcctatctaaaattgcactcccacaacacacatgtagttactctccacctccatctcccctgtctccctttcctgctgtttttcctccttaggatttaactaccttctaacatactaaatacttaacctatttaagtaactaattgtgtgtccatttctaagatgtaaggtccatgagggcgttaattttggcctgttttgtttactgccacatccctagcatctgaaataatgtttagcaggtatatatgaggcaatatatatttgctgaatgaatgaatatattcatgcccttggatgtatgtctttttctttttcacttgattttggtgcacctgatacagccctgctgttagcactactgtttcttttccttccttattttgcagactttacagttagtcctatttgggtccataatcttggctaccccaggcagagattctgtttttccatgttgattggcccaggtaaccatatcttcacttgaatctgaccttcaaatctcctaacttgatctctgaagccctaagagaagttgtgtgtgcgtgcgtgtgtgtgtgtgtgtgtgtgtgtgtgtgtgtgtgtgtgttgcggagaggagatgatgcattcagagataagtcagatgcaaaacttgttcttttaaaacctagataggacaaatagatgattatttctatagtacaagtttgagtacgatgatatttgtttatgagaaatgctaaccaatggggagaaacttattcttcattttaaaaaatatgaaataagttttctgaaaagtataaaaagtaatatagtgaacatcccctgtatacctgcctcccagctttgtaatatctgaattttctcctgtatttgctttggattgttttcatttttgagataaaatattaaatatgatcatagcctcctggtgttctttttttttttttttatctctttttctttcttccctacccagatgtaaccactatcctgaatttggtgccatgcatttaaaaatgtttacacacacacacacacacacacacacacacacacagtgttgtgttcatgtttcaaattttgtataatgaactcttaccatgctttttttaaactcaccattttattgagatttttctatattgttccatgtaattctgctttatcaagtttgctgtatagtttcctactgtatgaatagtccacaatatctcatttttcttattgataatcatttgagctgattctacattttttgctttttcaagtaatgctgcaatgaacaacattgcacatgttttcttcacttgtaggtgagtttctctagagcaatacgtctcaattaatgtgcataggaatcacctgagtaccttatgatactgcaggttctgattcaggtcctgattcagttgttctcaggtgggcctgagaatctatatttctcacaagttcccaggtaatgcagatccatagaccatatttggagttgcaaggcactgctaggttctagaatatgcacattcttctctgaagaggttatacaagtttatatttcaaccaggaatgtatgagagatttggctgttctaggagtagcctcttttagatgattctataaattttatgtgtaaccattctctccttaaaattagatattttttttggagggaaagcattaaaacatatagcagaatcacttcagtgggtagttggcttaatttcagcatttctcaggaattgatctaaatatatatatatacacatacacacacacacacacaaactattttattaaaaattcacctgtttcctttttgttcaaatagttactctgtttaccattgccaaccaagacagggctttgactacaaaatgaaccatcccagagagttgaaagggaaggaagactgtgtgccaagtactatgctatattgtttcatttaatatccacatttgtacaggggagggagctgaggctcacagcaaagtgttagagccagtgtttggattctagtccacctgactttaaagattggtgtactactcctagcttcagttatctgtaaaaaggaggtagtggtagagcagataatcagatctctaacttccagcactttaagattcactagcttctagttagggaagtaaggaatgcctaccagcatactgtatcatgatagctccctctctccttttcaaattatgggttaaaaaacatataaagctgaccactgtaaccatttttaagtgtacagtttgttaagtatattcacattgttgtgaaacagatttccagaactttttcatcttgcaaatttgaaactctgtatccattaaataagaattccctcggccgggcctggtggctcacgattgtaatcccagcacttcgggaggccgaggcaggcggatcacgaggttaggagattgagaccacagtgaaaccccgtctctactaaaaatacaaaaaattatccaggcgtggtggcgggcacctgtagtcccagctgctcagagaggctgaggctggagaatggcatgaacctgggaggcggagcttgcagtgagccgagatcacgctgctgcactccagcctaggcgacagagcaagactccatctcaaaaaaaaaaaaaaaaaaaattccctcaactcccttttccccttcccccaagctcttggcaactatcattccaatctgtttctgtgaatttgactactttagatacttcataagtggaatcatggagtatttgttgttttgtgactagtttatttcacttaacacagtgacctcaaggtttctccatgttgtagcatgtgacaggatttccttcatttttagggctgaataatattccattgtatatagatgccacattttctttctttatccatcaatagacatatgggttgcttccacctcttgagtattgtgaatagtgctgctatgaatgtgattgtgcaagtatctcttcgaggcattgcttttagttcttttggatataaacccattaatgagattgttgaatcatatatggtaaattaattttttgggaaactgcgatactgtttttcatagtggctgtaccattttacacttccaccaagactgtggtgatagcttttaatggtacagaaagtagtgaatgggatgtatgaaatcagaagtgaagtagaaagaattggcaaattctgctagtgtggaaatagatatcatttagccatagtctgtttcccttagatattttatctaacattgcctgtttctccaagactattacttcaggaggggaggagggagccaaattatttcttttttgatatattattgaccattggtctctgagaatatccgagattgttaacatctaatagtgccttggcaataattagaggaagttcgacggttgtgttttgtatttttctctgaaggagtgtgcaagagtatgatgttgatgtaaacattgtgatgagcaggttaggagtatgtcaggaacatggaatgcaatcctatgtctgtattgcttgcagccttgaacaaaatcttcaacatcttgatgcttccaaaatcgcatttaaaaaatgaagcctcccggccgggtgtggtggcttacgcctgtaatcccagcactttgggaggcccaggcgggtggatcacaaggtcaggagatcgagaccatcctggctaacacggtgaaatcctgtctctactaaaaatacaaaaaattagctgggcgtggtggtgggcgcctgtagtcccaactactcaggaagctgaggcaggagaatggcgtgaaccctgggaggtggagcttgcagtgagccgagatcgtgccactgcactccagactgggagagagagcgagactccgtctcaaaaaaaaaaaagaaaaaaaaatgaagcctccaatctgttttagtattgtgacttctcaacatcagttttcttttgaggatcttagtgtatacatggcgtatatgtgttggcagggaggtggctgagttccactaatggcgtgtgcaagagcaggaatgatcagtggtgttggaagagggatttcttctctactgtgcccttctttttgaatataaaatgttactcaaatgcttagtcacgatgataaagcaaagaatttcacagcttgcagtgtggagcagtgtttatactgtataagtgtttgataatagtgaagtgtggcaggagagtgggaagaatttgtcaacaagttttgaggattaagaggattagatagggaacacaaagtaagataaccccctttgacttctgaaagaaaaaagtagttattttaaaatgtcctttggaatgactcaaggctcagctattttacttgcttctagaaaactgcaaatctattaaacttctagcactgtagacaactgcagacaggtatattttcgaccttggagtgtttattcagaaagcaagcagacttaatttcagtgtataatatacagatagaccctacttactgtgccatctgtatgtttgaagaagcagcctttactagtgactctgcccaaattcaggttctcctgtcaaattgctacaacagtttgtcaataaacctgtagccctagtctaccttctctagtcctttcttcacactgctcttaaagatggtcatgaccatctgaccttgggaaaattaatttctctgtgcctctattttcttattttataccctctatggtaaaggttgtaactatcttataggttccttgtacatttttatttgtatttatacctggattttattttatttttaaatttttttccttgtaagttttttgtttgttttggggtttttttttgaagcagggtctcactcctgttgtccatgttggagtgcagtgatatgatcatggctcactgcagcctcaacttcccaggcttagatgatccttctgcctcagcctcctgagtagctgggactgcaggtgtgtgcccccacacctggctaattttttgtattttaagtagagacagagttttaccatgttgcccaggcttcacactgccagttttcaaactgctataaagaactacttgagactgggtaatttataaagaaatgaggtttaattgactcacagttccacatgcctggggaggcctcaggaaacttacaatcatggcagaagccgaaggagaagcaaagaccttcttcacatggcggcaggaaagagagctagcaagagcagggaaaactgccttataaaaccatcagatcttgtgagaactcactcactatcactagaagagcatgagggaaactgcccctgtgatccaatcacctcccatctggtccctccctcaacacatggagattatgaggattacaatttgagatgagatttgggtgggttcacagccaaaccatttcgttccctttggcttatggccaactttttgggtaaatcagaatgaattttgaactatgtaaaaatgcatattccttagtacccccaccagagatttctattcagtcggcctaggatgggacccaggaatcagtgtgttactgtactctccaggtgattttgaggctggtggtaccagaaccttctttggggaatcattccatgttggatgaaatgcagactctttagactgcagttcagggccctaatatacctttctaatatgtatattctcctattcctccctattagtctttgctgcaaccataacaagtacattttctctactcactcttctccatatgccccatgtattttcccaagatagtatggcataactttgtaagcaaatatatatttattcctagtaatctacaaaatattcatttaatactatgtgtaagggctgggtgcggtggctcatggctgtaatcccagcactttggaagctgaggtgggagcatcacttgggcccaggagtttgagaccagcctggttaacatagcaagatcctgtctctacaaaaaataaaaacattagctggggatggtggcttgctcctgtagtcccagctactcgggacgctgaggtaggaggatggcctgagcctgggtgatctacagtggaccataatcatgccactacactccagcttgggtggcagagaagaccctgtttcaaatatatgtgtgtgcgtgtgtgtgtgtgtgtgtaagaattggttggggatgaatgtgaaactacaaaatgtggaaccaaccttcccttttttgaatattggcaaatagttcctaggttataccactgcacaccttaggatagcatttttaaactgacctttccttttgttctctttgtactacttttctctgaatgaattttccaggcattacaatgagcaaatagttctaacctttaagttgctcatctggcctctctgtaaacagggacagtaaggcaaatctggtcccaacctcagaagcaattggcagtacttgaaattgaagttattttcttcttatgctttctgttatattacctataagattaagccttaatcaggcattaatgaattattttgggtattttgaattcattaataggcctctgatgatcccttttagtttttaatttttgcaatctgtagtaacatctaaggatgctactttgccaaacagattgcttataataaaaatgtagggtagagaaaggccactgtcataggtgttttttgttgttgttgcttgttgttgttgttttgccttgtatcttctaattctgaaaacatccttgtaaggttcattactctaattttaagaaaagtctttacaaagaggacatgacatttgagattgcagagctataaacaacggattcagatttgcacccaagtccctttacttcataaactaatcttcctctactgtggcctggagctggatttcaagttattcaaattcagtttccgtgtttgctctccctgtccctgcctccccttggacttgggatattgtgataatgctgtaaatcaaaaagcccatataaattgaagaatagttaccaacataacagctactctatattaataggtatatggtaattaggatagaatactcttaagccttctaggcagtacttggttaattattttagtattacacatactaaatttgatagtggcctgatagagtcaaatgcattctttttttttttcattaggcacataacccatttttattataaaaagaaatgcacatataagtaaacttgtcttgtgccatccctcccccaaccccaggcagtgcatctcgcagcaacaaaagtgactccttccttttgtttaaggagaggatgcaaagagtaaagcggactttgtcttgcatcttggatacaagctcagccacagtagtatagggtatcaagcagagctgtgaggcccccattccaggacctagctcccagacaacatttctagacacaccctgtgccaaaagggaatctgccgccttcaagggaaggacccagtcctggcggcattcatcacctactgactaaagagcccttgggccctgaataaccagcagcagtagccagggaggacactgtggggccgtgggctctgagatgtgctggcttcagaggcgacccagcacattcccagctgtggtggctatggtgaaagactccttctgtttgagaaaagcagagggaaaggtaaaggggactttggcaccttaagtaccagctcatctatggtaggatagagcaataaatgggctcttgaggtccctgactctagggagcctaggcctaggctcttaggcagcatttctggacctgcccttggccacaggggagcctgctgcctggaaaacagagtcccaggcctggcagcattcaccacaagctgatggaagagcccttgggccttaaatgaacatcgacagtggcctggcagaaccagtggtggtggtggccacaggaagaggctcctgtgcctgtggaaaggggggaagagtgagaaggactttgtattgtggcgcgagtgccagcttagccacagtagaatagaacatcaggtaaactgctaagactttttacttctatccctggctcccagacaacatctctggatacatccagggtctaggggagcttgccgccctgaagggaagggccttgggagagatccagtgctgtggtggcttcaggtctgacccagtgcagtcccagtggtggtggccacaggggtgcatgcgttaccacacccccagtttcaggtggctcagcacagggagagagacttcatttatttgggagatggtaagggtaaagaataagagtttctgcttggtaatccacagaattccagatcttatccaggaccaacaaggcggtacctgtataagtctgcaaaaaccagtgttactgcatttggggcccaagtcccttcgaatacctggaaagccttcccaagaaggagaggcacacacaagcccagactgtggagactacaataaatacctaactcttcaatgcctagacaccagtgaatatctacacgtatcaacaccatccaggaaaacatgacctcatcagatgaactaaataaggcaccagggaccaatcctggagaaacagaaatatatgaactttcaaacagagaattcaaaatagctgttttgaggaaactcaaattcaagataaaacagagaaggaagtcagaattctattagagacgtttaacagaaattgaaataagtaaaaataacagaaattctagagttggaagtgcaattgacatgctgaagaatgcatcagagtctctctctttttttttttttttttgagacggagtctcactctgtcacccaggctggagtgcagtggcacaatcttggctcactgcaacctccgcctcctgggttcaggtgattctcctgcctcagcctcctgagtagctgggattacaagtgcttgccaccacacccggctaatttttgtatttttagtagagacggggtttcactatgttggccaggctggtctcaaactcctggcctcaggtgatctgcctgcatcagcctcccatagtgctgggattacagacatgagccactgcgctggccagagtctctctgtctctctctctttttttttaaattatactttaagttctagggtacatgtgcacaacgatcaggtttgtcacatatgtatacatgtgccatgttggtgtggtgcacccattaactcgtcatttacattaagtatgtctcctaatgcaatcccttccccctcccccgacccctcaacaggccccggtgtgtgatgttccccatcctgtgtccaagtgttctcattgttcaattcccacatatgagtgagaacatgcggtgtttggttttctgtccttgtgatagtttgctcagaatgatggtttctagcttcatctgtgtccctacaaaggacatgaactcatcattttttatggctgcatagtattccatggtgtatatgtgccacattttcttaatccattctatcattgatggacatttaggttggttccaagtctttgctattgtgaatagtgccgcaaaaataaatgtgtgcatgtgtctttatagcagcatgatttataatcctttggttatatacccagtaatgagatggctgggtcaaatgatatttctagttctagatccttgaggaattgccacactgtcttctaaaatcgttgaactagtttacagtcccaccaacagtgtaaaagtgttcctatttctccacatcctctccagcacctgttgtttcctgactttttaatgatcgccattgtaactggtgtgagatggtatctcattgtggttttgatttgcatttctctgatggccagtgatgatgagccttttttcatgtgtctgttcagccagagtctcttaatagtagaattgattaagcagaagaactagtgaacatgaagacaggctatttaaaaatacaaagtcaggctgaatgcagtggctcacacctgtaatcccagcactttgggaggccgaggcaggtggatcacttcaggccaggagttcgagaccagcatggccaacatggcaaaaccccatctctactgaaatacaaaaaaattagccaggtatggtggtgcacacctgttatcccagctgttcaggaggctgaggcatgagaattccttgaacccgggaggcagaggttgcagtgagccaagatcatgctactgcattccaccctgggcgacacagtgagactctgtctcagaaaaacaaacaaaaaaatcccccacaagtcagacagtaataaatgctggtgaggatgtggagaaagggaaatcttgtatagtgttggtgggagggtaaattagtacaaccactatggagaactgtttagaggttcctcagtaaactaaaattagagctacaatacaatccatcaatctcactgctggatatatactcaaaggaaatccatatatcgaggaatatttgcattcccatgtttgttgcagcaactgttcataatagccaagatttggaagcaacccaagtatccatcaacagactaatggataaagtaaatgtggtgcatatacacaatggagtactattcatccataaaacagaataagatcctgtcatttgcaacaacatggatttgcaacaacaacaactagaggtaattatgttaagtgaaataagccaggcacagaaagttaaatattgcatgttctcacttatttgtgggacctaaaagttaaaacaattgaactcatagagatagagaatagaaagatatttactagagtctgggaagagtagtcgggggttgcatggaagggaggtggggatggttaatgggtacaaaaaataaaatatactctcgaaacatgaacaattaactcttactaagtggcaaaattagttttttcaaaactttgaaaaatgtatactaatggaaaagtggtggcacaaaaagataagtgttttgcctaggttcaaatagaagtttgatagcttagtatagtccatatccagaactcttgatcccaaattagcacatttcttttagagagatacttgtattgttttagttatgagagtgcatttgaataaaataaatggatgacaaatactaactcatgattgtgtctttggctttgaacagtatgttaaggtgtaccagctgaaaacaaatgcaaggtgttgccaattgataatttattttgtagcttgagcaactgcttccctcctaccccacaccatttggtaatcatttgatttgatttcacttgcttacagaaaaacagattggaaaaaaaatgccagacgcagtggctctggcctgtgaaccagcactttgggggctgaggtgggcggattgcttgagcacgagtttgaaaccagcctgggcaacatgatgataccccatctctataaaaaaaattttttttttaattaggctggcatggtggtgcacgcctgtagtcccaactacttgggaagctgaggtgggaggataacctgaggcaaggaggttgaggctgcggtgagctgtgatcgtgccactgcactccatcctgggcgaccgagggagatccggtcacatacacacacacacacactcacacacacgaaaagaaaagaaaacacaactgcatttaatagtattaggtagaatttcttcttctttttgctccttatctcctccccttcttttaaaggaagaagtggtgaagtgaagtgaaatgaggaagggtattgacgtaagataaacctggatgtgaatgttgtctcaaccacttacccgctaactctggtcttgggcaagcacttagcttctctaagttttagttttcctcttaataaactgggacttgcagtctctacagttgcaaggttgttgtaaagctaagtattcatgcaagtaaaatgtgcaacaaagtccgagacatagttagtagatcatagtaaatgacaattatttttattataatagtaataaggtttacctagggattaagataagcagttgtatgaaacagtttgctgtattttatcacaagctgttgtggaggaaacccagaattatatctgttgttagccagataagatatgacctttaatggaagatctcataatcatgtaacttaaaaacagaaatcttactcaagaaaatcaaggggaataccattagaaacaataagagagttcatcaaaatgtctgtatggatatctcaaaaaatctaattgaatgattattactaatattgattagaagatacaatggaaaaaaaaatcacagttgtaaccactactgccaccactactactaatgataaaaagtttaaaagtcatcataacaagatatgtatgaaactcatatacatattttttaagttataaaatttcactgatataaaagaagactgaataagtggagacacatgttagtgctcatagatgggaaaattgaagttttttttgtagagatggaaccggttttgccatgttgcccaggctgaacttgtggactcaagtgatctgtctgccttggcctcccaaagtgctgggaatgcaggccagagccactgtgcctggctgaaaattgaatattgtaaagctgccagttattgatgcattaatttttaggataaatggaattactggggaaattacaatgggaatatttttggagggaatgtggcaataaagtttaggtggaaacattagtaactatgaacaactaaagaaatgtaaagaaggataatacattagtgaagcacattataaagctgcagttattaaaacttttttatgtgctgatataagaataggttgtttttttttttttttttttttttgagatggagtctcgctctgtcggccaggctggagtgcaatggcgtgatctcggctcactgcagcttccgcctcccaggttcaagcgattctcctgcctcagccttcagagtagctgggattacaggcgcccgccaccacacccggctaattttttgtatttttagtagagacagggttttactatgttggccaggctggtcttgaactcctgaccttgtgatccacccccctcggcctcccaaagtgctgggattacaggcatgagccactgcgcctggccagtaatttttttttgagacagggtctcactctgttgcccaggctggagtacagtggcatgatcacaactcactgcaaccttgacctcccaggcttaagccatcctctcactttagcctcctgtatagctggaaccacaggtctgagccaccatgctggagtaatttttaaaaattttttatattataaagatggggtttcactatgttgcccaggctagtattgaactcctgggctcaagggatcctcctgcctcagccacccaagtgccgggattacagatatgacccactgcacctagccagactaggtccacttaatagatcagacatagattctgacgtgtaaaaatattctcatatgtaatataaaaaggaccatggtttagccattcaccagtcgaaggacatttgggttatttccaatgtttggtgattatgaataaagctgctataaacattcagttacacttatgtgtgaactcagttttcatttctcttgggtagatacctgggagcagttattgggtcatatggtaggtatatatttaactttataaaaattagccagacatgatggctggtgcctgtggtcccagctactcgggaagctgaggcaggaaaatggcgtgaatccagaaggcggagcttgcagtgagccgagatcgcgccactgcactccagcctgggtgacagagcaagactccgtctcgaaaaaaaaaaaaaaatagaaactgctggcctgatgtggtagctcacacctgtaatcctagcactttgagaggctgaagagggaggatcacttgaggccatgagtttgagaccagcctggccaacatagcaagacccctgtctctgcacaaaatttaaaaattaggcaagcatgatggtgtgtgcttgtagccctagcttcttaggaggctgaggcaggagagtcccttgaactcaggtgtttgaggttacagtgagctatggtcatgccactgcactccagcctaggtgacaaagtgagatcctgtctcaaaaaaaaaagagagagagaagaaagaaagaaactgtcaaattatttttcaagcattcccatcaacattgtactagagttctacttcctcagcattgtggtatttggtattgacagttttttgaaatttgccattctcttagatgtgtagtagtatgtcattttggttttaatttgtattttcctaatgaaagatattgggtaccttttcaagtgcttatttgtcgtacatatatcttctttggtaaagtttctagatcttttctccatttttaaattgcattatttccttattgttgggttttcagggttctttatatattcttgatgcaagtgctttgacagaaatgtgatttgcaagtattttctcccagtctatggctgtgtttttattttcttagcagtcttttgaagaacaaagtatttcattttaataaagtccaacttatacatttttcttttatggattttacttttggtgttttatttgtaagctctttgcctaatgcaaggtcaatcatattttcttctgtgttttcttctagaagtgttatagttttacattttacatttagggctatgatccatgttgagttaattttttttttttttttttttgagacggagtctcactctgttgcccaggctggagtgcagtggcacgatctcggctcactgcaagctccgccctctgagttcaagtgattctcccgtctcagcctccccagtagctgggattccaggtgcctgccaccgcgcccagctaattttttgtattttttttagtagagacgagacttcaccatcttggccaggctagtcttgaactcctgacctcgtgatccacccacctcggcctcccaaagtgctgggattgcaggcgtgagccaccgtgcccggcctattgagttaatttttatacaaggtgtggtttatgtcaagttttaatcttttgtttatggatgtccaactgtaccaacaccatttatttaaaaaaaaaaaagcatcctttctccattgaattgccttttcatcttgtcaaaaattaaatttgttagatatttctgagggtttatttctgggctctctattccattggcttttgtgtaggttttttcttttttctttttaccaataacaccatgtcttgattactatagctttatagtaagtcttgaaatcaattattgtgagtcctccagctttgttgttatttggctattgaggtttctttgctttttcacatatattttagaatcaatttgttaatatctataaaaaatccttctgggattttgattgggatttattaaatctatagatctaattgtttgcattatgtcttccatatttttagatctttttgtttcttttttcatgttttgtagtttttagcataaaggtcatacacgttaattttgtatgtaagtatttcatatttttggagctattctaagtggtattaaaattttaaaaattccatctgttcattcataacacatagaaatacagttgatttttgtttgttaattttgtatcttgcaaccttattttttatttttttgagacggagttttgcccttgttgcccaggctggagtgcaatggcgcaatctcggttcaccgcaacctctgcctcctggattcaagcgattctcctgcctcagtctcccgagtagctgggattacaggcatgcaccaccacacccggctaattttgtatttttagtagagacaaggtttctccatgttggtcaggctggtcttgaactcctgacctcaggtgatccgcctgcctcggcctctcaaagtgctgggattacaggcatgagccactgggcccagcccttgcaaccttattaatgtcatttattagttctaggaatttttgtaataaacatttttttctacataagctttcatgttatctgtgaatagagacagtatttatttgtttatgtatttattgagacagggtctcattctgttacacaggctggagtagagtggtgtgatcatggctcactactgccttgacctcctgggctcaagtgatccttccatctcagccccaggaatagccgagactacaggcatgtgccaccattcctggctttttatttatttatttatttatttatttatttatttatttttctgtagagatggggtctcactatgttgcctaggctggtcttgaactcctggattcatgtaatcctcccaccttggccttccaaagagctgggattttatacgtgtcgagctactacccctggcccagttttgtttcttttttgatctgaagaccatttctttcttttccttgccttattccactgtctaggacttctaatatgattttgaataggagtggcaagagaggacattcttgccttgttcctgatcttgggagaaagtaattagtctctcactatgaagtataatgttaaatgtagtttcttcatagataccctttattaggctgagaaagtttccttctattcatagttttctgggcacttctcccatgaatggatgttaattttttaaaatcttttcttgcatcagttgagatgagatggcatttttctttagtctgctaacaggatggattgcactgattagttttcaagtgtcaaaccagtatttctggaataaatcccacttaatctttttatatattgctgggttcaatttgttgtttatatattactggttattttgttgagaggtttttgatccaagatgttcacaaggaatattgttctgtagttttcttgtaatgtttttatctggttttgatgtcaaaataatgctgtccttatagaattaattggaaaggattcgtacctcttctgttatctggaagacattttatagaattgatgttatttcttattaaaatgcttagtagaattctccagtgacgccatctgggcctggagatttctcttttggaaggttttaaactataaattctatttctttaataggtataggaccattaaggtaatctgaattaggttttgatagcttggtttccaagagattggtccatttcatcaaagttgttgaatttatgtgcatagagttatgcataatattccccgtagtgatgtcttctccttcattcttcatattagtgtctgaaaacaataacaatgatttatttctcattctgatggttcttctcctggtctctcttgggcttactctggctgtattggtagattggctacagctggaggatctaaaaatggcctcacccatatgtttggggccttgatggggatgactggagtagctgagacttgtctctccctggattcattgggaaccaaaatgatctgccatgtggaagtggaagcataaggagaggacttgatcatagtaaaatcctcagtaaatgctcatggatttatccaatgacgtggagaccaaagaaagagtttcaaagaggaaggggtatcagtatgtcacatgctgcaaaatagttaagcagaatatggcctgagaaggctattgttttgttttgggttagtaacttttgagagagcatttttagtagagtttagaaaagattgcagagcattaagaagaaaacgtggtgaagaaaaggaggcagtctgtatttttgtttgagaaattttatttagaaaataaatgctagttaaatggaacaggagactaaacagagaattgtgagagacccaatgcatatttgaaggtaaattctgtaaagagtgaaagcttgaaaaggctcaagtagggggacaatgggagtgggcagagtagagtcctggaaagagctctgggagaggatgcgataaagagcgcagttggagggattgtttggtcttggaaggagctggctagcctgaaactggagggaaggttaaattgatgggaaaaagcaggaagagagaaaaagaaggtctcagtttccatgaagttgcaaccatttgctggttgtacagtgggatggaagacttaaagagaagcttggaatagccaatgctggcaatggatattgaaacagtaagataaatctaaggatttagaagcagttctagggacttagtgaaagtaaaacctttaacacactaggtctttatattgtaactttctctaacaatgctctaggaacacggtagaggatacatagtggaaggtacaaagaacttttagaggccgggcacggtggctcatgcctgtaatcccagcactttaggaggctgaggtgggcagatcatttgaggtcaggagtttgagaccagcctgaccaacatggtgaaacccggtctctactaaaaatacaaaaattagccaggcatagtggtgtatgcctgtagtcccagctactcgggaggctgagacaggagaatcgcttgaatccaggaagcggaggttgcagtgagctgggagtgtgccatggcactctagcctgggtgacagagtgagatttagagaataagggtgtttagaatgctaatgagtaaagtatttgagtacatgatcctgtatagtaaatatttttctataatctagactagacttctctctttcttctaccttttttatgacttcaggaaacttgttgaattattccaattctggattaaaagaaggtcccttctgccagaaaattgtaaaaagctgtagtttaaccaactctaattcctaatcttccccaatcccttattttagagcatttattgtcatatctcgtttctgatatcaatttctgagagcattttctacattttaagaaaagtaggacatctggggagataaaacagtaaatatcctattctgatactgtcacatttttatctcatttcatcctcagaaataaccatattaaatatatttgctgtcattttgccttatgtattttgagactatggtattagatatatatctaatttagaactacatatttttaatgaattgtacatttttttatgtagtgaccagacctcttatctgcttatattgctttttttttttgcctaaacatctattttgtctcatattaattaatgtagctagctgtactagttttcttttggctagtatttacgtgcttcatcttttttccattcagttacttttaacctttaggtataattctgttttatgtcttttgtaaactgtttgtagctggattttgtgggttttcattgaatcttgaagatctttgtcttttaaattgaccagctctaattttattttataaaatggaatctgatttgaacagacatttatagctatttactgatcagtactgtgctaagccactatgagaaatgtggagaaatatgagaaaatttgccatcattgagcaatttaaaacctgtgattttcccttaaaacatagtatatacattctaaattttcaaaggaaattgccttctgatttacttattcagattattagatataccagtgggtcaattaaaaaaaagtttttgtaaaccaaaaacaatatacatggccatatataatttgacctttaattatttttcatgatagatgaaaagaattagccacattttgtacatggagacactgaaactcagagcagttagactcactaacagtcctagagctggttaattagcagcaaagtttgattttaaagtgttctgggtctgtctgattgttggcttcttaaagtgaaaagacatggactttggagttactcattttgggcttcagtctcttctttggtactgattagttgtatgatttgtttcatctatctgatactcagattccttgcttaaggtacctgcatcacaggattatggtgaacactaaaggaggccatttgtgtccagtttcttgtgtgatgtctgatatatgtatagtatatgcttaatagctggtaatatcatcattgttattagtagtaaaaactagcctttacaaccttttccagaacttgtcatcttgtctcattaattagatgaattatctctgaattgtggaaaactggcagtgagccagggacaagcactaacaacatgatttttaaatgtgagacagaaaattttctacaaaacctgggttatgttgccccatttatttcatatggctaccctaaagttgaagaaatgttttgctctagtaaattgtgactgggaattttaattgatacatttttattttcaaacaaaacttaaagcttttctttaaaagtagtggctttaatactacacatctctacaaagtctagtttaaagaaattcatcagctttaatattaagtttcccaagttttcaaagatttgtggcaataccttggcataacataaatgtgaaatgtaaattgagtattaatgttactctagagtaagactctcaaaacaaaaactcttgtgttgataattccttttccctacaatgaggcttttctgagattccttttcttcagacctaaaacataaaatatggtccaataaaaagtacattttgaaatacaccatatacttaggaaatcaggcctgtagtcaagataatatagttttgttggtttttttgtttgtttgtttattttgagacagggtcttgctctgtcacccaggctggagtgcagtggcacgatctcgtctcactgcaacctctgcctcccaggtttaagcgattctcctgcctcagcctccggagtagatgggattacaggcacatgccaccatgcctgactaatttttgtattttagtagagacggggttttgccatattggccaggctggtcttgaactcctgacctccggtgatctgcccaccttggcctcccaaagtgctgggattacaggtgtgagccaccacacccagccagtttgttggtttttttaaagactcattcgatgtacatgaagaggtttgaattgtgtattcctactcttgattttgacaatatttttccttttcaattcagaaatcaggaatgatgtaatttttgtggatccaatcctaggcttgtgaaaatgggtgaagttctttgttggatagattagatagattgaaagttatatttacatgcattttcctggtctttgtttaaacagagtagggtttttaatgatcaatctgaaaaagaaacaaacaattgcatatgaaaaaaggatagtaatcctatacatctttatctttcatttttttcctcttctccctcattgtacatgggagcagttgcagcctaagacttaagttggagccaaagggaaaagaaaagattgtactccttttagtgaaatagcattttaaatactaaaatgttccacaactccttatgcaataatcagctgaagcattaataacttcctgctatcttaaatgtaacagtcactttgaaaaagcctcaatcattagttgggtcccctgtggacgttagtgccaagttcagttgaaatagttgcttgtgggacaccaaggcatccttccagcaaaattttaaaaattgaatctagtaagacctcattgcttaaaaaaatttttttgcatattttaaaatttatatccaatgaaatttactcatttgatgtgcaatagttctgtcagtgttgatacatgtataatcaagatgtaaaatggttttattaccccctcaaaattcccctgtattgctcctttgtagtcagcccttccctcctgcccccagctcctggcaaacccctgatctgttctcttcccctggctcctttcatttagcataatgcatttaagattcatccatgttcttggatgtcagtggtttattcctttttattgatgaatggtgttccattatgagaatgtaccatagtgtatccattcactagttgaaggacatttgggtgatttccaggttttggtgattattaatatcacttatcataaatatttctgtacaagtttttgtgtgactataacttttcatttccctcagataaatacctaggagtggaattgctgggtcatatagtaaaggtataattaactttataagaaactgtcaaactgttttccaaagtgtctctactattttgtacttaacaccagtaatttttgaaagtcctgcatgcttgccagcaattagtattgtcagtttttttgtttgtgtattttagccattcaaatagagggatactcattgcctttcaaagtacagttttgcttttgacttccactgagtggatgttcctataatatttgcattgtgtgtgctgagaatagaactatttccatctacttttgcaagtcagactgtagttccaactgtctaaaactatgatatatcttttggacttagaacttgaatggccagtgctctgataaatattataaatttaggaataacttaatacaggttttttgtattcttaatagataacagtatttgaagatattaaaaagcaagtgtactacctaaagcaatttatagatttaatgcaatccctatcaaaatatcaatgatattcttcacagaaattttaaaaaaaaccctaaaattcatatggaatcacagcagacaaagcaatcctgaacaaaaagaacaaagctggaggcatcacactacctgacttcaaaatatactacaaaactatagtaaccaaaacaacatggcataggtataaaaacagacacataagtcagtggaacagaacagagaatccagaaataaatccatgtatttacagccaattgattttcaataaaggtgcccagaacacacattgggggaaaggatatattcttcaataaatgatgctgggaaaaatggatatctatatgcagaagaataaaactagacttcctatctttcatcttttaaaaaaattaactcaaaatggattaaagacttaaaagtgagatctgaaactataaaactgctagaagaaaacacaggggaactgctttagaatattggtactatacagccatgaaaaataatgaaatcctgctatttgtggaaacatggatgaagctggaggttatgttaagtaaaataaggcacagaaagataaatactgcatgttcttactcatatgtgggagataaaaaaaattcgagctcatgaaagtaaggagtagaattggagctgggcgtggtggctcacccctgtaatcccagcactttgggaggctgaggcaggcggattacgaggtcaggagttcaagactagccttaacaacatggtgaaacaccatctctactaaaaatacaaaattagccaggtgtggtggtgtgcccctgtaatcccagctacttaggaggctgaggcaggagaatcgcttgaacctgggaggcagaggttgcagtgagccaagattgtgtcaccacactccagcctaggctacagagtgagactccatctcaaaaaaaaaaaagagtagaattggaggtattagaagccatgaagggtaggtgagaaggaaggatgggaggagattggttaatggatataaaattatagctggatagtactaaatgagtactgatgttctgtagcacaatagggtaaatatagttaactgtaatttactctatattttcaaaaagctagaagagagaattttgaatgttcatagtacaatgaaatgatcaatgtttgaggtaatggatgtgctatttaatctgatcattacacattgtatgcatgtattgaaatatcactccgcattgcataaataggtattattattgtgcatcaactaacaataagagtgaaattgttgttgaatgaatgaaaaggactcagaaattgagttttgcaaaggtatttatgcagttttgcaaaaggctgtagattgaatttcaggctgtcttcctgaaccagattccggtgagtgctctgtattagttatagccaccagtagtcttctagtaatctatgcttaagtgcgataattttgtagatagaatttcaggcagtctttctgaaccagattcctgtgagtgctctgtattaattatagccacaagtagtcttctagtatctatgcttaaatgcaataattttgtaatcattttagtttaccagcagtattgttgtcagggtaacatttctttgttctaggagatttccatcatgactgaggacatagttattttattttgttacgcaaatttttcatttactgtttttatggttttttatctgcaaagggttaacacacaattgttccaaactgcttgagcattacagataattttagcactcagaaatgacttcaaaaagagacacagagaggacacattcattaggacatacaatcacaattagtattttccaaaaactcccatcattaatgcaaacaagctgaataccagaacataccaaatattctctatgagatagatggttaaaaattgaatgaagagagagcctaccaggtatattaaaggcctagaaaaggtcttcagtatgttcaagtaaataatctcttaccagagcaaatgtttgtgcacaaagggagggcaggtgggggtaggtggcaggggaacttatgggacttgtaaacaaaatcttttttttagggctaaaaaattttcatctcttggcttttggaatgtttgaaaaagtgcaggatttgattttctctgggactttatgtgactatcttcaaatacttaaagcagtttggcaaagattttagtttcttattcttcttcagggtgaaaatcactatattttattgttcttcagaagccaggcgataaaaggaaataatgttgccaagattttgctctctgtgagaacatttacattacccttctctaattatttctctatagagttttccaaagaattaaagggctgaaaggaaacctgctactcacacgataaagagtttattccatatttacttttaggcaattgaatgagctgttcggcatcttattcatacttgtctgcaattagctttaggtgtcctcttcatattgtttcattcccattaacatccacactggtgacttgccattaatcatgttgcagactcctttgtgctgctctggtgtctaagattctaactcattaaaaagtcagcacttcctcttgtctttggtccttctcattgcttctatcaattgaaacttccttccttctttttcatattgccacctttttactaaggggattgcattatttctgcattaactcctatctggttccgcacaaatgtctagacctgtgaagggtctgagattttactttacttacaagctaacaaattatcctggcacaatttagtgaatacccagagtgttttacatttattactgttgcttatactattcatttaacttgcatcatttcatttaaggtcagtcactgggacgggccttaagttctgagttacacacagaaaagatgcccatgctccctggcacttggtttactttgtattctcttcctttcctttggttttttggggcagaagtattaacatgatagtgcctttctgtcttgatgtgtcagcccccttcttatccctggggtggtctctcttgctgaaacatttgccattcaccctgctacagataaactgattagtaccaaggatatataattaataaatgctcatttttcatcttctctgaagccacatcctaaatccttctgtttttaccaatgtattttaaggcacacatattgttaatgagtggagcctggtataagtagaatatcgtcttattctctacctagatgaaccacaacatggatttctgcgtaacagcccactaattctgtttcccagacgttattcaaagctgctatagtactaaacccattttcaggcttttagatcttatccgcaggatataacgaagctatagcctgtgaatctaacatctgaattgcatttattattttatctgataccactttctacttttttccagctgttgtattaattattgcaatactccaaagcacttccagcttaagtattgggactgagtggtatagctactattattatgccctgtttacaggagaaaaaataaaggcacgcagagcttaattaacttgcctaaggttataaagttagtgagagagccggatttaatcttagccgtctacgtctacaatctgtgctcataacttcataactctttgctttactgtctcttcaaattattgtcatttgagaggtttaggtagtagatattgttatggattcataataggggcagtacagttagagtttatggagaagtgagtttcagctgattcttaaaatagagaataggtttgaatatgtgaaaaagagcattccaagatgtacagaataagcaaaggttcagagacaggactaaccggagtatgttcagggaataatgaagatattagactgactatagaaataataaataaccagtgaacttggttagtattgaaagtttatccattagaacttcactggaaaaaatattaagtgtttatatctgagttcttaaattcaattggattcttttgaagatactgctaatcttactcattgggaacattgactcagttttcagatggaaatacattagtaaggaaataatgaaataaaattcatagtttttattgtagaaaattttttttagtattttcattttttcttgagctagttctactgacaccaacatactttgattagttaactggtgataaaataggtccagcaggagaagttggatgtaatttgaatttctgcccgatttcagaagaaaaatgttaagtgttctggtcatttctggtggagtgaaggtcttgttatgaagttgtcattggcaggtttacagaccactgaacgtggctttgttatttacaaaaaccacaacacacatacgcagaaagtagctatcatgtgaaaacatgtaactctgtcaaagaaatgtcatgtttatgtagcctagtgaaaataagaatcttgattgtaatgggaagctggttcctttcctaagcttgaggctgaagaaatgtgaattttcctttgggttttgtgaaccacccaagtttgaaatagacataaaataaacaaataagctgccaatatttatttatttattttacgttaattattttttatgagacaggtctcactctgtcacccaggtgggggtgcagtggcaagatcttggctcactgtaacctcagcctcccaggctcaagcgatcctcccacctcagcctcccgagtagcgaggactacaggcccatgccaggatgcccgcctaatttttgtattttttttggtagagacgtggtttcactatgttgcccaggctggtctcaaactcctgagctcaagtgatctgcccaccttggcctcctaaagtgctaggattacaggcatgagccactgcctggtctatttatttgttatttgttatctttacaaactagaagagctgtgaagagcagggaaataaagtgacaccaaaggttaggaactgcagaagtgtgggaggtatagagttggccaagtgggaatttctttgaggaatcttttgttttgacttgtgtggataaataagctgcttgtgattacataaagaattttgaagcttaatttccttttctagaatggagaagcaaacccctttacaactctctttttaagagtctggatttgtagttgtctagtagctttttgaagtcatcaaaaatagtatcaaagattattttttccaagctaaactgtgttggtacagtgccattttatatagtgccttacctatttagaactgtaatttgtaccatagatttctcaggaccctttaagggtaggatcatagctattttggaatgggacctattcctaggatacatatgttaatacaaagtcctctgttactgctgtgtcaaactatgttgaaaacactttccttttgataaaatgaatagaggcagtagcaaaaaatgaatcctaactgacctttaaatgagtctttgcattagaaggctaaaactaagggcttctcaatatttttatccaaagaactgtctgactgcgaagaatagtggacaggggtgtggtggggaggaagtggggatggttaatgggtacaaaaaaaaatagaaagaatgaataagacctagtatttgatagcacagcagatagactgtggtcaataatttagtaatttatggacagtaatttaattgtacatgttaaaataactaaaggagtataattggattgtttgtaacacaaaggataaatgcttaaggtgatggacacaccgtttatcctgatatgattattacacattgcatgcctatgtcagaatacctcaggtaccccataaatatatacaccttatacacctatgtactcacaaaaattaaaaattaaagtatttctttcgaaaagtgaaaaaagtgaaaccaacaaacaaacaacaaagaactgtttgaaatatacttaaaagaaatgtttattttccaaatattttaatttgggaaagacattcaactcacagatcaggatgaacctgtaaactttctcctctggttttattgttcatcatttccttactttaaagtttctattcttcattaatttcttcctgggcagaacacattagcttatgattctagctatggcacaatctagtatgaccttgaatcggttgccaaagttaatcatctgagccttaggcttttgctgctatacagtgggattatttattatttaacatgttgtcatttccaacatgtgcccttagtgccatgtagataagcctgcctttggtggcttctaattcagaaaaactaataatacacacacacacacacacacacacactgtcacacacacactacataatttatgtactctatatgtttcctgatttaagtaaactaaacgggatagaaagtaaatttgaactagagttaattttatctatccttacaaagttgtcatgaaaatttattaagaaaaataaaatagagttcattttattaagagggcattaaatcttagttggtaatgtctctttccttctttcctttgcagagtatgtatgtaactgctctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacaggtaagcaacagagggtggaactgaagtttattttattttagcaaggggaaaaaaaaggctgctactctcaaggaccatactggtttaaacaaagggggatgagggtcatagatttacaaaatattttatatacttttattctcttactttatatgttatatttaatgtcaggatttaaaaacatctaatttactgatttagttcttcaaaagcactagagtcgccaatttttctctgggataatttctgtaaatttcatgggaaaaaattattgaagaataaatctgctttctggaagggctttcaggcatgaaacctgctaggaggtttagaaatgttcttatgtttattaatataccattggagtttgaggaaatttgttgtttggtttatttttctctctaatcaaaattctacatttgtttctttggacatctaaagcttaacctgggggtaccctaatttatttaactagtggtaagtagactggttttactctatttaccagtacatttttgagaccaaaagtagattaagcaggaattatctttaaactattatgttatttggaggtaatttaatctagtggaataatgtactgttatctaagcatttgccttgtactgcactgaaagtaattattctttgaccttatgtgaggcacttggctttttgtggaccccaagtcaaaaaactgaagagacagtattaaataatgaaaaaaataatgacaggttatactcagtgtaacctgggtataacccaagatctgctgccacttaggagctgtgttccttgggcaagtaatttcctttcactgagcttgtttcttctcaaggttgttgtgaagattaaatgagttgatatatataaaatgcctagcacatgtcactcaataaattctggtttgttttaatttcaaaggaatattatggactgaaatgagagaacatgttttaagaacttttagctccttgacaaagaagtgctttatactttagcactaaatattttaaatgctttataaatgatattatactgttatggaatattgtatcatattgtagtttattaaaaatgtagaagaggctgggcgcggtggctcacgcctgtaatcctagcactttgggaggccaaggcgggtggatcacttgaggccaggagttctagatgagcctggccagcacagtgaaaccccgtctctactaaaaatacaaacaaattagctgggcgtggtggcacacacctgtagtcccagctactcgggaggctgaggcaggagaatcggttgaacccgggaggtggaggttgcagtgagctgagatcgcgccactgcactccagcctggtgagagagggagactctgtcttaaaaaaaaaaaaagtagaagagaacttcattaagaagtttataatttcaaatgcagcaataatcaatgcttctgatgcttaatattttaaaatagttatttgtcttaattttcacagcaactccttatatataggttactaggtcacaaagatagtaagtgccagagaaagaattccaaattaggtcttcaattccaagtccagtgtcttcactaccatagcataccgtagcatgtagattctataatgagaaaactgataatcactctattctttgagattgagaatagagtggtagcttaacgctgttccctccactccccctaaaacatgctcatacaagttagattcagaagtttcacattgcttaccgttttaaaagataagccattgttaagtttgttcattctggtgtctcatggagtgtccactactttctttggaataatattctgcaaacatatttgtggagaaatagaaaagtgtttacttctaggcccagtgctttattagaagagaaagaaataaaggaaggattaagagagagttttataatagaagctgtaaaagaggaaaaaacagtaatactgatatttatgtactatcttactgtattcataattctactgcaaattattcctgatttatcttttctctgacagttaatgctaccaagtttaatgctgaaaccctatcctgaaaataggtggtaaccataaagtaatggaaaagtacactagactagtaatctaaaggcctagggcaggggtctgcagagtatggcctatgaacctaatccaccccactgcctgtttttgtaaagttttattggaacatagttccatgcatttatttatgtattgtctatggctgcttttgtgctatagtggcagcattgactagttgtgatagagactgtatgggctgcaaacataaaatatttactatttggcctttttggaaaaagtttacccacgcctggtttatatggtggtttatatccaatcatggtgggtatttttaggtaatcatgtaactttaggcagttcactttaacctttattttattcattattttattttattttgagacagagtcgcaccgtatacccaggctggtcttgaactcctgggctcaagcgatcctcctgcgttggcctcccaaagtgctgggattataggcatgagccaccatgcctggctgaattcttttaagtgtttgtctttttatttgtgaagtggagataataatccatgtcctgtccctctcctgcataaagttgttttgtcttaagaagcaggataatgcatgcataaatcttctaagctgcaattgctagacagataatacaaataattatgggaaccattattgagcatatgctatatgctagggcactctactaactacttgatgtgcattatctcatttaatctttttttttttttttttttttgagacggagtctcgctctgtctctcaggctggagtgcagtggcacgatcttggctcactgcaagctctgcctcctgggttcacgccattctcctgcctgaggctcccaagtagctgggactacaggcacccgccaccacgcctggctaattttttgtatttttagtagaggtggggtttcaccgtgttagccaggatggtctggatctcctgacctcgtgatctgcctgccttagcctcccaaagtgctgggattacaggtgtgagccaccgtgcccagccatctcatttaatttttacaaaaactcccttgaggagaacattattattttcccattttgactgagaattttgatgtttaaagggtatagttaacttgactaattttatatactaaagctgccattcaaccatttgaacaaatgtaatatgtaagcagagtccaccaaatgacttcacagttcgtgtttttcctagtagaaagcctcttggtatttaacacccaaatgtcctagaattcattatctctcaattcagtgtgttttggcagatcattataaaatacatatttacatttatgtcccagaaatacagccaaatactgcattttaaacaaaataatgtgtgagaagtctgtgttaaattccagatataattggtagactgtcagaatcacatgtcaacaatttgaaaggtgcaccaaatatcaacaaagaggatatgtagcatgttactacttgtagccactgttaaccttaggaatggtttttgctcaggaagtgatgttttcagcattttatatcctaacattggagtttgttacttttgtataggtgctttactgtgttttagttacactttaggaacttggttagttttttggggttgacatgaaatgaattgtaatttttttcatttaaaattgataaataggttttttgttagtatctcatgtggaatatgtgatattcagtgatggacgattcatgcaagaggtggaagagacctataatattattactacgttacttaatggtggagatatgttgtgagaaatgtgttattaggcaatttcattgtcacacagcatcatagaatgtacttacacaaacctagatggtatagcctgctgtatacctagactatatagtatggcctgttgcttctaggctacaaacctgtacagcatgtttctgaactgaatactgtaggcaattttagtacaatggtaaatatttttgtatctaaacatagaaaagatacagcaaacgtataaaagataaaaacggcacacctgtctagggtacttactatgaatggagtttgcaggactgatggttggtctgggtgagtcagtgattgagtcatgagtgaaagtgaaagcctaggatattattgtacactactgtagaatttataaagtctgcacacttaggctacactaaatttatttttaaaaagttttcttcaatagtaaattaatcttagcttactctagctttttaacattatgatctctgatgttttaaactttttgactctttttgataacacttagcttaaacataagtccattgtacagttgtacaaaaatattttcttttttatatccttattctataagcttttttctattttaaaattttattttttacttattaaacttttgtgttaaaaactacgacgtaaatatacacattagcctaggcctacacaaagtcaggaccaatagtactgtcttccacctccacatttcatcccactagaaggtcttcgggggaataacatgcatggagctgtcatccatgataacagtgctttcttttgggatacctcatgaagaaactgcctgaggctgttctagttaactttttaaaaatcgtagatgtacactctaacataacaataaaaactgtagtatagtaaatacatgaaccagtaagtcatttattttcattattaagtattatgtactgtgtataattgtacatgctatacttttatatgattggcagtgcagtaggtttgtttacaccaacatcaccatgaacacatgagtaatatgttgcagtgtgttaccacagctatgatctcactaggtgatcggaatttttcagcttcattataatcttaagggaccatcatgatatattccatacgtcattgacggaaatgtcatcatgttgcacctgactgtattatttttccctgttctatatggactattttctatgtgtgcctacctgatagcttctgttatccttagtagttttcctttttttaatgaggtaacacatggttttatattatcctcatagcatcaaagtgtgttgatttctaaaatcctttatcatcttcttctaagtgaaatctggaaggatcttccttcccctgcagctcatgcaggtaatggttgttttctgtctcacactcttacttctggacctggagttgcaatagatatctctcttactcttcattgctgctctcagagtgttcttcccagcctccgtcctaaaaactcctttgaagctcatggcagcagactatgctgtcacacctccttgttgctgtttctactcctgggcaccagcctttatttcttacacttggctcactgttatctctggcactacacttgccataattttagatgattgcagtatctatagatgagcctaacaatacttcagcctctcagtttcttgacctctcttccagtaagttttcctccatgctccttccagtctttgtttctttacttgctgtatttcttgtttgtctttggcatattaaacttctgagataaatttatacttctattggtcacaacagagtcatttttttagttttaaaaaatattattaaaaaataaaggccgggcgcggtggcccacgcctgtaatcccagcactttgggaagctgaggtgggtggatcacctgaggtcaggagttcaagaccagcctagccaacatggtgaaaccctgtctctactaaaaatacaaaaattagctggatgtggtggcatgcgcctgtaatcccagctgcttgggaggctgaggtgggagaattgcttgaacctgggaggtggaagttgcagtgagctgacatagcactattacactccagcctgggcaacagagtgagaccctgtctcaaaaaaaaaaaaaaataaaataaataaaatattatttcagaatgtcaggcaatttgtcagaacaagtagtgtatcacagaagtagtttaaaagcctgtacttaaaggaagtctttataaggaaggcttaggagctctaaatccacatagccctaagcactgaatttcttagtaggaagttaaattgacatgaaactagaacagaaatggaaagttgcaggactgtgtactttgcaagaagatgtggatgaactctgagcaaacagctctgtgttctgctctgctagaaattatatgtgagtgggttaagggagaaaggaaattgtagacaagtagtgtgatgacgtgtagtagaaagggagcggaatttgaaattggtagacttggattctgttcttggttcagccactggctaactatgtgacctttattaagctgtttgacctctctgaacctcattgcttttatctgtaaaataggattaatatatctaacatgaaggatttttctgataattagtacaaaaatacagttagatagaagaataaagatctagtgcttggtaacacaataaggtgactatagttaacaatatattttgtatatttcaaaaagctagaagagtagatttggaatgtttccaacacaaaggtcattacccattgtatgcttatataaaaaccacatgtcccctataaatatatatgactattatatatccataaaaattaaaaattaaaaaaagtttaaaagaagaaaactaaattgtgcacatacgtgtgtgtgtgtgtgtgtgtgtgcctgtgtccacttagactggcacgtagattcagctcaataactctctactagttgaatctctttttggttttttggttttgtttctgttttttttttttttttttttttttaagacaagatctcgctctgtcacccagcctggagtgcaatgtggctcaatcatggctcgctgcagcctcaacctcctgggctcaatggatcctcccacctcagcctcccaagtagctgggaccacaggcatgcaccaccacgcctgcctattttttgtagagacagggttttaccatgttgcccaggttggtcttcaactcctgggctcaagtgatccatctgccttggcctcccaaagttctgggattgcaggcaggagccaccatgcctgacctgttttttttttttttttttttgtgtgtgtgtgtgtgtgtgtgtgtgtgtgtgtgtgtgtgcttgtttgtttgttttaactgaggaatagaattagtgttataccaaaaaggaggattaaatcaaccacccttgagtatgagtagattttggggtatttgttttttgttggtatgctagggaagaagttgttcattataaacagaagaaattctcttattgtcttcaatttttatttaaaaacctattatacaggccaggcgcgatggctcatgcctgtaatcccagcactttgggaggccgaggtgggtggatcatgaggtcaggagttcgagaccagcctgaccaacatggtgaaaccccatctctactaaaaatacaaaaattagccgggcatgctggcgggtgcctgtaatcccagctacacaggaggctgagacaggagaatcgcttgaaccggggaggcggaggttgcagtgtgccgagatcatgccattgcactccagcctgggccacagagcaagactctgtctcaaaaaaaaaaaaaaaatcctattataccttttaaaattgaatgctatatattttagaataataatagcttaaactgaatacttgctaggcattatcctaagccctttgcagttattaatttatgtaattttcatagcaaccatataatgtagacactattattattattctcatttgtacaggaaaaaaaatgcaagttaggtaatttgcctaatttgctgcataactgccagtaagtaaaagagttggaattaaaacatttgcagtctggatctagagtatatactcctatccactatgctggtacagcctttctcaaaatctcagatattgagcaaagagagtgagtattgtaagaaattcaatgctgtggtgcagacttcttgatattttctaaaaatttcttctagttgtcttttggtaatcagacactgaccctggtgtgatgtagctcatgttatgtaaataataactcttctttgtaaggactaatcctagttttggcgtagtagaaattagagcatgaaaggaccagccctttgatgaacaaataccaattgcaatatctgttatattgcccttcctttttattaggcactttggaatattgcttttgctcttgtcaagaaatttataatctaatctgtgcaaaactatgaaacacatacaatacaaaatagtttatgaatatctgcttaatttgtaagtatagtagttcagagtagaaaaagaacaggagtaagtaaattaaagtgtaataggaaaggctttccataggaggtggaggtcttacaggttatgatttagagtggcagagagatgagaagacctatcaggagaaaaaaaaaaacatgaaaattccagtgaatttcctgattatacaatgacataagaaatctgatatcctaacaccaaattctcttctgttgtgacctctctgttctcttttaaaaaatgagagtagaaaagtggattcaattctatcctgattccctcatatattgaaagtctatggaactaacaattggcttttaaaaaattcatttccctattctttatgcccatatatttcagtgggagtcaccccagtgagggtagattttggctgcaggagccagatgtgggttgagcaatgtctttgtgtgcaaacacaaagttctttatgtactgacggatgtccaccccctcacatcaccattggtgttccaacctgtttaattggaaggagttggtgtacagtatctgaacttttcagttttgcttttgaaacacatttcaaatgtttttcctgatttatattttgacatgtgcttaataaatgaatagagaaatcaggtagcattttatctcaaaaagcagtatgcttagtgaatgcgtgaatctcagtatagttcttaaaatgttatcagggatgcctttatatgtagacaattgcacattgatttgaggcttttttgccactacaacctccgcctcccgtgttcaagcaattctctgcctcagcctcccaagtagctgggattacgggcacccgccaccacgcccggctaatatttttttgtatttttagtagagacgggatttcaccatcttggccaggctggtcttgaactcctgaccttgtgatccacccgactcagcctcccaaagtgctggaattacaggtgtgagccaccgtgcctggcctgatttgagactttttaatgtattcacggtaggttagagtacaaggtgcatcattttagactgtcttagataaagaaattctgtattggataatatccttttccataaaatctgtcgttgctgctacacagtaagtcctcctcatcatcgtaggttcttggaaactgcgactttaagcaaaacaaggtacaacaaaaccaattttaccgtaggctaatggatataaacaagagttcaagttcatatgcatatttctggtcatagaaacatcaccaaactatcaaaaaaagaccaaaaacacttctaataataaacattgaaataaatgtgaactatacatatatgtaagaaaaattaataacaagtaagaaaattatttacctagttattccagtttagggtcatgggtggttggagcctgtcccagcagctcaaggtgcaaggcagaaccaaccctggacaggacaccattccatcatagggtgcattcacacaccccgccacactcaatcatcctgggatgatctcaacttgccagttagcctgacatgcacatcttttggatgtgagaggaaaccagagtacccagagaaaacctagaccgacatggggagaacatgcaaactccacacagatagtagcttccactgggaatcatttgtcttcaacaatgttgtactgaaactacattatttgaggactagctctacagtgtatcttaaaatttacagtcagctttccttatctgtgagttccacatctgcagattcaagcaatgcaggttgaaaatattttttaaaaaccaattaaaaataacagtacaacaataaaaaatgaaaatttaagaaaacagtataaaacaacaattatttacatagcatttacattgtattaggtattataagtaaccttaaagtatctgggaggacgtgcatatgcaaatactgtgccattttatggaaaggacttgagcatctgaagacttcggtatggtgggaaggtcctggagccaagccccatcccatgctcagggacaactgtatttactattttgcattttaattgtgggaatgtgcctcaggttaaaaggcaaacttatgaagtaaactgatgccaaaataaatttcaaatggaaagatgacaaaacacctcggaggcttacattcatatagggctctgaaggtcatctcttgtgtaatactggacagtaacagctgcttttgcaaactcttatttactactttgcctatacttctggaagattgagaaaaaggttatttgatcactagaaacaattaacaatttagaaaaactttgtcatttcattcatgttttatttttaaaaagacattgcatttgccaaccatatgtcaaaagatattacctctattctcaaggaacttactggctagtggacttgcaaagatagacttgcaaacattcggggagatcttaagagaggcagttgcatttggattgatattgaagagtgagtagaaatttgtataaagaaaaagacgtcttcactgattgcaagtggttcactatttcttgaagacaaagtttggtagtagtggggaagaagggttgaaaggaagtaggcaatgacaggatgacatttttgtctatttgtctactgttatatttctgacacctagaacagtgattggcacatactagatattcagtaaatacttgatgaatgaacagaatgaatgaatgaagaataaacggggccaaaccatgaaggccctgatgtgccttgtaaatacgtttatccattgaagaatatttaacaagaggtgacatcagacttgttttttggaaaaattagtctgccagaagtctggtggttagaaagagtgggctcaggcaaggaaaccagattgagaaagctgttgtaacaatctaagcaagagaacttaaaggcctgacttaagatattaatattggcattgacaatagtgctggaaatgagagaatttaagagatatttggaagataaaatatacagtactaaatggttgcttgtctatggagagagagagaaagagaaagagaaagagagatgactcccatgtttctggcttgagcacataagtgaagagctattctattattaataactaattaaagagtacagatagataagcaagttggagggacatgatgatgttaggtttcaaaaatgttgattttgaagtgactatgggatattcaggtagagatgtctggcagacacttgaaagtaagcatttgtatattcgttgtgtgtcaaactcaaaatctaatctagcatattcttatgctattttgtaggaaagcagaacaatacttcacttttttttattttaagataactttactctgtaccccaattattcctgcaattataccaatctctagtttaaattgcctttatggtacacttgaatatttttttccgtgaaagtagactttttaaaggtagccatcttgatcaaaagtaggtaactgcttttagcctttatcttattgtgattcatttgattcaataaatgcttgtataggaccaaatggtttatttcttagaagatatcaagtatgttaagttcatggaaaaacaaattaaagtttgcatgttaataaatggtcagagaggagcttgttcagaaaaaggcactgagtgcattgggatttaagtgtaaataatgcgtatctaatacattctggaaagctctatgtttttttcagtggatttttgtcttaaagtttccattcaatacagggcataatctgccctcctagtctaatcattaactagatatcagctgtagtcaaatgaatgaaaaaaaaaaaaacttttttccaggtctcggtgacctttgtgaacattaacatgtcacagtgtgttgatattgccgttgattaaacatgttaccgtccctaaaccatgttgcagactcctctacttatttcattttattaagttagttttaggccagtttataattttttaaagaaatatcttaaaattttgttatttatagtattagatcatttatttcatttttgtgagaagctcccctctaaatctgtagttgaatatatgctaatagtataaataattaagtttctataaatgcagtatttggtattatggtttctgttgaataaaataaataccttatactaaataccgcatttatctgcaggtaatttaataagccttgtgagagataaaagataaataagataatgggtctcattcaaaaggagcttctagtctaataaggacactattaaatatgtgtaaatagttacaatacaaagtaaaaattgacccacatcacaaaatacagtataaagataaaatgttaagaggattaagaagctgggagacatcacttatagctggaaaactcagagctgaattcattgaggaggtagcttttgatcccagctttgaaggaaggaaaggatttagacatacagaagtgaaaaaagatgagaaaggactttacagacagcaaacagcaagattaacatctcagagatgggcttactgaagatgtcaagtggaagaggagtggggacaggagatgagtctggtaagtcctgttggggtcaggtcacagggagcctttagggccagacggatgatttgggttttattcacaaagcaatttttaagcaggagaaagatcaacactggattgtagcagtaggagaatgagtagatgtaagtagggagagattggaggcagagtaaaaactaacaagggccaaaattagggtaatattagtgagaatggggagaatatttaaaatatggagagtagtcagaagagtcagaagggtgatacgccatgacagccatgtttctgtgcataattctgtggaaattttgtaatttttgcattaatacatacaaatctaaaggtagtttgtatttctaagttgaacttatggaaatgcttaggcacaaagttccttctcaggcccacaccctctccctgtgcttaccattcttcctttgttgcaggctgcaggaattgaatctgctttcctatgctccagcaattgctaccacccactgtatcccatgggatttttattcctgcattagccttgctgctgagtgtcaagcagtgtccccatatccacattctttctgcattactgaaaagaaatccaaaggccctttaccttttaagagtttttaaaactgttaatctttataaggaggcctttgagggtagcaaacaatagatattggaaagttgaaagcttatataattgacaaactttacttcttttatttttccaattaattgctctggccctcatatgcctaaatagcataaagtcaagtactctctcctcttgatgcaacacattatcaacaggtaactaattgtcctataactctaggggtcagtcctcctgtgatgctaggtataaaaggaatgtgattctgatcagttcactaatcctactgtttctcactgctacctggaattgttggggtgaagcctggtccctgaacaacctaatggatggatgatgcttgctcacaactgtgatgatgctttaactggtccagatccttgcagaggcagcagtgattctttaagggaggatgaacccaatcccttaatgccacattctttcaaggatgctctaaattaggtctcctaggttctagatcttaacaatcagctccttcagtttatatatgcagccacatctcattgtgtaagccggtcccaagagtactttttgaggacattttgtagaatcttttcactaacaaacctcaaactttcttccctccccagggcttaagcgcctttctttagtcactcaaaatataaagagtcttgttaaacccttatctcaggacagtagggcctgttcatgctatacttatgtaactaaaggaaacccaacttaaatgatttttcacagtcaggaggatctgcttcagggttattttcctacctctacccaaatggcaaagcaattgcacacttctcttgctaaagaagaaaggaactacaaatttaatctttataaacatctctcttatagggcattttactatacttaatgtgttttaaaaccttacgaacatgtagtgttttcctgtctgtagtttgacttccttctgagacaaaaataccacacaacttgacaaatgcttctgacattattactaccactatcaactccagaatgaacagcactaacatttaccgactgtttactatgtgccagggtaagtgctttatatttactgtcttgtaaggataaaataacagttaattgaaggtgatatattctattttacagatgaagaaactgaggcttaatttgccccaaaacagacaactaataagtggcagaaactggctcaaattaatatctgtctgactatcctgccttcagtgggtcctagtgtttgttaattggttggccgaaccactgcttattttcagtaagcctgatagccatcctttaagtttagctatcatacaaacagattcctagcattaaaaattatcctctgtgtgatcaaggtaacatcactagcaatatgtcatgaatattatgtatccctaatgtgatgagatgagaaagatacattacatttgtgatagtcttcctcaaaattcataacctcattctaattgtgacaagagatcagacaaacccaaattgagggaaatttcacaaaatacttgtcaagttcccttaaaagcttcaaggtcataagagacaagaaaagactgagaaactgtcagattggaagaggctgcggagacatgacgagtaaatgcgagacaatatcctagattggattctggaaccgaaaaaatggatactggtagaaaaattagggaaatctgagtagttaatagtattgtgccattgttaatttctcctttttgataaatatgtcctgattacatacgaagttaaacaggccgagcctcatggtgcctcacacctcttatcccagcactttgggaggccaaggcaggaggatcgcttgagcccatgagtttgagactagcctgggcaacataaggagaccccatctctacaacagattacacaattagtcaagcatgcttgtagtcccagctacttggtggtgcatgcatgtagtcccagctacttgggaggctgaagtaggaggatcgcgtgagcccaggaggtcaaggctatagtgagccatgatggcaccagtctgggcaacagagctagatcctgtctcaaaaaaaaaaagaaaaaaaaaagaaacattagtggaagctggatgaatggtagattagaacttcctgtactatctttgcaactcctctttaaatctaatattatttcaaaatagaaagttaataaaattgttatttgaagcagtcattcaagggagtatagacagtattatttatttgagggcaaagttggtccttatggtaattcttagccttaagtacagaagagaaattaggataaggaaataaacttactttgttgacctgccattttagatgtatgacattgtggttagaatgtacaatcaaattcatagcctattttaatgttcttttttctctgcagtttaaaatgaatagcttctaagactcatgttagtagacttaggctaaaatagaaggcctcttgttcccacagagaaggctttgtcttcctctctattccctgaaagaaaattaaatcagcatgactttttccatctcagattttttttttttcatagcaagaaatatgtttcctagaggatggagataaatatgggactgttcagctttttttcctccctggatgtgatttcttctcaaaatacctaaatttgtcaatcctagagggagacttggacttgaagtttctttagattttccataaaaagggacacaaatgcttcagccatgattattttgacatagtatataggactagtttaaaaattataaattccattattatggctttgtgtagattaaatgaatattctggtgtgatatattttgtgtgtttcaacaatttggggttttcaatttagtttttcagtttggggttttctacatacactacagaaggaacataggcatgtttctcacattgccaaaagcagtaatgcaagtatggcttatattgtcaataacaaaatctcttccttctcttttgccagtttccaacacatataccatgaccattactttaattaagttttacttttgctggccttgaattgattttcaaagggttctgcaattgaatagaatgtccattaaaacagatattgtggatatttgaaggaaacatttttacagagaaatatattagctttcttgactaacatgttcaccgaaagaagctgcataatccaggagaggcagcaggaggaacagaaggaaattaacattcattgaacactttaaacctccattcttgatgttttacacataaaacctctctgacttctcagacaactcatccattttgttcttagcagctaaattacttagcgacatggcataactaataaatggcagaacttagatttgagcccagatctgtccggctccaagtctcttcccactgtaccctgaaatagaataggcaaaattagatatggcagtgtgagcatctcaatgtaagtgcaaggctagctgtgggtgagtatgactcatcagtttaggtactggcctatggaaatataaatctagaaatcagacctgggctacaatgaaaataaatactgaacagaaggcaacaataaaaattgttaagagtatacatacagaatcattggaaaggaaaaggcaggaattagggcattagaaatatttaaagctaggtctgtggtttgggtgtcagaacatctgacttgcttgggtttaagttaaaaggcaggcatttgatatgtgagaagtctgaaagcaagtgtcatggacctagtcattgtggtggaaagtggagaggcagggccactgagaccaggagccaggcattgagaaactagggacaatagttgtaattaatcattaggaatataggggactgaggacaaaggaaccagtagcaaatgggacttgacagaccgctgaggttgattgccttaagtaccctcttcttaggttagaattgataccaaattcagggttcatcactatgcctggaagtggaaagtaagtagctttaccagtcagggatagggatataaaaaatagagtgaaataagtacagttaatttagtagagtagttctctaattatggtccccagaccagcaatatcagtttaacctggaaattgcttagaaatgcaaattcctaggcccaacaccagacctattgaataaaaaagtctgggatagggcccaagaatcagcatgctaaagtttcagaaccactgatctatgttggtggctctgagtgtgttgtcctcaaaacctaaggtcaacttatgcagatgcaaactagaactaagaaagaagggttttttttgaggcatttcaacctctattctttgtttttatgagaattgtataagctaaagaggccctattcagtagggtcatgatggaatattggggttgagcaaaatggatttttctttgagggctaggactttttctttctatctgctcttctttatcttactttaatgaacaaacctgagggatcactgtcttacaaggttgattggcctatcatgggctagtcattgaatgtctcattttgctcacctagaatgaatattctatttccaagattctaagaggtttatttaagtgtgacataaagtgtcaagattaagtgcatgctattcacaatagcaaagacatggaattaatcctgatgtccataaattgtagaatggataaagaaaatgtggtacatatacaccatggaatactatgcagctgtaaaaaagaacaaaatcatatctgttgcagcaacatggatacagatggaggccattatcctcggcaagttaatgcaggaacagaaaaccaaataccacatgttctcacttataagtgggatctaaacattgagtacacatggacataaagatgggaacagtagacactggggactactagaagggggagggtgggcggggggtaaagggttgaaaaactacctattgggtactacctgggtgatgggatcattcatacaccagacctcagcaacacagtttactcatgtaaccaacctgcatatgtagcccctgaaaaaagtcgataaaagtctaaagaagaataataaaattttaaaaaagattaagtacatggaaaatattaaatggactgaaatgaaaataaatattgcgcttagaagtcatcaagagttaatgaagaaagcacacatagactttggagccagattatgcaatcattaaacaaagtttgcatgcctatcacatgccaggcactgtgctaggcactgggaatatagcagaggaaaaaacacataaaacccccctgattccacagaactgacattctagatgggaagagagataataaacaagaaaataaaatttatggtatattaaatagtaagaaatattacaatttcagatagtgtggctaggcaagatatgttgagaatatgacattagaataaggaacaaaaagaagtaatagagcatgccatgcggatcccctgtggaaaagtattgccaatagagagaacagcaagtagagtccctgatgcaggaagatgcctgatgtatttgagcaacagcaaagtcattgtggctgaagtggtataaattgggaacaggagttagggggtagtatgtaaagcaaaatatatacacagatatccagaataccattcttttgatttatctatattttccaaagtttttatacagaaacattggagagaggtaaagctatagtaatctagacagggtggtattggttcaggataaacaaatagataaaaaagaaagcccagaagtaaatcatatgtataaagacatttgatatatggcagaggaggtactaaagcttaggggcataaagggtggatttatcaatgaatcgtactagagttttggctatctattaggaagaaaatgagtttgaacctttcacttatatgttatgcaaaaataaatttcaggtagatcaaagacctaaatgtgaaagacaaaatgtaaaatgatattggggtagagagggatttcttcaacaataatactaaaataatagcaacacttaggtagtttttactctgagtcaggcactgttctatatatgtgcttaccacatattaactaagttaatcttaacaaacctgtgagataggtcctctgttagacaaatgaggagctgaggcataaagagattaagtaatttatttaaggtcatatgactagtggccaggattttaatctaggtattctagctccagagttcctatctttttttttttttttttttttttttaaagacggagtctcactctgtcacccaggctggagtgcagtggcacaatctcggctcattgcaacctctgcctcccggattcaagtgattctcctacctcagcctcccgagtactgggattacaagcgcatgccgccatgcccggctcattttggtatttttagtggagacagggtctcaccatgttggccaagctagtctcaaactcctgacctcaaattatccacccacctcggcctcccagagtgctgggattacaggcatgagcaccgtgccctgcccagggttcctactcttaactatttcactaaaatactctccaaaatataaaaaacatatgggaaatatttatacattcaactggattaaaagtgaaaacttctgtttgtcaagagactttataaatgaaatgaaaagacaagccacaaactgagagaagataattacagcatatgaaactgacagatgattacttttacagaagtatataaagaatttttacaagtcaatgtcaaaaatacttggacaagctgggcatggtggtgcacacctaagcccaagctactcaggatactgaggcagaaggcttgctcgagcccaggagttcgaggctgcagagagctatgattgtgccactgtattccagcttgggagacacagtgagaccccatctctaaaaacaaacaaaaaatacttgggcagattcctcataaaagaggaaactcaaatggccagtaagggtgaaaagatgttccatctcattactaatcagaagaatgcaatttaaaaccatgttgtgatgctacttcaaggtgccagattggcaaaaatgtaaaagctgatagcgtcaagtattggcgagaatatagaacagtgagaccattattccgttgctgatgggagtataaattgttaccaccctgttggaaaataggcattgcccagtaaaattgatcatgcccaaatattgcctactgactactctaccccctatagggttcaaacctcaaagacttagaacttgggtataaaggacttaggcttcaaccctgtcagtaatgtttcaatttaagcaggtttttgtttgctgatctggaaactaagccaccatttatgcaatcgtttctctgagaaaatgagttctaaattataggcactacaagttaatttttggaatacagcaaatacaaaaattaggtattaataattactttttcagctgggtgtggtggcccatgcctgtgatcctagcactttgggaggccaatgtgggagaatcacttgaagccgggagttaaagaccaacgtgggtaacatagtgagaccctgtttctacaaaatcaaaacattagccacgtgtggcagcgtgcacctatagtcctagcaactcagaggggctgaggcaggatgattatttgagctcagtaggtcaaggctgcagtgagctgtgatcgcatcactgcacttcagtctgggtgacagtgagaccctgtctcaaaaaaagaaaaaggttaaaaaaaaatttaccctttcactaaacatctcttttacaatggttacaaaagaatacaaatattaacatatttgagaagcaacttcttggcaagatacctagaccctatattttgtctctacattttcttttttcaaaatgacttatgaagtgcagaaactatcaaataatgtagtacttttttttttttttttttttttttttttgagacagagtcttgccctgttgccctggctggagtgcaatggtgcgatctcggctcactgcaacttctgcctcccgggttcaagcaattctctgcctcagcctcctgagtagctgggattacaggcacccaccaccatgcccagctaatttttgtatttttagtagagatggggtaacaccatcttggccaagctggtcttgaactcctgacctcataatctacccacctcggcctcccaaagtgccgagattacaggcatgagccaccacgcccggcctggagcaccattttttttttttttaaagcagaatacatactttattctttaaaatttcttctctctttttttttaaactttttttagtatttattgatcattcttgggtgtttctcgagagggggaatttggcagggtcataggacgatagtggagagaaggtcagcagataaacatgtgaacaaaggtctctggttttcctaggcagaggaccctgcggccttccacagtgtttgtgtccctgggtacttgacattagggagtggtgatgactcttaacgagcatgctgccttcaagcatctgtttaacaaagcacatcttgcaccacccttaatccatttaaccctgagttgacacagcacatgtttcagagagcatggggttgggggtaaggttatagattaacagcatcccaaggcagaatttttcttagtacagaaatggagtctcctatgtctacttctttctacacagacacaataacaatctgatctctcttttccccacatttcacccttttctattggacaaaacccccatggtcatcatggcccattctcaatgagctgttgggtacacctcccagacggggtggcggccgggcagaggggctcctcacttcccagacgtggcggccgggcagaggggcccccccaccccccagacggggcggctgccgggcgggggcgcccccccacctcccagacggggcggctgccgggcggacgggctcctcacttctcagatggggcggccgggcggaggcgctcctcagttcccagacggggtcgcggctgggcagaggtgtggagcaccatttttatgcttgtattttttctgttttaaaaaaaacagtgaaggaagtgaaaaatcactgtcctagttgaattaagttaactgttgcaagttgtggctctggaaatgtgtcacatttgatttttatgcctttaagttttacttctgagtttttaaatttttgaattttattttgataagatcagttatcacaaaatatttttgcacttaagcagtactctttttgagtattatgaatttctggccaccactgtcacaaatgtgtacagcctatgccactgagatgcttacagttattgctgacattgaataaagatgaagaatcttcatgaagactataccactgcacccaattggaaacagagtcaccaccaccttttcaaccagcaaactaaaacccaactgcagatgaaagtccttatctatggaagccactctagaaagttaggaagaggtaggctggacgcggtggctcaagcctgtaatcccagcactttgggaggccaagatgggtggattacttgaggtcaggagttcaagaccagcctggccaatatgacgaaatcccatctctacaaaaataccaaaaaaattagccaggtgtggtgacatacacgtgttaattccagcttctcatgaagctgaggcaagagaatcgcttgaacttgggagacagaggttgcagtgagccaagatcatgccactgtactccagcacaggtgacagatggagacttcatctcaaaaaaaaggaagagatgattgttccaccaggtgcacagacatcaacacagggacaccagaaatatgaaagagcatggaaataggttgccaccaaaggaacgtcactttctagtggcagacctgcatgaaaaggaaatcaactaattgccagaaaaggaattcaaaattatgattttttaagaaattgaatgatatacaaggaaatacagatagttcagtcaatcagaaaaggatttatgatgtgaatgacaaattcaacagagatagaaatcataaaaaaaagaaccaaccagaaatcctgcaactgaagaattcagtgaattaaattaaaaaatacaacagagagattcaacaaaagaaagaatccagcaaaagaatccctgaacttgaagataggtcattcgaaattacctagtcagaggaaaaaaaaaagagagagaaatatgaatgaaaaagagtaaagaaagcttacaagacttatgggacaccattaagtgaacaagtatttgtattgtgagagttctagggaagggaaaaggcatagaaaacctatttaatgaaataatagctaaaaaattcccaagcgtgtggagaaatttggaaatccagtttcaggaagctcagtggtccccaaatagatttcacacaaaaagatcccatccaaggtacttaatagtcagattattcaaagtcatatacaaagagagaattctaaacacaacaagagaaaagtgtcaagtcatgtataagggagtcttcattaacctaacagcagatttctctgcagaaatcttacaggccaggaaagaatgggttgatatattcaagttgctaaaaggaaaaaaaaagtgaaccaagaatactatacccagaaaagctatccttcagaaataagggaggaataaagtctttcccagataagcaaaaactgagggaattcatcaccactagaacagccttacatgaaatgctcaagggagtcctacatctgtaagtgaaaggacaataatcactattatgaaaaaacacaaaagtgtaacattcactgttagaaaagatggacaaaggagaaagagaagagaatcaaaccttatcacttcaaaaaaaccaccaaacatcaatgataaacaataaaggcagaacaaaggaaataaggatatacaaagcaaccagaaaacaattaacaaaatgtcagcagtaagtccttacctatcagtaataaccttgagtataaacagattaaatcccccacttaaaagatatggactggctgaatggataaaaagatatggcctaactatatgctgcctacaagaaattgtcttcacttgtaaagacatacacagactgaaagtaaagttatggaaaaagatattcctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaagatattccacacatatggaaaccaaaagtgagcagaaatagctatgcctaagtcagataaaacaaactttaagtcaaaaactgtaaaaagagacaaaaaaggtcattatatagtgataaaggaattaatttagcaaaaggatataataattgtaaatatatatgcacccaacactggagcacccacatatgcacatattattagatctaaagtgagagttagactccaatacaataatagttgcagatttcaacacccaatatctaacgtctcaacattggacatatcatctagacagaaaatcaacaaggaaacatttgatttaaactgcacttgagaccaaatggacctaacagacgttgacagaacatttaatccaaaagctacaaaatgtacatcctttcttttcaatagcacatagaacattctccaggatagaccacatgttagactacaacacaagtcttaacaaatttaaaagaattaatattatatcaggtatcttttctgactgtaatggaatcaaactagaaatcaacaattagaggaactttggaaagctatacaaatacacaaaaattaatatactcctgaatgaccactggatcaatgaggaaattttaaaatttcttggagcaaatgaaaatagaaacgcaacatcccataccatgctatgggatagagcaaacacagtatcaaaaggaaactttatagcaataaacacttgtattaaaaaactagcaaaatttcaaataaacaacctaatgatccagcttaaggaactagaaaagccagaaaaaacaaaactcaaaattagcagaaggaaagacataataaagattagggcaaaaattttaaaattgagactaaaaagcaatacaagaaatcagctaaataaaaagttggctttgaaaagataaacaaaattgagaaaccatcagctagactaaccaagaaaaaaagagaaaaaacctaaagaaataaaatcagaaatgaaaaagaggacattacaactgatgccacagaaatacaaaggatcattagaggctattacaaacaactgtatgccaagaaatctgaaaacctagtgaaaatggataaattctgcttgtatggaaacatgcaagctaccaagactgaatcaggaagaaatggaaaacctggacagcccagtaacaggtaatgagattgaatcagcaataaaaagcctcccaataaagaaaagcccactggttgcattcatagccaaattctaccaaacatatgaagaagaactaatactaatcctcctgaaactattccaaaaaatcaaagagaagggaattctccctaactcattctgtaaggctagcatcaccctgataccaaaaccagacaaggacacaacacaaaaaagaaaactacaggcccatatccctgaataacataggctcataaatccccaacagaatacttgcaaaccaaatccaacaacacattaaaaagaaaatacaccatgatcaagtgggatttatactagggatgcaagggtggttcaacacatgcaaatcaataaacgtgatacatcaatcaacagaatgaaggacagtaaccacatgatcatctcagtggatgcagaaaaagcatttgataaaattcaacattccttcgtgataaaaacactcaaaaaatagacagaagaaacgtacctcagaataataaaggccaatatgacaaaccaacagccagcatcatacagagtggggaaaaggtgaatgcctttcccctaagaactggaaaaagacaaggatgcccactttcaccactcctattcaacataataccagaagtgctagccagagcaattaggcaagagaaagaaataaagggcatccaaattggaaaggaggaaatcaaattgtctgtttgcagatgacatgatcttttatatagaaaaccctaaaagctccaccaaaaagctcttagaactgataaatgaattcagtaaagttggaggacacaaaatcaacataaaaaatcagtgctgtttttacacagcaacagtgaaatagtggaaaaagaaatttaaaaaaccaatcctatttaaaatagctccaaaaaaaaaaaaaaacacttaggaataaatttatccaagaatatgaaagatttctacaaggaaaactataaaacactgatgaaaggaaattgattaggacatttaaaaaattaaaagatattctatgtttatgggttgaaagaattcatattgtggtctgggttcttgggaggccgaggtgggtggatcaccaggtaaagagatcaagaccatcttggccaatatggtgaaacctgtctctactaaaaatacaaaaattagctgggcgtggtagcatgcacctatagtcccagctattcaggaggctgaggcaggcaaatcacttgaacctgggaggtggaggttgcagtgagctgagatcgcatcactgcactccagcctggcgacagagtgagactccatctcaaaaaaagaggaggaggagaaggagaaggagaaggtgaggaaggagaaggagaagaagaattaatattgtgaaaataaccatactaccaaaagtgatctacagatttaatgctatccctatcaaaatatctatggcattcttcacagaaatagaaaatacagggccgggcacagtggcttatacctgtaatgccagcactttgggaggctgagactggcagatcacttaaggtcaggagttcaagaccagcctggccaacatggcaaaaccccatttctactaaaaatacaaaaattacccaggcatggtggtgcacacctgtaatcccagctactcaggaggctgaggcaggagaattgcttgaacctgggaggtggaggttgcagtgagttgagattgcaccactgcactccagcccgggtgacagggcaagactccatctcagaaaaaaaaaaaaatgcaatcaaattcatatggaaccacaggggacctcaaatactcaaattctgagcaaaaagaacaaagctggaggcaacacactgctggacttcaaaatatactacaaaactttagtaaccaaaacaacatggtactggcataaaaacagacacatagactaatggaatggaataaagaatttagaaatgaatccacatacttacagccacttgattctcagaggtgccaaaaacattcattgagaatgggacagtctcttcaataagtggtgctggggaaactggatatccatatgcagaaaaatgaaactagacctttatctctcaccatatacaaaaatcgtttccaaattgactaaagaactaaatgcaagactgaaaactatgaaactactggcagaaaacatagaagaaatgtttcagggcagtgctctgggcagagattttgtgaagacctcatcagcacagacaataaaagcaaaaatagacaaatgggatcggatccagttaaaaaacgtttgcacagcaaaggcagcaatcaacagagtgaaaagacaatatgcagaatgggagaagatatttgcaaactattcatctgaaagagactaatatccagatatcttcaaacacctcaacaaccagtaaacaaataattttaaaaatgggcaaaggagctgaattaacatttctcaaacaaaaacatacaaatgaaaagtactcaacatcactaatcatcagagaagtacaaatcaaaactacaatgagatgtcatctcacccccattagaatgtctgttatcaaaaaggcaaagaatacatgctggcaaagatgcagagaaaaggggactcttatacactgttctagtggaaatgtaaattagcacagccattatgaaaaacagtatggaagttcctcagaaaactaaaaatagaactatcatatgatccaacaatccctctactgggtgtatatctataggaaaggaagttagtatgccaaagagatatttgcatgcccatgtttattgcagcacttcacaatagccaagatacagaatcaacctctgtgtccatcaccagaagagtggctaaagaaaatgtgtgcaatggaacactagttagccataaaaaagaatgaaattctatcattcatggcacaatggatgaacttgaagaacattatcttaagtgaagtcagacagatgcagaaatactgcatgttcctacttatgtgggaactaaaaatgttgatctcatagaagtagaaagtagaatagtggttattaaaggtagaaaaggtgggaggggaagatagccaaaggttggttaacagatatgaaagtatacatataggctttgtattgacataccacactgtaccccataaatatgtacaattgttatttgtcagttaaaaataatagcaaaaaaggctactcagcaatgggcggatggtcaaggtatactgaactgtaccattaaagagtgaaaatagccatagacaatacgtaaattaatgactgtgttccaataaaacttttcttttttttttttttgagacggagtctcactctgttgcccaggctggagtgcagtgatgcgatctcagctcactgcaacctccacctgccaggttcaagcaattcgcctgcctcagcctcctgagtagctgggactacaggtgcgtgccaccacgcctagctaatttttgtatttttagtagagacgggtttcaccatattgtccaggatggtcttgaactcctgacctcaggtggtccatcctccttggcctcccaaagtgctgggattacagatgtgagccactgcacccagccaaaaatttttttggggactgtctcactctgtcacccaggctggagtgcagtggcacaatcttgcctcactgcaacaacctccgcctcccagattcaagcaagtctcatgcctcagcctcccgagtagctggaattacagccgtgtgccaccatgccattaatttttgtatttttagtagagacgatgttttgccatgttagccaggctggtctcgaactcctggcttcaagtgatctgccttccttggcctgtcaaagtgctgggattacaggcatgagccactgcacctagcctgtgttccaataaaagtttatttaaaatgtgtctcaggcaggatttggctctgttgttcagattaatcatcatgactgggccaggcacagtgactcacacctgtaatcccagcactttgggagaacaaggctgaaggattgcttgagcccaggagtttgagaccagcctggacaatataatgtgaacctgtctctacaaaaaataaatttcaaaaagttatccaggcatggtggcacatgcctgtagttccacactcaagagattgaggtgggaggatatcttgagccagggaggttgaggctgcagtgagctgtgatcgcaccactgcactccagcctgggcaacacagtgagaccctgtatcaaaaaacaaaaaacaaaacaaagtcatcatgactggagtgttgtactcatgagaaaagttttcagaggctatgagattgtatcattgagaggtggttattgtttcaagacaattctctaaagatctcttgtgcttttgcaagcagaggcactgccttgttctggactatttattcaaggatatttgcatagcaaactgccttggaaaatagagctaatatcttcctctggagtaaagaacagatttgccactgtccaatataataaaaataaagtctccctcctgggcaaagatcaggtaagctcactgtccattataaaagatttggattctctgagtttggggttcttcttctgtaacaacccacctcatatgcaggcatcactggccctcgttgcatgaccgttgggaattgaggtttggggacatggtgtaaatgctgatactctactctagctactgcttttgtttggaggaataaactgtcctctgtctctgaaaaaaaaaaaaaaaaaaaaaaaaaaacaacgacaagaatttctgtctgaatatggatttcctctaaacatattttagactatttgccctcaaaaatacaaggaatgtttagcataatagcccaatgttttcaacaataaagctatcctttttttcctccagaagcctcgcttattgcataatgatcttttccataactgtggaaagacagaggaacactaaattcagataatcttttgccagaaagtccaattattaagtttcttttaacaagaggagaaactattattttcttacctctacaaaatcatgacccagacatgaaattaagaatttttaataacgttttattttatttttccatataaaacctttttgtagttggaaaaactttttctagctaccttttaaagttcgattttaatatattgagcgagtttataatcagcagtttggtattactgatttcagacttttaattactagtttcagtctcttcccaaagtaaattgttttttagttatttaaaaatagcttaaaatgttatttttaagttcatttttaaaagtggaggaagaagaaaattgatacatttcattatctcttaattgtgtttcttattgtcttcatgtcagagtgtcaacatgtgtaatgtctgaggaagaaggaaaggggaaaagcaaaagttcccaaatgaccacaaatgaattaattttctctaattagaactatgggctgggcgcagtggctcacacctgtaatcccagcacttggggaagcccaggcgggtggatcacttgaggtcaggagttcgagaccagcctggccaacatgacgaaactctgtttctgctaaaaatacaaaaattagccgggcgtgatagtgcatgcctgtagtcccagctacttgggaggctgaggcaggagaatcgcttgaacccaggaggcggaggttgcagtaagccgagattgtgccactgcaccactccaacctgggtgacagagcaagactccatctcaaaaaaaagaaaaaggaaagaactatgtataatttttaattattctgtaactgcttgagttaaaattgataatgtgatacctaaaaatatacatacacacgtactttatatcttgtaaatcttaggaagaaaatagactttcttgataacaaaaaacatgccaagacatttaacaatttagaaataaatcattaactagttggtagaaaagcaagtcaggtccagctggctttgatcccacctaatgtaggattttgcagatcctttctcttctcgattaaaattttttcccccaaaactgtttctaccatgtgtttataatgtgctctctttttctagccatatttttgctacaaactagtaattatcctttaatgttttgcttttttttagttttattaacagaattctaaaattttaaattacttacaaattttaaattttaaaagtaagtaacttagtcttccctgtctttgccaactgggaattctaacctactttccttagaattctcagaaaatatttaagatctaggatcactgtcatcatgtccatagttgctttcatttttgagtactgagtatgtgccagacactgtgctaaatgcattgtgtatgcaatttttaatatactacaaaggttggtataattgtcttcacttaacaaatgagaatacagaggccaagatagaatgaatactttgtgccagctagtcactagtagagctggaatatgaaccaaactctgtttcctcgggctggttttttccataaactctgatactcctttcctgtattatacccatcccacctaatcaatgtgactgtaaaataatggaaattctgaagcttctccacccactcatcttaaacagagtctttaaaaaggtaatttggcttgtattcatgtgacatagatatgtaccatatcttgagatgatacaccagtgaattttcttttgaaaaagtaatgactattagtgttgtaaaatatgtttttatttatatacacttaaaaaatgcttttttctaaagtgttaaaaccttgcaggagttgttcacacccatgagtatgtaagttctataactgagcattactaccacaagaaaatctgagaatcccttttgggataatttaagaaatgtgtagtatatgcatagttacacttaatgcagcgtagctccacaatgcttatgcttcgtttatgaataattctatattcttttttttctgatataatttttgtgctatcttggtactttactagcaacatgtcattaagaccagataagcaaattttatcttaaattgttagctgatctcatagtacagatgtctgatttctatttaaaatccagttctacacatttattctccagttatgaagctgtgggttttggttctttcatttcaaatctatggataagcataagtggtctgttcacagccttttttttttcttttttggtttcattgcatttatatcattgacctttgcttcagaaagcattcaagtctttaacagagagagaccatgaaagggagtgttgtaaagtctttattctacgaaggaagtcacacaggcaaagctttatatttgctgagtgatttcttttctttctttttttttttttttttttttttgtgagacagagtcttgctgtcacccaggctggagtgcagtggcgcaatcttggctcaccacaacctccacctcacaggttcaagcgattctcctgcctcagcctcccgagtagctgggactacaggtgtgtgccaccatgccctgctaatttttgtatttttagtagagacgaggtttcactatgttggccaggctggtctcgaactcctgccctcgtgatccactcgcctcagcctccgaaagtgctaggattacaggcatgagccactgcacctggccgatttaaatcttttttttaagagacagagtctccctgtgtcgcccaggctggagtacagtggctattcacaggcccgatcatggcacactcagctcaagaggatggcttcaattccctgtgatgtcatttcctgcctaaccagtcagcacttctggctccctggtttcaccccacccaccaagttgtccttaaaaaccctaatccctgaatacttagggaaactgatttgagtaataataaagctctggtctcctgcacagctggctctgcatgaattactctttctgtattgcaattcccccatcttgataaatcagctctgcctaggcagtgggcaaggtgaacccattgggtggttgcaggattagtctcctgtgtttcttggtctgtggggctttatgagagacaggtttaatttgagataagtggacccagctgtttattcctgtttaactgcagttggagtagttcaggcagcctagaactcctgggctcaagtgatcttcctgcctcagcctcctgagtagctgggactataggcatgtgccaccatgcctgataaatttaattcttatacatgcagaaattggccttgggccatgaataacatgatgcaaaagcactagtagtgcagcctcacaaccaaaattcctcacttcattttttttttttttttttttgagacggagtctcactctgtcacccaagctggaatgcagtgatatgatcttggctcactgcaccctccgtcttctgggttcaagcagttctcctgcttcagcctcccaggtagctggaactacaggcacacaccaccactctgactaatttttgtatttttggtagagacggggtttcaccatgttggccaggctgatcactggtcttgaacttgtgacctcaagtgacccacccacctcagcctcccaaagtgctgggataaaggtgtgagccaccacgcccggcctatattttcttttaaaagagagaaaagcacctttttttttcttgttgttttaaaatctggccatgcatggtgtctcatacctgtaatgctagcactttcggaggccaaggcagacggattgcttgagctcaggagtttgagaccagcctgggcaacaggggaaaaccctgtctccacaaaaaatacaaaaattagccggatgtggtggcgcatacctgtagtcccagctacttgaggggctgaggcagaaggaccacctgaacccaggaagttgaggctgcagtgagccgaaatcacgccactgcagcctaggggactaaatgagaccctttctcaaaaaacaaaaacgaacaaaaatcacccaggaaaaaataaagcatggtatgtacactcagacaactactttatcaagattcattaagtcactttaaatcagcaattaaggagcagatcctccagatagaaagtcttttagtgccccaagaattattaagggaaaacccacttcaggaatagcaactactttgggaacattggctatattatggttacacaatattattaagtgattttgtgttcgaaactaataccttcttcttgtaggttgtgggttaggcaaacaccatcattgaaagtaactgtttatccttttgtatattgaataacatatttagaggaatgaggagtaagcatattttgattaacattttaaaagccttggaaataagctgatgaagtgttgtaagccattctttgaaaggtacattatgttctttataattttctgatagtatagagtggcttcgattgactggttccttcttattgagtcataaaatattcctgaattttattttttatgaatacaggttttctttgctagatctttaagtaccttgggatattcttgtgtaagaccgtatatgtgtgtggcttcttttcttttttctttactaaattacttaagattcatagattcatgcttgatagtataaattagataatgtaaatttttgttgcatttttaaaaacatctcctatactatgatcagtacaaattttatttaagctttaaacatcaaaatatttgggcttctatctctgagaacctttgactttgttaggctgcagcttctcttcaagcaataagatttctcagcctttgttaaagacctgaaatttacttgcagtgagaaaagagagcaagatttattgtggacagggcataaacaccatcactggagtcaggacctatatagatggtgaattgtaatgctttggatctacagaatgaagcttgatacctaagtggatatcaagttatttggcagacaaatttcttgtaccaatttagagtcaatcttaggagtagatagtatggtggggaaaagtctggctttgtatgaatagacttgacttactagctgaggacagtaactttatctgaattttctcagtagtaaaataagtattatgaccctcaccaggtagaactaccttgaggattagagaaaaaatatatttattgacataagccctcaataaatgatagctcattgcatcatcattattactcctgctttcaaatgcctccattttaaattttctgtaaaattatttgttagctaagaaattgcattatgcaatacactagacagcttttaatagcaatacagaatttgataggtgatttatttggacacaaggctttgagatatggtaagtatatatgatttacatgagctgggctttctttcccttctggggtgttactcaatacaacttttaaattgatttacttttattcattgtctttgcttttatttgcagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtacgtactttccttaactttgtcatgtaattattccactgttcttttaatttggaaatctttcagctataggttgattcttctgaaatagtttggaagggcctttatcttctaagtaggatgtactagatcacagcaagccaaactcctgctacaacaaacttgaaaaagtacgtaaattaaaaaaaaaaaaaaaaagtcatatacctatggaggcaaggagaactataggaactaaaattccagaaaggttggaactcttcctaggtaaactgatgatcaccagccattgtctttccaggggacatttgctgattctgagcataggcaaagaatgagctagacccaagcaaaggaattctttaggaaagagatacaagaaatgtttttggcagtcatttgaggcttgcatgatggttggaaacaagaggatccccaaacacaaggccagctttcccacaggatattagccgactatgcaaaagatggaaggctgggccagaaaggtagaaaaaaatctctttctctttcagtcttgtgctgaggagacaaaatccctttagaaagagagggcctgctatgacattcaattatctccccctcaagatgtcttcagactctgagggtgcatgcagtgggacctaagctcaaattaccaaaggccaatacaaatctctcacagtcttttagggctaaggagacacaggcttgctaggctctgaccaagaaatagtaaggaaccagaagttgattaactcatactaaaattacagtccaccctcaagccgcctcaccttctgattggattgaagtaattctctcattatatctgcctaacagatgaaaggggagccctctctggttcttttatatactgtgtccggcatacaataaaaaatactggacaatgcaaagacagaaaaatgtgaccaataccaaagagaaaaaaaatgagcaatggaagcagacctttaggtgatctaggtgttagagtcaacttagaaagacttgactaaagttagtattttcatacaataaagggaaaatcagacaaaataggtgaagagaggcaaaatgtcaatagaaattggaatctctaaaatatcaaatgaacaaactggaactgaaaaatacaacatgtgaattaataactcattgcattaatctaacagtagattgtacacagtgaagacaaagttagaagacttgaatacagtacaattaaaaatatccaaactgaagcatttcgagaaaatataatggaaagaacagagcagggaagatgtgggacacagccaaaaggtttagcataaatgtaattggagatctaaaaagagaggaaagtgatactggatcccagtaatatctgaagagaaaatggccatgaattttccaaatggattaaaggtgtcaaccgacagattcagaaagttcagcaaaccctaagcaatataaaacaaagaaaaccacatttaggcaaacttagtcaaaccattaaaaactaaagccaattaacttctgatcttagttttcctaaatgtaagaattaagtatccttccttggaaacattttttttcccaaacaaacaagcaaaaaaaatcaggacacactagtctgacaagtacaagtgtttttatgagaacagggtggcaaaatacttgaagtcaaaagtaccctggaaaaatcggttgaaagttttattcttcattcaaatactctatagtaaaacaaattgatttagaagaaattgttttttttttcttttatgcgatcttgtctctgcctatttgccagttttatcttgtggcgttctttttctttacatctgtgatccagtcagactggcttttatttctaaaacaaggcatgttccctggtcccagggttctcatatatgatctttcctctgccaagaatggtttttctaatccacctctacctccatccttgacccctctgccttattaaatcacattcttccctcgagtcgtcaattaaaggccacttcattagaaagcatttcctgatgctctaggcttaatggtaatttccttattatatgctctcacatatacttgtattttttcatagcacttttcacagtttgtaattgtatatttatttgtgattctgagtcacatatggctcactcatgagggcaagaacttttttttttcaccattgtatacacaatctctagcatggagctttagcatatagtaactactcactaaatttttatcaaataaatgaacaaatgaatggaaaggcgtacagaggaaagattattttcaatactgagtaacaacaggaatacttcattatactgagtcgattaaaattactccctagatcttttacagtaccgaaaagcagtctacattgctgattctcagttttaatttttcttaaggcaacgaggccactgtctttactgtcatgtaagtgctgacctgtcctttctctggagataatttaaggcaaaataattcttttcatggttatggtttctaaaagcagctagtagtgagagaaataaatgggttctttgtttggaattataataaaagtggaatccaacgtgaaggagtgcaaatactgtatttaaaattacaagctttatataaaaccactctcgtcaagtgactttattttcaacagtgctgtgataaggttgccctctggtggccacttactgtgttttcacagtcctattttcaccccctctactgttttgctataccttgtgttttagattgaagtagattttcaaagtactctttttttgtggtaagatatatttggataaacattttggaaagcaatttgacagtaagtattagaaatcttaaaaattgttctttgatctggtagttctatttccaggaatctattctaaggaaagaattctaaattcttaagaaggttatattcagagatgctcaccaaaatggtagttacaattttaaaaagttaggcaacccaatttctcacaatagggtattaagtaaatactgttatctaggcagtatattattaaaaacacagaaaaccaaatgttgaccttaccttgagcaagttgcttaatctgtttcttcatctataaatttgatataatagcagtaactgcctagtgggttgtcgtgaagattaaatgcaatacacttgtacagcctttatatagtgcctggtccatcacaagtaatcagtaaatggtaactgttactatgttctcgataaaatgttttgttttgttttgttttttctgaaacagagtttcacccttgttgcccaggctggagtatggtggcgcgatctcggctcactgcaacctccacctcctgggttcaagcgattctcctgcctcagcctcccaagtagctgggattacaggcgcccaccaccacgcccggctaattttttgtatttttagtagagacggggttttgccatgttgggcaggctggtctcgaactcctgacctcaggtgatccgcctgcctcggcctcctaaagtggtgggattacagatgtgagccactgtgcctggctgataaaatgttttaaagaatgatatatagcaatatgagaaagtgaaagaagcaaggtataaaataacttatgccatataattagactagttaaaaaacaaaagccaaacccctgtaaatgaggaaagattacaaagagaagtactaaaaatcttttttttttttttgagaccgagtcttgctctgtcaccaggctggagtacatggcacgatctcggctcactgcaacctctggctcccgggttcaagcgattcttctgcttcagcctcccaagtagctgggattacaggcgcccaccatcacacgcccagctaatttttgtatttttagtagacacggggtttcaccatggtggccaggctgatcttgaactcctgacattaggtgatccacccatctcggcctcccaaagtcctgggattacagacttgagccacggagcccagcctaaaaatcttaatgagagatttcctaggatgattttttacccctttctactcctgtatttttctagattttctttattaagcacgtttcccttaaaatggaagtggggggatattatttttaaaactggaacttcatgttcatataatatacttcctttgaaaatccagtgtacctttatgtattcatagtgtcccatgatgagtaacttgacctgagcagcttgactgagttgaccaatcctctactccccaatgatacttacttcagagtatcatgctttcctagtttttgtgctacctaaccagcttttccttcttatttgttctactacatcttcctcagttcagctccaagcactggagtgcctcagggctcagagcttgtcaagtttgtctttgccatttaaactttctccctaagtggtctcattcagtcccctggatttaatttgtatttgtttgtttgttttagctcattttcccccttaaccctggatttaatttaaatgccatctatatatgtgcttattatcagatttgcatttctccgttgatctccacactcaaatatccaactgtcaaatatccacttgttttaattggcattatatacctaacacatccaaaacaacttttttttcaacttataagttaagcctgctctattcatttcaccaagttactcagtcccaaagcctagtagtcatttttgattttgctcctttttattactgcaaatatccagctcatcagtatattccatcagccctatcttcaaaacataccctgaatctgaccactgttcatgacttttattgcatcatccttgcccaagccactgtcatctctttgaactactttggcacagtctcatctggcctttcagcctcctctcttctctccctattctctgatccccaccccaccacagttagtctccacataacaaccagagcaatctttttaaaatgtaaaaccagatcatgtcattttcatgcttaagccctccaatggcttctcatcccttttggaataaataaaattcaaacatctctctatggcctatctggttttacattttctgggccctgcctttctctctgaccttatgccctgttactctctcccttgttaacctgggctccatactggccttctttcagtttgacaggttaaagcttgccttttgttctataaagagggtaaggcatttcttcctacaacaaagcacattactgtatttcagataggtttatatataaatgatgaaatggtaaaataaataaaggaataaggaaaggtctttttgcaggtaacaatgtatgttttcaatgttttgtccctgaatttggctggaaaggagccctacattcctttctttgactatttattttcttggttatctctacaaagatttttgagatgcttagtcaaggagcatgaaaaaatcatcttcaggaaacattcctttttcttttgatccaccctttggccatctttcagcaatgagaatgtgagaatgtgagttttagggcagtattgttatattttggggggttccaggcagagcataatgaacaatgttaaacttcagcttatttttatgtatcatttatcataaaagaaagattcttagattttagatttaaaggaaaccttagatttcatctagttcagcttttaaaatttacagatgaagaaattaagacataaagagaaaacattatgtcctatggaatagtctttcaccctttgaaatgctcacattatattaaatcgttagccaaagaattattatcccattttacagattagaaaagtgaaaatcagagaagctgtttgcttaaggtaacttagtttgtgagaatttcagctggaaatggaacacaaatttgacattaattcccataccactttttttttttttttttttttttgagacagagtcttgctctgtcacccaggctggagtgcagtggctgatctgggctcactgcaagctccgcctcccggattcacgccattctcctgcctcagcctcccgagtagctgggactacaggcacccaccaccattcccggctaattttttatatttttagtagagacggggtttcaccgtgttagccgggatggtcttgatctcctgacctcgtgatccgaccgcctcggcctcccagagtgctgggattacaggtgtgagccaccgcacccagccccataccattttttaatgctatgttgcctctcacagaggagttgtaagctattaaagaagcaaattcacatcattagtttctaccgtatataggttttaaacgttatggtctttatttttattgtaaaaataaataattattaaatatatatatgaagtgtttcaaattgcttgagttcttgaaatattttacaatgtgtatgtgatatattttacagtgtgttattttacaataagaaaaatcaaggtaataaaaaataaaagtgatgcatgtatactagagataatttctagactagagggagaaaaactctgaaagggctattgcctctcacgactgttgttaacactttggttatttatgtctggcctatctttaatttatttgttttctttctctatagttgtactttaggtacatgcaccttaaagcaatgtaaacagtgattaatatttaagaatcaatgaattttattctttttttaatttatttatttttcttctgagacagggtctcgctctatttcccgggctggagtgcagtggcatgatcatagctcactacagcctcaaccttccagactcaagcgatcctcccacctcagcctcctgagtagctgggactcaggcatgcaccaccgcacccagctaatttttgtattttttgtagagacagtattttgccctgttgcccaggctggtctcaaactctggggctcaagcaatccacctgcattgacctcccaaagtgctgggattacaggtttgagccactgtgttgggctaaattttatacttatacttgctttcatttttacttttgagataacattgtttaccacgtaaggttattttttttttactcattgatttctcattgcagggtatggccaaaaaacaaacacaaataaaaaattcttctggaaaaaatattctggtataaatggcttaagagagtagaattatattgtggtagtcacaaacatgtggagtcttatttagaatagtaaaaagccccaaaatagtaaacatataagcccagtagccctgtaggagtaaaggattacaagtgtgtgtgtgtgcatgtgtgtgtgtgtgtacacacacatgcacacacacacgcttacatatatgtatttatttattattattatttttgaaaaggagtttcactcttgttgcccaggctggattgcaattgtgtgatctcggctcaccacaacctctgctttccggattcaagtgattctcctgtctcatccttctgagtagctgggattacaggcatgcactaccacacctgactaattttgtatttttaatagagatagggtttcaccatgttggtcaggctggtctcgaactcctgacctcaggtgatccacctgccttggcctcccaaagtgctgggattacaggcgtgagccaccatgcctggcatatacatatatacatatatatatgtatgtatgtatatatgtatataaagggtagcaacatgaccttttcttgtcacatcagctatgcacaaaggacttattattggactgcatcttaccctgaacatccaaattttactatggaactgttagctttttttttttcaggtattttttatattaaagcttagcactttatcagaactttttctcttaaaaattctttgtattgaacatttttaatagggggagagtaggtagacagatttcacacataatgcaggttttgacgtgtccaacctgaggaacagtttaacttttaaaattgttttatttttagagcaaaactccagtttcctagtatgtatttttcagctgttttttattgtcacaaagatacatagctaaagagagatcatgatacaagaagatctgaaagaagccagtacctaaagtgtctaccacagcatgaatatatactactttgttatgtgggaaaaatgtcattaacactatcaggcctttacaattacatgattgaaaatgatgatatttacatacaagtttgatttaatgttaagtgttcacataaacttttgaaggtatctttcacaataaatttatgaagtttgggggaattttgctgtagtcagttaagaattgagatttacacttagggaggcctacatgggcgcatcacttgaggtcagaagttcgagaccggcctggccaacgtagtgaaaccctatctctactaaaatacaaaaattagccaggcgtggtgacatgcgcctgtaatcccaggtacttgggaagctgaggcaggaggatcacttgaacctgaagatggaggttgcagtgagtggtgagcagagatcatgccactgcactctagcctgagccacagagtgatctccgtctcaaaagaaaaaaaaaaaaaattgagctttttaacatgtaggttgatgacattttcattcttttgtttttttcaagttttgcttcagttgtgagaccattttatttcacagccttattctctctccccttttaaaaatatttctgctagtaaggaaaagaaatcaagacttttacgaatagttttagcattggactgtagttagcttactttgtaaaatgtcattatcttcctagatttctatgtagaatttactcactaatttccataatagtagttctgagtgtccctttgaatcttcctggccccataaggaaggaatgtaaattatgttacactttctcattttgtattttcaaatgttatgctgcttccatgtctgtagaacatccttactaatagagtgccaagggagtattattacaaaacctaactttgttttgtttttttcttttctttattaattgtttttatttttactttaaatttttaaatatataaagctatggagaataatataacaaatatccatgcactcacacccagaattattaataataaagattaacattttgacattttgcttcatatttatatatatatgtatatagttacatctttgaaatagaaaatttcaataaagttgaggtcctcttttcctccgtagtcctgttttacccccctccctccacagagacaagcagagtgtaaaattcccctataccctcgcaatccacattttaatttttacctcatgtttatatccatctggttagtgtactctgtatccatttgcttagtgcgcttagtgtggtttttaaattttaataagtattctctttctgtatgtgttattccccaatttgcttttcaaccaacattctttttaagatttaggctgggtggctaatctaatggctcatgcctgtaatcccaaaactttgggaggccaacgcaggagaatcactggaggctgagagttcagtatcagcctgggcaacacagtgaaatcctgtctcataaaataatttaaaaattagccgggtgtaatggcatgctcctgtagtcccagccacttgggaggccccatctctaaaaaaaaaaaaaaaaaaaagatttgtgcatgttcatgcatgtatgattagttcatttatgaaaatgccacaatttatctattcttctattaatatgtatttggattgtttttgttttctccttggcgtatagttgctacttttggtatgtaatcagattaaccagcaaggatttattgagccactaatcttgtatcccacctttccctaaggagcttacaatctagtaggggacacaattcatagacatggcagtatagaaatcaggtggggtagaaattaactctatccaatccctattagtttttctttttcttatgatctttttgttgcaggcatgatttttgaaagttacttggctttcaaggtaaatctttaacttttaaaaataatttgcttcttttaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataagtaaggcctttctctaacttttcattttagagggaaaaaaaaatcagttatcaataggtataagttgcattgatgaataaagttctggatgctataggtgaaagggagttataaaaacagcaaaagttttcctttccaggaatttataatctaatccaaatatatatatatgtgaatgagacttaaagtgtctaaaaacctgcataatgagttaatgcaggaacttcaagactgagcaacttttgctcacctatttcaaggtaacatttactaattagttcctcctagataccgaataatgttgactaattgcaatctaataaatatagttgactcatttaatcctgatatatatattagttatctattgctaaataacctattaccctaaaatttagtggcttaaaacagtaagcattcattatttcacatattttctactaggactttcgaagcagcttagctgggtggtgctggtttgaattttttcctttctttctttctttctttctctctctctctctctctctttcttccttccttccttccttccttccttcctttctttcttttcttttcttttctttctttctttcctttcttttctccctgtctgtttaaataatagctttgttgagctgtaattcacatttcatacaatttaagatgcaaaattcagtttttttagtacatagtctcaaagttttgcaaccatgaccacaatcaattttagaagttttcatcacctcccccaacaaaaggacctaaaaaacaatcctataatcattagcaattactcccttttcctctggccttaggcaaccactaacctactttttctgctctatggatttgcccattctgaacatttcatacaaatgaagtcattcaatacatggccttgtgtgtctggcttttttcacttagcatagtattttcagttcattcatgttataacatgtctcagtacttcattcctttttgttactaaataatatattattgtgttataccccatttcattgctctcttcatcaattgatagacatttgtgttgtttccactttttagctattacaaataatgctgctgtgaacatttgtatacatgtttttgtatgtacatatattttcatttatcttcagtgtatacctaggagtggaattcctgggtcctgtagtaactatgtttatcctcttgaggagctgtcagactgttttccaaaatgagtacaccattttgcattctcattctcaccaaccctgtatgtaggttccaaattttccacagcttcaccaacacttactatctgcctttgtataattatagccatcctagtagatatgaagtggtattccactgtggttttaagttgcatgttcctgatggctagttatgtgcttattgttcattcatatatttagagaaatgtctgttcagatcctttgcacatttaaaatttggattatttatcttgttatcattgagttgaaataattctttatatattctagatacaagtcccttaacagatatatgatttataaatattttttctattttgtggtttaattttttgctttcttgatggtgaccttcttagcaaggcccaattcaaatgttacctgcttcatgaagacttttctatacctcccagtaggaaattatcctgtccctcaagctctcgtactacagtgcaatatcatgtatttatgtatagtggatgcaccaagagggaataattactttgcctggagtgggggaatatcagcaatggcttcagagaggatgtgacataaaagctgagtctcgtgatgggagtctgcatttagcaggtagacaggagaaggaaggacatttcagataaaaatatcagtaggaacaatggtacagaaatcttaaaacagcttatttgatcaagaaactacttaagaatggcagaaacaaagtataaggcagaaggagtgaaacatcaggcagcacattgaatgtcatatttgaggtccagttggtctgcccatgacaggcatgaaaggctttcacaaaccttaatttcagtccttcagtctatttcatcaggaattctttagattattgttgctatagttgttgaagtacaaaaatgctgtaaaatatggtactgttgtaagctgtaacttcattgagaacaaggaatatatgccttttcactaagaatttttttcctgcatattattgtttgcatgggttatgaataattcagctgccaccttttattgctgaaagtaacctaagtatttctggtttaattcctttatttgaaatatggaaagctgaggcccagagtttagtaacttacttgagatcacactacccactaggattgtaagtggtaagttagaattctttatcagttgcacactctgggaatatactaaaaccattgaattgtatacttttaatggttgaatgttacggtatataaattatatctcaaagccattttaaaaagtaaaagtgaaagatgaaaggaattcgtttttcttaaagagcatcagaaatatgattcattgccacaagttccatgaccactgtaaagtattcctgctataataacattagtctgtgtttagataacagggtgatcctgttagtgtaattataatagtaaattctaaggaaagaactaatctatctagcagatttaaaagatgacttgttgattattaaaaattatttattaaatataattaagaatccagaattgaaatcctatgaagaataaaaaaggaaacagataggtatgagttgttatgttcctactgcctaaagtgaaattactcagtagatacatattgaacacgtgctatgttttaggcactgtgctaaacattggcgataaagacagaaaaatgtcaaatagctcatagtttaatgggagaaacacacaagtaactaggtaattacaatttcaaatgacatgtgttacagttaagcatagactaaccctatcctaaactgagggaatcaaggaaaacttctgtgcttctgagaagaagtaatacctgagttaattcctacagattgaatttgctaactgaactagaaagagagacaagaggatgtcccatgcagagaaagtagtatgtacaaaacctcagacagaagaaagcaggcagtatttgggtatttgggagttcttttaagccatttaatgtgcctgaaccttagggggtggtggagtgtgaagtgaagagagaaaagttgagagaagtaggcagaggtcagattatgaaaagtactaaaaattctattacgttttcacttaatcctgaaggagttagggaaccattgaagagatttctctagagaagtaacatattcttatttactttgaagttcaaagtgaatgtaggggtgcattgtgataaaaagaaccatgaggaagtagctacaataatctaggtgagaaatgatgaaggcttaatctaagatcactccagtgggaatggaaagagacatccgtggattggaaagactttaatcaggtacaattaatatgaattgataactgcttagaagggacatatggaggaagaggattgagagatgattctcagtgttttggcttatgcaagtgggtagatgttggtaccattcactgagatctagggaacattggaggaagacaggactcaggaagggaagatactgaggacagtgttgtacatgttaagtttgagatgtttgtggatccaggtgtacaggaagttagtatatagtttggaatttaggacagagatgtagactagagatacacatacacatattggaattgttgatgatgtcagtggatgaggccacccatggaaaatgagcagagaagagaaagaaaccaagaatagaagtctgcagagtacccacatttaagtttgggagggatggaggaagtttttgttaaaacaatattttatccaatctgtcatctataaaaagaagggaataacacaattatgagagtgccaacccatcataatcattcagactccttatgtaagcctatttattttgctctctacatgaataggttctctggatggccccatcattcctacaataagctggaaaattagtaaatagattatagattattagtttaattaattaatagagattattatatgtctctagagaggagacagtagggaaggtttataaaaaacaaattagaaacagggtctcatcatgttgcccaggctggtctcaaactcctgggctcaagcgatccttccaccttggcctccaaagttctgggattataaatctttttaaggactagtagttgttttgcatttttaattgtagcttcagactgtactaaactattttggcattctctcttttagaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaaggtaaaacttcacctaagtgattgtaaatttaatatctaaaactagcagtgaaaaatggaaggctttgtaaaaccttctaaccctaccagaggagtttctggaaatagattttgatagatatttgcctaaagaggtttccttccattcctgctgctcttctgacactccacagtcaactccagaaatttgaggaccaagacaaagtcattgcgacagtgagacaaaatgttctcacatttttctcttcatctatttttatttttatgttaataatttaagaatcctatcatttcttttattctttgcttcctttattctcatcactttgagggatcatcaaaggtcttttgaagtagggacatctaatctggttagaagttccagctgagaagctggagttcattctagcatctgtcctaactttgggcctaagtttccccatgtacaatggaggaaataataatattccttttgaattttaaaagcaaaagttatccacatggcaaaatatttcttataggaaagctcagtaattaaaattaatgattatgaattcaggatgagttaggatattgagggtttattaggtcacagagagattggaccatgctgttctacaaaccactctttgatattcttaacatgctgaacacgaggctgatgaacagttggtctatggcaactgtcatctttctgccattttcttgatatctttatactgtagtgatcaaggcaaaaagattcagattgaaccctattactagctagagatcctgctactcagttctcttacctatttgggaggcacactttgtccatagttagctgacagaactgatgatttttcttattagctaataggtaatatatataaactttgcctctttttagaataaattgatatggctttcatggtgaagaattataataataatagtaatacttttattgagtacctactatatgccaagcaccgtaagcattaaatgtgataatgctgtgtagtatattatttcatttaatccttcccaagaactcagcaaagttgatgttattattcacattttacagataaggaaaccgagctttaaaaaaatttacttatctgtagccacacacttctatttgattccaaagcctttagtccttccaccaaactatgctgccattagaaatacaaagtataatacctaaattataaagtagctgtaatctacacaaaggaagaattcctacacatggaattaaggaaagctgttttctctcttggctgatgtcagcctcagacatttaaaatttgtttttcagacataactagaggtatagttttccctacacctcctttgcagataattattttacctttatgaaatgccatcagacttgttagacttatttttgttcaaatgattgccatatatccctgttacttttaactatgtgatttagagctcagtagtgacaaatttactgcctttgcaggaatttatatgattttatctaagagtaaataagaatggaaaactccaacactggtattttcccaaagattttttttttttttttttttgagacagagtctcgctctgtcaccgaggctggagtgcagtggcatgatctcagctcactgcaacctctgcctcccagcttcaaacagttctctgcctcagcctctcgagtagctgggattacaggcacccgccaccacgcccagctaattttttgtattttcagtagagacaggtttcaccatcttggccaggctggtcttgaactcctgacctcgtgatccaccaccctcggccgcccaaagtgctgggattacaggtgtgagccaccacgcccggcccaaagattttaatgtagatattatacatattggaaaacagccatagatgtaataatctagctttctagaccctgattcttacccttatcactatatttctttaaacattatttttaacttgcattaccttaaagcagaatatcatgttaacatcctacatcaacattcactcccatgcgtatttcttttattgtttctcaaaactagataattttgtcttttacatttcattctctgtttttattttcagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtagtctcagctacttgggaggctgaggcaggagaatcacttgaacctgggaggcagaggttacagtgagccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttatttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttactgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgtacctattgtagatttgttgtttacttttttgtgtggtcagagttgtttcatgtcttcaaatacatgccaaggatcatttactttcagcccacttcataaaaatctttgaactcttcatttattggccatgtattttgtttaagttcatttaaagaatgttttctacttggggggaaaaaaatccatgaagaagattccctctcttagaggaaaacaaaacctgagaagaaaatatattaacatatatttttgtttgtgcttttgcctattccctctgacatccgtcggattttatagagaaaacttgctcgctttggatttctttgtcacacatataaagaatttcctttctttggtagaaatctgaagagaaaccatattctacctgtttattaagtaacttgtaatgagagtacatctttttaatattttaagctactcttgaagaacctgtattttgacaaagctagatggtgtttaatgggatgccatctgagagattcctttatttgaaaaaaaagaaaaagtcaggcatttctttgtgctgagagctttataaacttaaactgttttattcaacttcagttggttaacatttaaatttttaaactctattttttcttttctagccacacaagaaaacaggttttatcactttataataacaccttatgtttatacatgtggttctgtgatgtatatgaattgggtattaagggaaaagaataagcatggcagaaatctaaacaaattacagtttcaagagaaagtatatatatacaaacaagtaaggacatttgcgaggttgcattatcaaaactggttgtattcattttccataggagtataaaacatctatgttttaaaaaaattccacatgctccattataattaagtcagtaacttcaaagtaacagtgtgcttacttatattttaaaagttaagctgaattggccgggcgcggtggctcacgcttgtaatcccagcactttgggaggccgatgcgggtggatcacgaggtcaggagatcgagaccatcctggctaacacggtgaaaccccgtctctactaaaaatacaaaaaaattagccgggcgtggtggtgggcgcctgtagtcccagctactcgggaggctgaggcaggagaatggcgtgaacccgggaggcagagcttgcagtgagccgagattgcgccactgcactcccgcctcggccacagagcgagacttcgtctcaaaaaaaaaaaaaaaagttaagctgaattaaaaacgtttttcatgagatgatagcattaggagtgttgacaggctgaaaatcaacattctatctaaatcaatgttaaaattgcagttttacctataagttagtctttcaaggcaattttatgaggaattattgtagtaattgtacaggctttctagtacttccgtgtacaaaatgaaagccatcagacaatgttaaatttacaatgtgctgcttgtttgtattaataataagtagattttaaaccttgtctgttgaatggaacactgcacttcaaacagttgcaaaagaaaacaggcaaaatgttttctttgtatgtaataagagtaggtttgggtaataaaagaagtatttgggaggaaatcttcttttgtggtttcctttgtgttgttagacaaactgctgaaattgtatatgtcagtattggttctttcaatctttgacccaaagaaggaaaagtctcagctcttgccacgttaattactattccaattcaaccatgttaaactcatacaatttcctacatatgccaggttatatgatgtcttcctcctttgctggtactgtttcccctacctataatatccttgagaatgctcattcattctttgcaaacctttgataaaggaaagttgatcaattcttaaatttgtacctccattttgcctaatgaatacttctactactgcatatattttattataaatacttgttagtttgtgccttccccagtgaactctgtattccttgaaattaggagcgtttattcttctgcctctggcatctggcatgttgctggtacattgtgggtgctcagtaagtgatggtttatgtacaaaaggtagttgacaatacaagagttggtatgtgaacttatttgttgaagtatggcaacaaaacttctattcagtggatacgataatatttcttattcaagagaggtgtcaattttacataggcttcagaggttctgagaaacccttgaaatttcatgccgttttgtttattgatgcaattgtgtttctttttttctggagagaagacccatactttaatcattgtctcaaaaggatccatgatcggcccggcacagtggctcatgcctgtaatcccagcattttgggagaccgagatgggtggatcacctgaggtcaggagttcgagaccagcctggccaacatggtgaaaccccatctctactaaaatacaaaattaagccaggcatggtggcgggtgcctgtgatctcacttactcagggggctgaggcaggaaaattgcttgaacctgggaggcggagtttgcagtgagccgagtttgtgccagtgcactccagcctgggtgacagagcaagactctgtctccaaaaaaaaaaaaaaaaaaaaaaaaaagatacatgatccccaaaggataaacaactaattgaaggattattacttcatttttcagcaatcaaaatcctcccactgaatgcaaattggcacaattggtaaattggtctttatttcaggaagtccacttctaggaaatcttcataaggaaatgacctaaaaagcagaggctccacaaaattttttttcagactggtgtataaagtttcaaaacttgggaataaattctagatgttcaagaacagagatgtagcctggcacggtggctcacacctgtaatcccagtactttgggaggctgaggcaggtggatcacttgaggtcaggagttcgagactagcctgaccaacatggcgaaaccccgtctctactaaaaatacaaaaattagccaggtctggtggcgcatgcttgtaatcccagctacttgggaggctgaggcagaatggcttgaacctgggaggtggaggttgcagtgagccgagatcatgccattgcactccagcctgggagacagagtgagacgccttctcaaaaaaaaaaaaaaaaaagaatagagatgtagtttagtgcatatacttcatgagataacatacagtcactaagagggattagggagaattattaaaaactgaatcaaagttaaatgaagaaaaatggtttgttttgaagatgtgcatgtaatttcactcctggtatatagtttagagaaactcatatatgtgcaccagaagctgcatttcaaattcttcactgcagcattatttattatagcaaaataattggaaacagtccaaatgtctgtcagtagaagaactgtggtctatccatatactttgaacagaattttatgcagccgtggaaaatgaatgaattacagctatatacatcaatgtggatgaatcacaaaaacaatgttgagcaaaaaaaagtaagtcatagaggccaagtatgtaatcccagcactttgggaggccgaggtgggcagatcacttgaggtaaggagttcgagaccagcctggccaacatggtgaaaccccatctctactaaaaataccaaaattagccaggcgtggtggcaggcacctgcaatcccggctactcgggaggctgaggcaggagaatcgcttgaacctggaaggcagaggttgcagtgagccgagatcatgccactgcactccagcctgggtgacagagtgagactctgtctcaaaaaaaaaagaaaaattagcactttgaactgaatgaaaatgaaacaacatttcaaaattgtggaatgcagctaaagcagtatttagagaaaagctcagaatgtctatattacaaaaaagacttcaaattaatgacgtaagcttctatcttaaaaagctagaaaacgaagagcaaaataaacccaaagtatgcagttaggaaataacaaagacaagagcaaaaataaaatagaaaacataaaatgaaaaacagagctaaaagctagatctttgagaaattcaataaaatttatagacttccagacagatagataatcagaaaaattaagaaaacacacacacacacacacacacacacacaaaaacagtaccaggaatgagagaggggaaatcactatacatcccataaacattaaaaggataataaaggggccaggcatggtggctcatgcctgtaatcccagcacgttgggtgaccgaggtggggggatcacttgaggtcagcagtttgagagaccagcctggccaacatggtgaaactccgactctcctaaaaaaatacaaaaattagctaggcatagcacctgtagttccagctaaacgagaggctgaggaatgagaattcgcttgaacctgggtggccgaggttgcagtgagccgagattgctccacttcactccagtctgggtgacagaacagagcaagaccccgtctaaaaaaaaggataataaaggaagtttatgccaacaaatttgatgacttacgtgaaatgtacatattccttcaaagacacaaaccatgctcactcaaaaagaaatagataacctaagtagtcatgttacctttatttaatttaatttgtagttaaaaactatttgtttgtttatttatttatttttgagatggagtcttgctctgtcgcccaggctggagtgcaatggtgcgatctcagctccctgcaacctctgcctcctgggttcaagcaattctcctgcctcagcctcccaagtagtaggattacaggtgcgcgccacagtgcctggctaatttttgtattttttgtagtagagacggggtttcaccacgcttgccaggctagtctcgaactcctgacctcgtaatctgcccgccttggcctaccaaagtgttgggattacagtcatgagccacaccgtacctggcctgtagttaaaaacctttcacaggctatgtgtagtggctcacactgtaataccagcacactgagaggccaaggcaagaggactgcttgagcccaggagtttgaggccagcctgggcaacaaagtgagaccccgtctgtacaaaaaaaaaaagaaagaaagaaaaaaagaaaaattagccatgtgtgctggtatatgcctgtagtcccagctatttgggaagttgaggtgggaggatcacttgagcccagcattttgaggctgcagtgagccgaggctgcaccactgcactctatcctgggcaacacagtgagaccctgtctccgaataaacaaaaaacaaacctttcacaaagaaaactccaggtccagatagcttcactggtgaactctagaaatatttaaagaaatattaccaattctacacaaacccttccagaaaaactaaagaagcaatatttgtcaactcattctatgaaaccagcattacccaaataaaaaaagaagacataacaagaaaacaacagaccaatgtctctcatgaatatagagagaaacatttctaagaaaattcaagcaaatttaagtacaacaatacactttaaaaaacagtacttcaaggctgggcgtggtggcttctgcctgtaatcttagcactttgggaggccaaggcgggcggatcacccgaggtcaggacttcgagaccagcctggccaacatggcaaaaccccgtctctactacaaaaaatacaaaaattagccaggcgtggtggcgcatgcctgtaatcccagctatgtgggaggctgaggcaggagaattgcttgaacccagggggtggaggttgcaccactgcactccagcctgggtgacagagcaagactctgactcacacacacacacacacgcacaaatagtacttcattaccaactggggtttatcacataaatgtaagtttggtataacatttaaaaatcaatcagtgtaattcacaaaggctgagaaagaaaaataatatgatgattacttcaatagctgtacaaaaggcatttggcaaaatccaatattcattcatgataaaaatgatgatgatgatgatactctcttgtgtattgtgatataataagaaatataggctgggcacagtggctcacgcctgtaatcccagcactttgggaggccgaggtgggtggatcacttgcggtcaggagtttgagaccagcatggcccaacatggcgaaaccctgtctccactaaaaatacaaaaaaaatggcctggcatggtggtgaatgcctgtgatcccagctacttgggaggctgaggcaggagaatcatttgaacccaggagatggaggctgcagtgagctgagattgcgccactgcactctagcctgggcaacagagcgaaaccctgtctcaaaaaaaaaaaaaaaagaaatatatatttgggtctttgtctagctcccagcttttgtgcaagtttctaaatgataagagctgtagtagcatcttaagttatatttggtttttgcccctggctcttgtaataggtccagggtgataaaggtgaaaggaacaacttttgttacttatcataagtccctgttgaccacacctgagttattgaagtgactttggaaaagcccctcaagatgagggtgctggttgccagaggaatcaactgtatgtttggaagattgaaacgtttagcccaggaggttttttcttttgtttgtttatagagaggttctcactctgttgcccaggcaggagtgcaatggtgtgaccttggctcactgcagccttgacctcccaggcacaagtgttcctcccgcctcagcttcctgagtagctgggattacaagtggatggactataagtggacaccagtacacccaaataatttttatttttttttagagacagagtcttgctatgctgctagggctggtcttgaactcctgagctcaagcaatcctcctgccttggcctcccaaactgctgggattataggcatgagccactgtgcccagctaaggccagaaggtccaggctgcagtaagtcattatcttgtcactgcattccagcctgggcaacagagtgaggccctgtctctctctctctcacacacacatacacacacagacacacacacacacccctcactatatgttagtaaatgaataagtgaatcagccgtatcacagtttctacactcataagtacaataaaggtgtgtaagtatactgcagtctgcaggctttgaattagtgcaaacttaaaccaaaatcccaataaactgttattttggaaagcatcaagtcacttgtaagtagggatgtttgtgagtgaccctgggaacatacagcacaaaattcccttcgatggaatggtgctgatgaagctcattccttcggtgtagagagagatcacgcccacagacctgactgcatgtcctcaaacactgcggcctgtgctgactgagtaggaagcaaacatagtccaatatatggatgcttttggtgtcctccccttcctgcctttacttttactccagaaccaacaggcttcatctcagctttttaatttccccaaaacattttctaaatgagccattgttatctttaatcaccatggctaggggggattatccagcctcgtttgaagaagctattttttgcaaagagatgagatccttccagacaaggataaagacattaatgttgtctattaagattctgctttactcaagataataattttagggtaaattaaggaaattgtatagacgccaatgggccattaatccccagtggaattgtctgaaatggagaggcctttaaatttggaaacaaggaatttggcaacagttacattttgaatttccttcagttaaaatgaaaaggtttcaatgttaacaggtactgtcctgggtaaagaattttatttagttacaatctgtatctcaactttttgtattaaaaggtagagatcattaaacctttgaattaagagttaaagtatcagttaagtatactaaggaggaagcagaaacataccagaaaacctaggctaaaggctaagttagcaaatggcacccagttgagctatgagctgcccaacaaacagcaacatagattatttacctgtattactgtctaattaaaaggtgcatactggaacatcaacataaaatctatttttcttggttctaaaagataatagcttatggtacaaaaagcatcagctttgaaagtgatatggacaggagacagggaaatactgagtagaagagagcggtccccggcaaaggccccaccctcaagcctggagacctgcagccctaagtgggaacaggcatttctgttttcgtgcccaaaaagttgcctttttgcccaccacaccccctatcttgtacccatataaaccccgaactccaggctccggaagcagacaagcaggggaggagatgagataggcagaggaactgcggaatgatgcaacagagaaagagagacgaagaggaacatctgaatgcccagaggagtttggctgggggtggtcagagaggagttcggccactggatgggcaggctccaggggaatatcatcttcctattccattcccccttccagctccccatccatccctctaaaaaccacctccaccactcaataaaaccccacattcatccttcaagcccatgtgtgacccgattcttccaggatgctaggcaagagctcacaatacagaaagctatcacactggccctctgcccttatgaaaaggcagagggtccattgagcggtttaacactcaagccgtctacagataggagggctaaaagggcacactgtaacacatgcccacttgggttcctgcaactgcctgtctgtgtgttcccccttccctcgggggtttgagcagtggcagtgacaggcaagccacacttgccttcacacgtcctgtgagagggattggggaaccctcccatttcaaaagcagagagatatgggttctagtgcaggcctcacaactgtaggatctggggcaacttaacagatggctcttcgtcttgtcgccattacctataaaagtaataactttttagttatcactaaacatggggtttcgccatgtcgctcaggctggtcttgatgctgacctcttagggttgcagcgaggttaagtgaaaaccttatgtggagcatcgcagcacatgcaaggtctataatgaatagttcgcttcctctctccctattatttaagaggtctttaggctgggtgcggtggctcatgcctgtaatcccagcattttgggaggccgaggcaggtggatcacaaggtcaggagttcaagaccagcctggccaagatggtgaaaccctgtctctactgaaaatacaaaaatgagccgggtgtgctgataatgcgcctgtaatcccagctacccgggaggctgaggcaggagaatcgcttgaacccgggaggcagaggttgcagtgagccgagatcgtgccattgcactccagcctgagtgacaagagagaaactccgtctaaaaaaaaaaaaagaggttttaaataaaaactttacaaaaaatgcaatgtttttctatctctagtgagtggataattggatcaggtaccagctagtttgcttcctgactagaaaaccaatctacagcccagtatttgagtaaggctactcttgggttttgggtatacttaaatgaaatgagacacctccctaagttgaattgctgctgtttctgtgttttcagtgagtggtctgtggccaggacggcatccacaggaggctgaaagaagcaaagtgacatgttgttggcattctatggttccacagggatccatgaagaaacgccatatttgcctatgggaaatgggtgggaaactggtattgtgaagcgaggagagcacaggcctggaagtctgcccattttgggtctattcttgctctgttatgcacttgtagagtgaacttgggcaggccgctgaatccatctggatctcagtttttccactggtaaatccaagaagtttcgttaaatgttct

SEQ ID NO: 1811 - DNA, 6342 bp, Homo sapiens
atggtgcgcccggtggcggtggcggcggcggttgcggaggcttccttgggcgacggctcccacggcccaggccccgaggaccgggcccccgcgcgccaccgtccaccgacccctggctgcgacttctccagcccagtccccggagaccacccctctttgggcgactgctggaccctcttccaccacctttcaggcgccgctcggcccctcgccgaccacccctccggcggcggaacgcacttcgaccacctctcaggcgccgaccagacccgcgccgaccaccctttcgacgaccactggcccggcgccgaccacccctgtagcgaccaccgtaccggcgcccacgactccccggaccccgacccccgatctccccagcagcagcaacagcagcgtcctccccaccccacctgccaccgaggccccctcttcgcctcctccagaatggcccaggtcaagctagaattatcctgtgtcatgttgccagttacagcagtaatggtactgctcagaactggactaaatagaagacattttaaaaaggcaaatgcaaagatggaaatccccaaaacagccattgtccagttctggttagttatctctcagatcagacaaaggagcagctgttattcaactatagatccaactagattcgaatatgttttccaactagattacatcctacagctgaaaagcaagtacttgcctcttacacagccagtcatgaatcttagagtctcagaagctgttaaaacggagtatgtatgtaactgctctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtagtctcagctacttgggaggctgaggcaggagaatcacttgaacctgggaggcagaggttacagtgagccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttatttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttactgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgtacctattgtagatttgttgtttacttttttgtgtggtcagagttgtttcatgtcttcaaatacatgccaaggatcatttactttcagcccacttcataaaaatctttgaactctt

SEQ ID NO: 1812 - protein, 654 aa, Homo sapiens
MVRPVAVAAAVAEASLGDGSHGPGPEDRAPARHRPPTPGCDFSSPVPGDHPSLGDCWTLFHHLSGAARPLADHPSGGGTHFDHLSGADQTRADHPFDDHWPGADHPCSDHRTGAHDSPDPDPRSPQQQQQQRPPHPTCHRGPLFASSRMAQVKLELSCVMLPVTAVMVLLRTGLNRRHFKKANAKMEIPKTAIVQFWLVISQIRQRSSCYSTIDPTRFEYVFQLDYILQLKSKYLPLTQPVMNLRVSEAVKTEYVCNCSVVGSLNVNRCNQTTGQCECRPGYQGLHCETCKEGFYLNYTSGLCQPCDCSPHGALSIPCNSSGKCQCKVGVIGSICDRCQDGYYGFSKNGCLPCQCNNRSASCDALTGACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFNIIILTVIIIVVVLLMGFVGAVYMYREYQNRKLNAPFWTIELKEDNISFSSYHDSIPNADVSGLLEDDGNEVAPNGQLTLTTPIHNYKA

SEQ ID NO: 1813 - DNA, 24607 bp, Mus musculus
  misc_feature (1)...(24607): n = A,T,C or G
gtgctgttgtaggctgtgtgtagtgtgtgtgctgttgtaggatgtgtctgtgtgtagtgtgtgtgctgttgtaggctgtgtctgtgtgtagtgtgtgtgctgttgtaggctgtgtctgtgtgtagtgtgtgtgctgttgtaggctgtgtctgtgtgtagtgtgtgtgctgttgtaggctgtgtctgtgtgcagtgtgtgtgctgttgtaggctgtgtctgtgtgcagttttatcagatcttaccattgaagactacagaaggtctgagcatgaaataacagccacaatgtgacattggtataaagcattacagagatagatgaagctaaggatattttctgatcctctgtactttggtatcaccttatgacagacgtggccctgaaccacacgccaaagtaaacatttcctgggtggtttttgtcaaagctatttatcacagcaacagagaaacaaccagcctactgcacatgatctgggtcctcatactacccacactgtctaacaaagctacaaattgatgctgccatgatcccactctcagctttaataataattggaagagctgggagctctggaaaacatgttacttttatgtccgttatatctcataaaggatacaccgcaggaacacgcccttattaaagagataataaagtaagaagaggtggacactatggcacatgcctaggatcccaacactgctgaagcagaaggattacgaacctgaggtaaacctgtgtgacgcagcaagacctggagaaaaacatggggctgcagagataactcagcagttagggaacctgccattcttgagaaagcagggcccactgctgcccacagctgcctgtaactccagccttagagaccaaccctcttctgacccccattagcaccaggcgtgtgtacggtacacatacacacatgcaaggcaaaacattcgtgcacataaaatagaaataaatcttttttttttaaagatttatttatttattatatgtaagtacattgtagctgtcttcagacactccagaagagggagtcagatatcgttacggatggttgtgagccaccatgtggttgctgggatttgaactccggaccttcggaagagcagtcaggtgctcttacccactgagccatctcaccagcccagaaataaatcttaagtgctgttggggccagggtatcacttagtggtagtgtctgtgctctgcatggtgaaagccttggttctgatacctagcatgcatccccttatctggtagcattacatatcttagcttgagctgtcacattaaaatacctaggaatgcatgctgtatcagaaacagaaatgtacttccctcggtgctttgagctgtaattccaagatcagcctttgggctgctgtctcctagtatcctcctcagacagaaaggaccaggcaggtgttggcctcttcagtgagggcactcaccaccctatcagggctccaggacaattaggtaggacccagaggttctacctccaacaagcatgatgggattagatgtaaatgtctgagttaaggacaaactcagagcacgcagtttataaaatgatctggtgaaacaacaccagaaagccattgccacattgtttggttttgttgttttgttttgtcttgtttctgtttgttcttttttactttttgagacaaaatttccctatgtgaccctgcatgacctggaactcactaagtagaccagactagcctcaaactcacagacattcaccagcctgattcctaagtgctacaattaaaggtgtgcaccaccacagttggcctgtgtttttggttgtttaaagatagatctgagctagcaacttctgtaagaacattttccccttttaagttgtagcttcctcagaagagtagttgttttttctgagacatagagtctcaccgtgtagcccaggcaaccctcaaactttgtgcccttcttgtgagctaggataatatgcaggcaccagcacacttggcttagaagttaacactgaataggaggaacagcaatatgaactaaccagtatcccccggagcccgtgtctctagctgcatatgtagcagaagatggcctacttggccatcattgggaggagaaacccttagtcttgcaaagattatatgctgcaatataggggaataccagggccaggaagtgggagttgggtgggggggagggtataagtgacttttgagatagcatttgaattgtaaatgaagaaaatatctaaaaaaaaaattgaaaaaaaaggttaacattgacagctctgcaaatttgaggactttctttaatagatgtagttattccactctacaaattaatacattctattaatctgttctaaagtgaggaaacacttcatcaatgtgcaatgagagcttgtctttttttttaagattttatttatttatttcatgtatacactgtagctatcttcagacacaccataagagggcattggatcccattacagatggttgtgagccaccatgtggttgctgggaattgaactcaggacctttggaagagcaatcagtgctcttaaccactgagccatctctccagcccgagagcttgtcttttttttttttttttttaaagatttatttatttatcatatgtaagtgacacaccagaagagggagtcagatctcgttagggatggttgtgagccaccatgtggttgctgggatttgaactctggaccttcggaagagcagtcgggtgctcttacctgctgagccatctcaccagcccccgagagcttgtcttaattagagtttccgttgctgtgaagagacccatggccaaggcaatattataaaagaaagcctttagttggggctggcttatagtttcagaggttcagtccattatcatcatggcaggaaatatggcatcctgctgtggacatgatgctggaaaaggagccaagagtactacatctggatccgaaggcaaccaggagactggcttttgcaggagccaagagtaggttctctcttccatgctctccagcccaagaacacaggtcctaatagtcacttcccatgggccaagcatattcaaacaaccacagagctcaaggcatgtgagttttagatctgcaacctgttcaaggtcaaaagtcagcctcttaagatttcagaccttgtggggctgtgcttcctggagcactaacagtgttgacttcttaggacttgcagatacacagacaactaaccaaatctactaggcatctcacacttaggagagaactgatttctgtagccaatcatccaatggaccataaacacagtcctgctccagatgagggttaaagtatgcgccatgtctgagcctgaacagtagtgagggcaagggcgcttgtcatctgaagctttcctggagaaccatgaaaagacatttgtcctgggccagtgagatggctcagtggttaagagcactgactgctcttccgaaggtcctgagtctgaattctaggaaccacagggtggctcacaaccatctgtaatgagagctgacgaactgacaccctgttctggtgtgtctaaagacagctacagtgtacttgcatataataataaataaaaagtctttgggctggagcaagcagagctggagtgagcagaggtcctgagttcaattcccagcaactacatgatggctcacaatcatctgtacagctacagtgtactcatatacaataaataaatgaatcttaaaaaaaaaaaacctttggcctaagtaggcctcctgtactgatctacttcaatgctcttgacagtgagtccatccagggtagctaagcatatgctcccagactgatgaagaatcctgttcaagaacatgatacatgctgggcgtggtggcacatgccttctgagttcgaggccagcctggtctacaaagtgagctccaggacagccagggctacacagagaaaccctgtctcgaaaaaacaaaacaaaacaacatgatacacataaacacagaatgaaaacaccaacaattatactggaggagaactgagttagcaccaagagcactggcctctcttccagaggacctgggttcaacccccagcaccaacatggcgactctcacagatgtctatgactctggtctctgtgggcagtgaatacatgcatttcgtgcgtggacatacattcaggcaaacactaatatgcataaagaaaaaaataagtaaaatttaaaagtaaattactctaagtaaaccagctaatttccaaagttgtttttattactttttgttttttgtttttttgttttttttttgaggcagcatctcatgttgcagattacctccaactttctatgtagtccagggtaaccttaaaccctgatcttcctatccatatacactgtagctgtccagcagctacagagaacctgaaagagggggggaggggggctggaaatgaaaaagggcaagagaaggatgaagccaagacaaagatttctgatcaaggctcaaagtttaaatttcagctctgagtttatataggcaaaccccacagacccttcctttgtttcagctggattaagttgcaaagcaagctcagcaggaggtcaacttctcaaagctagaagtaggaagttgcaaacttggcaaggccccgtgctgactcaagactggttgtaaaaccatcagggtttgtttagcatactcagaactgggggaagaatacaccacaccttccaagcacttggacagaactgtatatttttaaaatgtctttttattcctgttgtggcttgaatatgcttggcccaggagaggtactactactattagatgtgaccttgttggaggaagtgtgtcactgtgttggtgggctttgaaggatcctggtgctcaaactctgcccagtgtggaagaatcatcagtctctatcctaactacagtcagatcaagatgcagaaatctctacaatctcagatcaagatgcagctccctctacagcaccacgcctgcctggatgctcccaccttgatgataatggactgaacctctgatcctgtaaaccagcaccgattaaatgttgtcccttataagagttgccttagtcatggtgtctgttcacagcaatggaaaccctaactaagacaatcccatcttttaaagtattaacaaagttcaagttctacttttataactgtatcttacctagagtgttctcttcagcactggttatccaagcatgaagtcctacactagataagacttcattcatgggctggtgagatggatcaatgagtaggacaattatcaccgtgccaggcaacctgagttcaatagttgatcccatgtggtagacagtgagaagaaactcattcaagattcaagatgtcctctgacttccacaagtgcactatggtctgtcatgtgcacatgtacaccacaaaataaatgttaaagagaaagatttaatggtctgatgaggcagctcagttcatactgtggcatagtcatgagggcttaggtggatacttagttcccacaggaaagtgtggtttagctgtgtgcgcctgtaatcctagagtttgggaggcagagaaagctatatccctggttcttgttgacatcacatctagtctagccaaatctacgaggtctaggtttagtgagagactctgtcacaaaaaatcaggtggagagactgaagaagacatccaacaacattgatccctgaccttcacacatgcatatacatgtatgcacaggcacatacaatgtgcacatgtatacacacacatacacaaaaagatttttgaaataatcagggttcttaagaggagctaaacaaatagaaatgatacatattaacaggatttattagatagattagcttacctgatacggcctggggcatccaaaaatgtcttcttcatactgggagactgattagtctacaaagttggatgcctcagaagatgcacctggtgctggagtcctgcatgattcctggagatctggtagtcttcagtctggtagaagcttgaagacactgggttctggtatcagtgaaggattgtggtgtcggccatagcagctgcaacataaatttaacagcgagatgagaaggcactgaggcagaaagcaaagctttttctgcagcaccccttttatctggattactactggaggtgccttcacatttagtgtgggcctttccccaaaacctgattaagaaaacccctcctgccgggcatagtgacacacgcctttaatcccagaatttaggagacagaggcaggcgaatttctgagttcgaggccagcctggtctacagagtgagttccaggacagccagggctatgcagagaaaccctgtctcaaaaaacaaacaaacaaacaaacaaaaaaaaaaaacaaaaaagaaaacccctcctaggagtgatcaaggcttgtctcttaggtggtgtctgattcagtcaaactgacagacaagattaaccttcacaacttccctctatttaaaatgaatgaaaaatgatggggtaaagaaatcagaaatcagggacagtttctccagtgccttttcctttaagagctggggaatggacccagggtctcacactggcagagaatgaatggacccagggtctcacactagcagagaatgagctatctggtcctcgtcccaaagtagagctttaaatttgctacttcagaaaccgctccatacttattctatttcactgattcagaaatacacattttatcatagtaattatcccggaagtctggaaaattaatagacactggctactctctcctcatttctcatctttgcaatcaactgtgtcctacagttgataaaatcaatgccattcattgatgaaatgaacactgctccatgatacagtcaacacgttaaggccagctagacactgcctctatcctaaacgctagtgagctaggactatagttccaacagttcacagcatgaaccttaattaaaactgttctaactatgggctggagaggtggtgccatggctaagatcagttctagcatccacgtggcagctcacagctgtgtgtaattccagatctgggggactctacatcctctctgccctctttaggcaacacacacacacacacacacacacacacacacacacacacacacaggcagacaaactgccaatactaaataagaataaatagatctttagaaatcttaatagcaataaacgtttccctcttttattttggagggtagagttgtactatgtagcccaagctggcctcagacttactaaacagcctaggatggcatcaaatttgtaatcctcctgcctcagctttacaggtgctggcattataggtattttctaccatttacaaagtgacaggcacttctctgggtagagaaagtagacatccatttaacagtaacaatataatgcgtgccctacagattgttttaattttttttcctaagtcacattttaaaaagtgaaaatagattacattaattttataatatatttaacccaatatatctaaaatatcacttcagccaacagtgcttctcccccttgttctttgaccattttatgcatgtgtagaatgcattctgattattcttgctccctaccatttcttatctccctcccacacatcagcttcttctcctccttacaaccctcattcccacattcatgtcttttattttgtgactcactgagtttaactggggctgtctgtgtggccatggggttggagaagtccaccgatgcctggtcagcttgccagcaagcacatataaagagaatgactccccctttctcagtatatgtgtctgtacccattaggtcagcagagaggggcaaggccccagaatcccttccccatcgatgactgacccttgtcagggtcattcatgtgcaagcccagtgcagataaacacagtgactctgaattcaaggttgcagtggctgttgtgcccagaagatggcttctcagccttttccgattactttctcttatattctttctgtgtccttcttcaatgatagtcactaagctctaaaaagaggttagccctcaacagatgtattttctgagaaccttgggcagccaagagtctctgcatagaaaggcttatctgaatatggctaagagtagcatttttttaatgaatataagcatagatattcagaaggcagccaacaaactttaaaatgagaagtgtggcacacaatttgtattttacgattacagcattttccagtttagactggccacattccaatccctcccgtggctgtatctgacatcttggctttagagtgataaatgaacttataactagttagttgcattgcagctatagttctttagggtggggaggcatactttattctttgaagaggcaaactgggcgggggagatcgcatgcctagcattttcagttgtgagttcaaggcccaggactttaaaaaaaggttaaaaatgaagaggttaaaccatattaatttaccagcacagagtggaaaaattaaccttattttaatgatttctgggatcaaaacgaagcatgtattttcacctggtgtctttcaaggatctttccatagcaatatatgtggcgctttttgattagctgggtaacagacactctataactgatcaatcttcgagggtattggggatagggactcgagctcaggttggcttccaagtgcctacacagctgaggatttggatcactgatcctcctgcctccgctttcccagtgctgggataacaggtctgcactagcactccgggtttgaacgctgtggttgacatcaatgtccaggctccttgaacgctaaggaaagctctttgcaaactgagcgacatggggtccttcaggcagactcgtagcgggctgcatcgtgaccgcggagtccttcaggcaggtgtgcgaccggctaaatcgcggccgcggggtccttcgggcagagcgtggccagctacgtagggcgtgggcggccgggcgggcgcgtgtgcgcaggcgcgcgggccctgactccccgtgctcccgcgcgcttcagtctttcggcggtcggacatggtgagagcaccgtcgctgcggtgcgcggaggcaggggtggtctgggcggtgggtcgggctgcggggcatcgcgggctcgcacagcatggggaacaggcgggcctgcaaggcgatcattcttgtggggcccaggctggcctggagctctccgcaatgcccctgcctcggcctccttaggccatacttggactgccgcttgagctgtgtatggctcagcgttttctgcacttctcgaggcctgggatcttatccgcggaccgtgggcgagccttcctggattgggccgcctgatattttttcttaacatcggggacttgtacgtgcctgtattttgaaggttacatgatcatttacgaatgttgtttcatagttaaacattttaactgggatggaaggaagtcggccttggcccacgccttttaatcctaacactcttggattaaagaagtgaggcagaagcaggtggcctggtctacacagggagttccagaccagacagggcttcatagccgagactctgaataaagtaggaaatttattttggcaatcgctttgacctacttattgggtgagtcttagaatcgaaggtggaatttggagctaatgggtctgattatttagcaaaggggttagcatgtgaagactgtagaaaggtgcgctgaagcctcaaacttgttaagcaagagtgtgtatttctggcataactcaaaagataagcgtcaagattcgggtcaatgatgagctggcatgtattctgaatctaaagttgattataaaccactttagctctagaattactctgagacctgaaagaaaaaaagtactgagatctggctatgtgtgagtctgagatgtcacgatttccggatggtgaatgggatctctgcttttttcttggaagggcacacagcagaaagacgttactatcaagtcagatgcgcctgacaccctgttgctggagaagcatgccgattatattgcttcctatggctcaaagaaagatgattatgtgcgtatgattcttttttctgttgaaaggtttctaagactaacagcaataagtataatacttacttgtataatactaattgagaggcctgatttaaaatgtattataggtgtaccttgtatatcagaggttggtatttgaccacatcagtcatgtgctggtacataaagggcggaagtgcagggctgcaggtagaaggggtttgctcatttctgtctggggtaaaaccttgaaggtcaatgatgtgttggcatgtattatctgaattcgctgatgtgtcataacactttagctctagaattacgctgagaccttgaaaaggttttacctaaacttgatgtaatggtgtgcctggggaaatggccggggaggttgccagcagcaagcaggggtggctgagtttgagaaggcccaagctgtggggggaccctccaaggaggagtcatttgggtaaaagtatttgtgcagcagctctctgtcttagagagcgtggcatttgactgtctttacaacttttcagttagtgggaatcataggcccaaatgtgtggccttcttgccaactgtgcacctggttcttttgggtttggtttggcagcacgccagtgaggccttcacctgaataaatgcttgtgaggtaatgcttcatttggttcccatctttagcgtcatttatctttccgtattcatagacttcatttgtagaatgcaataattgatgcttagtaaacagtaggcatcaatactgcttttggttaattcacctgaggttagcacttggagactaagagtattggctctcaatcttcttgctgctgtgacctttcctaacagttctacgtgttgtggcgatctccgaccatgagataacttttgttgctacttacttcataactagtttcattgttaggaatcagaatgtggggcccaaagggtcggcaaccgccactctaaagccttacgagttgttcacagctgacttaggtagaggtgggttatgtaaagtcagagtggcaaatctgagatgcttctcctaggaatactgcatgtctgaatacctgagaatgagcggcgtctattggggcctgactgtgatggacctcatgggacagcttcatcgcatgaaccgagaagaaatcctggtgtttatcaagtcgtgccagcatgagtgtgggggaataagtgctagcattgggcacgacccccaccttctgtacacgctcagtgctgtccaggtgagcccttgtgaaaccttgccacttgctgtgaccacccaaaggctacttcccacaggtcagtgatgtcatggcatgtattagctgaatgctaacctgatgcaagttacaaatgacactgagaccttggaaggtgaactccttgtgtatgttaattgaagcacagtccagttcaaatttggtttcaatgaagagccagaggatagttaaagccctacctgtttcttaccttatcaagggaacaagaagtttatagtaagcttgagagggcctggtgggtgactctgatccaggacaaacctgtgacacccgcttgtctttcagattcttactctgtatgacagtgttcatgttatcaacgtagataaggtcgtggcctatgttcagagcctacagaaagaagatggctcctttgctggagacatttggggtaagaccagattgcagtttttgtcagctactcctactcagaatatcttttgtcttggtggtagtaatcataagatttcaagttgttccgtcttttcaggtcccactaagcagttggtctaactggaataaaatggcctgctggaagtcccagcatgccccgtgctggcttgtcagcacaccacactaaaagataaggtaggttcaagttttatctccaataataattaacttccctgaaggtaaagacctggggaggtctctaaacgtttgtcaaattagtaaatatcttgagttgggagatggaaatttttcctttgattaatttagataatctgggggggaacaaaatgcagtcctgagaccagctgctttgtgggatgtgaaccttttttaaagcagggctttgattatgttactaaattactagcccgaatggggggcgaggcatatactcctgccattttataggttcctttcttttctgggcccttgcaagctactaggctattgctttctatttgcctagctggtttcctcagaagttgggggactgcctcctagtgagcatagtcagtcttgactttggggagtttaatgggttttgttcttaggtgacttggtagcacttacatgtctgccttggctctttttgtcttttaggagaaattgatacaagattctcattttgtgcggtggcaactttggctcttttggtaagctttgactgttgcattaaaggaccgaattaaacacttgagtactaggtagctgtaataggctgcttcctttctcgtcatagggcaagcttgatgctattaatgtggaaaaggcgattgagtttgttttgtcctgcatgaactttgatggtggatttgggtgcagaccaggctctgaatctcacgctgggcaggtaattttgcaattaaagtttataggggttttgtgttgtgaatggccacaccttctcactgagttttgtgtatatgctgggtctacacaacttcaccctaagtaaacaccagtgctccttattggcatttgtctgtttatgtggggtctgcattctgtgctgttaactgacctcgaggcttactgtgtgtgtagtccaggctgtcctcggggcttgctacgtgctgggattggaggcatgaccctgaccttattcgtacagatgaactaaccttacccagtgcagagaacattgtgcataagtatagcattccactgtcgcattgaacctactaatacaacctgagataacaaagatggagctttagtaattttggtagtgtctgtcatttactgttaaactatacctgtgtactttatgtctgtaattttagatctattgttgcacaggattcctggccataactagtcagttgcaccaagtgaactccgacctacttggttggtggctttgtgagcggcagttgccctcaggcggactcaatggaagacccgagaaggtattatctatagtggctctttatgcattcatggtgctgtgtgcttagaactgaggggtttctcaggtatagttttaagatcccttaaggagagagcttggggtctcattgactctgaattcatttctgccttgggacatgtacagatactcaaaagcgatactgaggttgggggtggccctgcttttagtttaacctaatcgcctgggaggcacaggcaagaagtcttagtttgaagctagccagctctattagggggacctagtcaataaattaaaatggattgtgaacacttcaaatgttgctagtctgagctccagatctataattagttactgtgtggagcttgctttgtgagaaaggcagagagaattattagtatgtgctggaattattagtgtagctagctacagtgctgaggtggtgtgagagacaaatgggaggtagtctctgtttgccctacaatcatgtctgggaacacgggattagacattaaaaaaaaaaagaatccatcaaatctgagagaatacaatggtgcagtagaggcagctgtcttactggctcccccttccccttctctagttaccagatgtgtgctattcatggtgggtgttggcctccctaaagatcatcgggagacttcattggattgacagagaaaagcttcgaagtttcatcttagcgtgtcaagatgaagagacgggaggatttgcagacagaccaggagatatggtcagtacaattctggctttgcagtttttcattgttgattgactttcatggttataggcatttctaatgcactaaaaatagtgccctgtaagaaatagtccaaaggttgtcttgggggtttaccttgggtgtttttttaaaatgtgttagttacaaaggctagagctgatagaaatatcttgtagtgataattgtttatgtctagtattagaaatacttgtcttcagaaaacttttaaagtggtattcaagatacacttcactgtggacagatagataattgagccttttccatgtttgtgaacttcccacaggtggatccctttcataccttatttggcattgctgggttgtcacttctgggagaagagcagatcaagcctgttagccctgtcttctgtatgccagaagaggtgcttcagagggtgaatgtccagcctgagctagtgagctagtcagatgggagagatgctgtagtgtgcaatatgaattactgctgtatttgaagtgtttatcaaacctagacgtgacttaatattttgtatatcatatgttaatgataaattatataagtattgtaaaataaatatgttgtatttagatctttagtcttctgagtccagtttttgttagtcctatttagagctggtatttaactgatgcctccccgtgtcctattgtcgtgtaacaatcaatgatggaaagtgatttctgttaataaaactgatgagtgaaactcataatttaaataaaggtcaaaatcagtggctgttgtgtatatagctttttatttagaactgaaccattttgtaagtgtgaacaccttatttatagttggggcagagggtacagtacatttttcagggaactctagtctgctgttggcttggatttctcaggcatgcagttgagttagccaggatcctgaaagtcatccccaaagaattggtccactccataatggctttaggtgttgtttcgtgatgggggccctgtgaggtgttaatgtctcaagggtttgaatgtggttactctgggtgggttgcaggttgggtgaatagtaatggtataaatgtaattttgactctagtctatagccgctcctgggtcagttactagagaggtaacttactattaaggacctctaccccttaatatttaaggaaggaaacgtctcccctctttgagagtcctacattgcactggaactccacatctttaataggtatctccaagtgtgttttatgtctcctgattgttgcttaagcattgctgtcaccttgaggctacacataactaatatcgtctacatgtccttagtgttctatttctgtaaagacatgctgtgaccagcaaagcgactcttgaaatttagggcttgcttaaagagtttcaaaggtttagtcaattaggagggcaggcctgcagacatgttccttgaagaccacacctacttaaaacaagctgcttccctcaagttttctacaggggcttttcctgctcaaactacactcactacacactagtgtttgcaggtactagtgtgaatgccctatttgctggagaacatttatcctcagttctgtcacctagaagatgttttatgtgttgattgttgaagagcttcccaagggtttcgagcaagactgtagtttgtttttaccctatgtgcaaaactgcagtactcgaaataggacggttgagaagtgctgtttttaattgttaatgtggtctcacccgtgttgtgctctgtcccgtactatgctatgtgtacaactgagcgaagactttcattcttagacattgggcacatgctgtgtactgggggtgtaactggggcgtattaaatatgcaataccctggctcagtcctcagaaagcccccctccttcaaaatgaactgttgacaacctaggtggttagtgggctataaattgttgagcctggtacctaaggagtgaagaggcttacagcttccagaatcacgtgatgagaataaaccggcacaaccctggacgcaaaggtgagaaactcgctgctcacccctgaactgcgcctgcgctgtgtgcatcatgtgctgcttgttcctgcgcctgcgcgattacagcactgcgcatgcgcttagcctcccgccttgtcagcggtgcggcctccagccttggagtgctcgaagccacgcgcgcagaaccttgggagtcagaaaggccggagagatgctgaggcaggaggctgcatcgctttccagttccccacgctggacgccgtcgcggagggatgccccatgcgggaggaccctggcctccgcgtccaggccgagtacggaaggcgccatggccgacaggagcagcagcagcagcagcagtccggcgccggcgtccgcgccaggcaaggccccggctcacctggtcacctccccgggcgggcgctgccctcggcgccctgctggagaaagcagtctggccaggattccacagtcactcatgctgggagtggtttgtgtctttaatcccaacactggcgactacgcttcaaggccagcctgggcaacacaatttcaaaccaatcaaaacacaggggagaaagtcttgactcttcacaacggtctcattaagacgtgagaggaagggtaacccatctagtattcccatgtaaagccttaacttcatgtttcgttttaaaaggcaggttttctatggctcaggctgtcctgaagctcttctgtcctgaagttcaggaaagcctggctggagactcctagcaatcctcttgccttagcctcttgagtactgaattataccaccatggctggcctttaactttttttcctaaaaaaaaaaaaaaagtttccctttttcccctctatgagtatatgagtgtgcaaggggtggatgtagaggtcaaaggacgacttttcggagaaaactccacctccaccaagagggctctgggaatccaactaaggtctgagtcaggcttggtgggtaatgcctctctagtcgttgagtcatcgtgatggtcccctacttcttcaaatatatagtgaatatatgggagattgtgtgtaatagtttctaatagtggagagctgagctttggccgacgggttttactctttaggttctagaatggaatgataacaggttaaagtgaacatcttatcaaggccttgttaaaaataaggccttctgggatcaaatagatggctcgcccgttaagggaagtagctactctttcagaggcttagtgttccaactgccagctcccacatggagactgaccactgtctgtaactctgctgccagagcatctgctgccctcttctggtctccggtgcacagacatgcatactggcaaaacacccgtacacttaggtgaaaaagtccttcagggtgagttcagttcattacaagaacagggttggttgagtgggttttatgagggaagagttggctggatgttgtgagggaagaaatagttaaatcgtgaagtcttctctgttaaatattaggtaaaaagcacttgagggaaaaaagcttaccatgaggatggcctgtctgacagttctgaagtgggaacctggcacagggacctgagcctcgtacaagacagacccacttatgtagacatgggtggtatatgatcttgagtatttaatgaatgtgtgctgttttctaccagatgaagatcaggagtctcccctaattgctctctgccttatcctttacaggcaatctctgtggtaggaaggccctgtgccctgattgttagatgggtaacaagcttggatctggactctgttgcatgactgtacagcaggcgctcttaaccgctgagccgcatctccaacatcttaacttttaagtttttcttagagataaggtctctgtatgtaacgcttgctgtcctggaactggcgatgtggaccaggctggcctcgaactcacagtgcttgttttgctattgttgttgttttgttgcttcttttgttatttcaaggcagagtttattctgtattccggaagtcagaggtccacctgcctctgcctcctcggtgctgggattaaaggcgtgaggaactgagggttgagaaaaatgtaaaagattatttcctggcatatgtcattcaaattccaatatatagaaattattttgaaaaactatagctgttttcattgatttatacactacctaggctgaacccctatttcactgccagagttgagcccctgccagtgactgtgtggcccacaaagcctagacatttgccctctgctgcaactggaatgttctcaacttgtgtagtgtgttagatgagtgaaggctgtaaatgaaagcctgaagtcatcaggaaatgaatgtcagcgggtgaccaagcccacacaatcagtcaacaggttctccagtgcgagagtgaggattaaaaaggaaaaaaaaaaaaaaaaagacacaacattgtagcatgaccctagtcaattctgagactgaagattcaattcactttttttttcttgagacagggtttctctgtatagccctggctgtcccggaactcactctgtagaccaggctggcctcgaactcagaaatcggcctgcctctgcctcccaagtgctgggattaaaggcgtgctgcccggctcaatccactttttataccattttaactacattcaagtattttgggtgagcagtacaataaggaactagcaaggcagcaagcgaagtcctgtgatcactctccctacagttgtttaaaagggattgttagagccgggcatggtggcacacacctttaatcccagcacttgggaggcagaggcaggccgatttctgagttggaggccagcctggtctacagagtgagttccgggacagccagggctacacagagaaaccctgtctcgagaaaaaaaaaaaaaaaaaggaattgtcagagtcagagtgaccaaaatacttgagcccacttccttgtccaagccccaaatcttgcctgaagcctagttcttctcttccaccctaagattaaaattcctgccttaccctacttccctattacagcctaaagttatattcttgctgaaacttacttccttatcatgccctaatgtcagattcctgcctgagcttacttcctcgtcatggccaatgtcagattcctgcctgaagcccatttccttgtccttggccaatgtcagactcctgccaagtggcaccccaaaaagctctccacaggcgggaacagggataacagatgagaggccagggaaaataaaatgtccatgtagtagtgaagttttaaaagcatggaacactgtaggccagcacttaaggcagaggaaaagggcttggtccaggaagctgtggatagtgtaaagagggctcagacaaacgatgtggaagtcaagggtgtggaaaagccctgttttttcatttgcttgtttgtctgtttggaacttctgtgttagcagacactgtgctaggctatttatgtacactgtatgaaatgttatgacgtgactgtgaagtaggtagcatgttggtaagcaaccctctgaaaaagtgcagagtctgaagctgagacttcataacaccatttacataggaagaggcgttcagatgagggagttgatgaaggaaaagacacttaattatagtataaactacacctggtgactgaaaggacccttctaattttagcaagagtttcagtgaactcatacactcaagacccctatcagaatatctctttaataaattaacttactttgaagcaaaatcccatgtgtctcaggctggtctcggctcattctttaggtgagggtaaccttgaacttgtgaacccctttcctgcatctctcaagtagtgagttcacttggtttatgtatgctggggatgaaacccagagcctcatccataccagacaagcactctacccactaggccacacccccagcccttatcagcaggtgctggtacatgattatcaagccaggtgtggtggtacatgcctgtaattccagcactcaggagactgaggaaagagaatcataaagtggaggcaagtctgggctacacagtgagttcaactccaccctgagattcatagtgagatttgccttaaaaataacaaacacaaattatcactaataaaaaaatacatgagagtagaggggaatcctttgggacaaggaaggggtcagagtaggaggggccaagagaggataataatggaggttggatatgatcaagatacaatatatacacacacggaaatgttacaatggagccacgtataataatgcatactaatacggttattatgaataaaattgccaataatcatttacattattataattttaaaattaatcagattaaattttatagacaatatataaattttagaaattaatatataattccttaatgctaatcattaagaattaatcataaaatttcaaacttaggttcatcatttggaaacaaaagatcttatgctatacacagagctgcatccagttttcctgttggtacaagctcatcttctgcacgagataccacttacccacatacatttagaactccgttatctgctggaaatccccagagatcagggcataaaagttggacaccacaagtaggatattcaggtaaaactgatgatcttttaaaatgttttaaagtttcataaattaaaaattgggtggttagctcatttgaggttcatctaccactgatagaaaggatggaaaggtgcatatatcactgacccctgtgcacctcagggcaggctaacatgcctatgagatttccattcttgtttgttaataaatgcaaccttgtgttatttgaacctttctgacccaggagggaaatctctctcatgtgatgcttaagtgaaaaacttgaccctaagagtactccctaaccctaaccgtgagtgctttcctactactgagttttaaactaaatgtactcaattttgctgaggggtcagtgagtgtgtattttgtgtgcaccagtttcctaagacatatataagattacgtcctggctacatgatgtgtaaatgtgcctgacttttcctgggaaggtaagaacaaacgtctgttcaccccagatactaagaacagaccaaagaaacgaccccacccaagtctagcttgggaaccctgagatgtggggcaggagcatgggtaactcggagcagctgcttctcagaacagctcccccagccatggctgagagctgtggtcctgaagttccctggccggcctgcagacgctgcacctcaccttgcttcctcccaaggaaagtgctctgtctgtgctacctgaggagagatggagtctctctccagaaggagggcttaacacctacctagcatgtgtgcatacgctttaagatgctgggtggttgtgtgtgtgtgtgtgtgtgtctgtgtgtgtgtgtgtgtggttttgatgatcgttgagaccagacctttctgtgtaggcttggctgtcctggaattcattccatagatgaggctggccttgaactcaaagatcctcccacctctgcttcctgagtactgggttaaaggtgtgaaccctcatgcttagccttttaaaaaaagtgtgtagtgacatatgatggcatctcaggggagacgtactgcatatgtgacagtagcaccatcactgttataatggaggtgaatattcttctggcctagtattgtcgttatatgttttaagaatcttcacatgtgccggacatggtgtcgcacgcctttaatcccagcactcaggaggcagaagcaggtggatttctgagttcgaggccagcctgttctacaaagtgagttccaggacagccagggctacacagagaaaccctgtctcaagaaacaaaacaacaaacaaacaaacaaaagaatctttacatgtgttagatagcaaacacccagtcaccatctcagtagtgtcacctgctgggggccaactcttccgttcacatccaaccacaacactcttaggatctttatggttattgtacttttagaaattacactatacatatatatatgtgtgtgtgtgtgtgtgtgtgtagttatatatatagtgttttacatctataatgttatatatatgtgtgtgtgtgtgtagttatatatatagtgttttacatctgtaatgttttatatatgtgtgtgtgtgtgtgtagttatatatatagtgttttacatctataatgttttatatatatgtgtgtgtgtgtgtagttatatatatagtgttttacatctgtaatgttttatatatatgtgtatacacacacacacatatttgttttgtgttcatttattccactcatttttctggagctcctacaccaaatactacaaacatttactgtcttatctgaggcctctctgcttgtctcactcttagccattttttctagtctcttcctacagtctctgtgtgccctaaacttctcacatttgtgtgccagtcataagggcactcaaatggcctcagtaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaggctcttacacatggtatgcactctgctaccactgagctaatctctcagtcttcttgaaaataagttgagcaaagagaagtatatatttgatagagttttataacagttaaataagtgtaagtaaataacttactatgcccttgacacatgataagcgtttggtgactgttggtgcccatagctgtgcactcacaggtgcacagtgcattgatttgctgcttgtagccagctcttgagttcaacattatgcttttcactttaaaattccttttttttttggattttcgagataaagttacttattatgagatcattttagcaaacaatatgtgttgttggtttgtttttttggggtttttttttttttttggtttgtttgcttttcgagacagggtttctctgtatagcctcactctgtacaccagggtggcctcgaacttagaaatccgcctgcctctgcctcccaagtgctgggactaaaggcatgcaccaccacactctgctgaacaatatgtattttaacaccaaactcaaaattcccttaatgactttattttaataaaattcaaaataaaagtcaggtgatggtggcacatgcctttgattctagcacttgggaagcagaggcacgtggatctctgagcttgagtccagcctggtctacagagcaagctccaggagagctagcactacacagataaatcctatgtcaaaaaacaaaacaaaacaaaaaacccaccaccaacaacaaaaaccaatcaaacaaatttcaaaataaaacactataaatttatcatctatgtgtaaaattaaggcttggcatgggacctcagcccaggaactagaaacctgtagtcagatgtatggacagctacctctgagtttgctaagacctcatcactggcatacagcatttggtagtgtatgcctgtaatcttagaacttcttcggagggagaggcaggaagattgccacaagtcagaggccagtctgatcttctcagcaagttctgggtagccaaggatacacatcctatctcagagttaaggcaaatggaagatccttagagtgaagttaagttttgacccagcactgagctttaatcatcttatttgttttggaaaatgaagtttttattttttaaaataaagattcccttcggatgttattaactagacaaggcacctaccttataagagctgcagaaggtcaaggcagcgagcatgagtcaccacctgaaggcagcactaatggggctcaggaaacaaaggagaggatgtgattgtggaaggagatgggagtgggagtgttcctggagtgagacagggcggggcacgtgggtgtgagccagataaattgtgtgcatgtatggatgacattattaaagaataaacagaggatataagaaccactagacttaggactttgcatatagcttccatgaaggagctatatgcaaccagtaacattcatatgtgttcttcatgccacctgtctccagccacatcctctgcggtgtctgcacacgccccatcagtcattgtagcggtggtggaaggaagagggctggccataggcgagataggaatggcaagcattgatttaaaaagcccacagattatgttgtcacagtttgcaggccaatacaacatatgcaaaggtaagctgtttttgcaacttgtaaatttgaagtaattctagatccacacaaagac

SEQ ID NO: 1814 - DNA, 1171 bp, Mus musculus
atgggatctctgcttttttcttggaagggcacacagcagaaagacgttactatcaagtcagatgcgcctgacaccctgttgctggagaagcatgccgattatattgcttcctatggctcaaagaaagatgattatgaatactgcatgtctgaatacctgagaatgagcggcgtctattggggcctgactgtgatggacctcatgggacagcttcatcgcatgaaccgagaagaaatcctggtgtttatcaagtcgtgccagcatgagtgtgggggaataagtgctagcattgggcacgacccccaccttctgtacacgctcagtgctgtccagattcttactctgtatgacagtgttcatgttatcaacgtagataaggtcgtggcctatgttcagagcctacagaaagaagatggctcctttgctggagacatttggggagaaattgatacaagattctcattttgtgcggtggcaactttggctcttttgggcaagcttgatgctattaatgtggaaaaggcgattgagtttgttttgtcctgcatgaactttgatggtggatttgggtgcagaccaggctctgaatctcacgctgggcagatctattgttgcacaggattcctggccataactagtcagttgcaccaagtgaactccgacctacttggttggtggctttgtgagcggcagttgccctcaggcggactcaatggaagacccgagaagttaccagatgtgtgctattcatggtgggtgttggcctccctaaagatcatcgggagacttcattggattgacagagaaaagcttcgaagtttcatcttagcgtgtcaagatgaagagacgggaggatttgcagacagaccaggagatatggtggatccctttcataccttatttggcattgctgggttgtcacttctgggagaagagcagatcaagcctgttagccctgtcttctgtatgccagaagaggtgcttcagagggtgaatgtccagcctgagctagtgagctagtcagatgggagagatgctgtagtgtgcaatatgaattactgctgtatttgaagtgtttatcaaacctagacgtgacttaatattttgtatatcatatgttaatgataaattatataagtattgtaaaataaatatgttgtatttagatctt

SEQ ID NO: 1815 - protein, 339 aa, Mus musculus
MGSLLFSWKGTQQKDVTIKSDAPDTLLLEKHADYIASYGSKKDDYEYCMSEYLRMSGVYWGLTVMDLMGQLHRMNREEILVFIKSCQHECGGISASIGHDPHLLYTLSAVQILTLYDSVHVINVDKVVAYVQSLQKEDGSFAGDIWGEIDTRFSFCAVATLALLGKLDAINVEKAIEFVLSCMNFDGGFGCRPGSESHAGQIYCCTGFLAITSQLHQVNSDLLGWWLCERQLPSGGLNGRPEKLPDVCYSWWVLASLKIIGRLHWIDREKLRSFILACQDEETGGFADRPGDMVDPFHTLFGIAGLSLLGEEQIKPVSPVFCMPEEVLQRVNVQPELVS

SEQ ID NO: 1816 - DNA, 27317 bp, Homo sapiens
tgcacaaaccaaaacagctgtagtacacacagcatatccgaattctgtggaaagctagtaaaaggcatacaggcgtttcttttttgaaagtaacttccagccgttccaagacagccgaataggaatagctctggtctgcatctcccagtgtgatccatgcagaagacgggtgatttctgcatttccaactgaggtacatggttcatctgagtgggactgcttggacagtgggtgcagcccatggagggtgagctgaagcaaggtgggtggggcatcgcctcaccaaggaagcgcaaggggttgggggatttccctttcctagcaaagggaagctgtgacagactgcacctggaaaaatgggacactcccacccaaataccaggcttttccaatggtcttagcaaacagcacatcaggagattatatcccgtgcctggcttggcaggtcccatgcccatggagccttgctcactgctagtgcagcagcctgagatgaacctgagaggcagcagcctggcaggggaaagggcatctgccattgctgaggcttgagtaggtaaacaaagcagcctaaaaagctcgaactggacggagcccactgcagctcagcaaggcctgctgcctttgtagactccacctctgagggcagggcatagctgaacaaaaggcagcagaaacttctgcagacttaaacatccctgtctgacagctctgaagagagcagtggttctcacagcacggagtttgagctctgagaatggacagactgcctcctcaagcaggtccctgacccccgtgtagcctaactgggagagacctcccagtaggggctgactgacacctcatataggtgggtatccctctgggatgaagcttccacaggaaggatcaggcagtaatatttgctgttctgcaatatttgcggttctgcagcctccactggtgatacccaggaaaacagagtctggagtggacctccagcaaactccaacagacctgcagctgagggacctgactgttagaaggaaaactaacaaacagaaaggaatagcatcaacatcaacaaaaaggacatacacaccaaaaccccatctgtaggtcaccaacatcaaagaccaaaggtagataaaaccacaaagatggggagaaaccagagcagaaaatctgaaaattctaaaaatcagagcgtctcttttctgaaggatcacagctccttgccagcaacagaacaaagttggatggagaatgactttcacaagctgacagaagtaggcttcagaaggttgggaataacaaacttctctgaactaaaagaggatgtttgaacccatcagaaggaagctaaaaaccttgaaaaaagattagacaaatgactaactaaaataaacagtgtagagaagaccttaaatgacctgatggagctgaaaaccatggcacgagaactatgtgaggcatgcacaaacttaaatagccgattcgatcaagtggaagaaagcgtattagtgattgaagatcaaattaatgaaataaagcgagaaaagaagtttagagaaaaaagagtaaaaagaaacaaacaaagcctccaagaaatatgggactatgtgaaaagaccaaatctacgtttgattagtatacctgaaaatcacggggagaatggaaccaagttggaaaacactcttcaggatattatccaggagaacttccccaacctagcaaggcaggccaacattcaaattcaggaaatacagagaacaccagaaggatactcctcaagaagagcaactccaaaacacataattgtcagattcaccaaggttgaaatgaaggaaaaaatgttaagggcaaccagagagaaaggtcaggttacccacaaagggaagcccatcagactaacagtggatctcccagcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattctgtcaccacaaggcctgccttacaagagctcctgaagaaagcactaaacatggaaaggaacaaccagtaccaaccactgcaaaaacatgccaaattgtaaagaacatcaatgctaggaagaaacggcattaactaacaggcaagataaacagctaacatcataatgacaggatcaaattcacacataacaatattagccttaaacgtaaataggctaaatgccccaattaaaagacacagactggtaaattggataaagagtcaaaacccatcagtgtgctgtattcaggagacccatctcacacataggctcaaaataaagcgatggaggaagatctaccaagcaaatggaaagcaaaaaaaagcatgcattacaatcctagtcactgataaaacagactttaaaccaacagacatcaagagagacaaagaaggccattcaatggtaaagggatctattcaataagaagagctaactatcctaaatataagtgcacccaacacaggagcacccagattcataaagcaagtctttaaagaactacaaagagacttagactcccacacaataataatgggagactttaacaccccattgtaaacatttagacagatcaacgagacagaaggttaacaaggatatccaggacttgaactcagctctgcaccaagcagacctaatagacatctacagaactctccaccccaaatcaacagaatatacattcttcgctggtaccacatcacacttattccaaaactgaccacatagttggaagtaaagcactcgtcagcaaatgtgaatgaacagaaatcacaacaaactgcctctcagaccacagtgcaatcaaattagaactcaggattaagaaactcactcaaaaccacacaactacgtggaaactgaacatcctgctcctgaatgactactaggtaaataacgaaatgaaggcagaaataaagatgttctttgaaaccaatgagaacaaagacacaatgtaccaaattctctgggaaacatttaaagcagtgtgtagagggaaatttatagcactaaatgcccacaggaggaagcaggaaagatctaaaatcgacaccctaatgtcacaattaaaagaactagagaagcaagatcaaacacagtcaaaagctagcataaggcaagaaataactaagatcacagcagaactgaaggagatagagacccaaaacaccctccaaaaaaaatcgatgaatccaggagctgtttttttgaaaacatcaacaaaattgatagaccactagcaagactaataaagaagaaaagagagaagaatcaaatagatgcaattaaaaaagatgaagtggatatcaccaccgatcccacaaaaatacaaactaccatcagagaatactataaacacctctacgcaaataaactagaaaatctagaagaaatggataaattcctggacatatacagccttccaagactaaaccaggaagaagttgaatatctgaatagaccaataacaggctctgaaattaaggcaataattaacagcctaccaaccaaaaaaagtccaggaccagttggattcacagccgaattctaccagaggtacaaagaggagctggtgccattccttctgaaactattccaaacaatagaaaaagaaggaatcctcaactgattttatgagggcagcatcatcctgataccaaagcctggcagacacacaacaaaaagagaattttagaccaatttccttgatgaacatggaagaaaaatcttcaataaaatactggcaaaccgaatccagcaacacatcaaaaaggttatccaccacgatctaataggctttatccctgggatgcaagtcttgaatcaataaatgtaatccatcacataaacagaaccaaggacataaactcatgattatctcaatagatgcagaaaaggccttcggcaaaattcaacagcccttcatgctaaaaactctcaataaactaggtattgatggaatgtatctcaaaataataagagctatctatgacaaacccacagccaatatcatactgaatgggcaaaaactggaagcatcccctttgagaactggcacaagacagggatgccatcactcaccactcctatttaacatagtgttggaagttctggccagggcaatcaggcaggagaaggacataaagggtattcaattaggaaaagaggaagtcaaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcctaaacaccaataacagacaaacagagagccaacttatgagtgaactcccattcacaattgcttcaaagagaataaaatacctagaatccaacttacaagggatgtgaaggacctcttcaaggagaaccacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctactaatgactttcttcacagaactggaaaaaactactttaaagttcatatggaaccaaaaaagagcccacattgccaagtcaatcttgagccaaaagaacaaagctgcaggcatcatgctacctgacttcaaactatactacaaggctacggtaaccaaaacagcatggtactggtaccaaaacagaaatatagaccaatggaacagaacagagccctcagaaataatgccacatatctacaactatctgatctttgacaaacctgacaaaaacaagcaatggggaaaggattccctatttaataaatggtgctaggaaaactggctagatatatgtagaaagctgaaagtggatcccttccttacaccttatacaaaaatgaattcaagatggattaaagacttaaatgttagacctaaaaccataaaaaccctagaagaaaacctaggtaatactattcaggacataggcatgggcaaggacttcatgtctaaaacaccaaaagcaatggcagcaaaagccaaaattgacaaatgggatctaattaaactcaagagcttctgcacagcaaaagaaactaccatcacagtgaacaggcaacctacagaatgggacaaaatttttgcaacctactcgacaaaatgtttgcaacctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccataacgagataccatctcacaccagttagaatggcaatcattaaaaagtcaggaaacaacaggtgctggagaggatgtggagaaataggaacacttttactgttggtgggactgtaaactagttcaaccattgtggaagtcagtgtggcaattcctcagggatctagaactagaaataccatttgacccaggcatcctattactaggtatatacacaaaggattataaatcatgatggtataaagacacatgcacacgtatgtttattgcggcactattcacaatagcaaagacttggaaccaacccaaatgtccaacaatgatagactggattaagaaaatgtggcacatatacaccatggaatactatgcagccataagaaaggatgagttcatgtcctttgtagggacatggatgaagctggaaaccatcattctgagcaaactatcgcaaggacaaaaaaccaaacaccccatgttctcactcacaggtgggaattgaacaatgagaacacagggacacacgaaggggaacatcacacaccggccacggttgtggggtcgggggaagggggatggatagcattaggtgatatacctaatgctaaatgacgagttaatgggtgcagcacaccaacatggcacatgtatacatatgtaacaaacctgcacgttgtgcacatgtaccgtaaaacttaaataataataaaaaaaatcaaaataaaatagaagttgaagaaaaggaagaaaaacaaagtcaggaaacaacagaagctggataagatgtggagaaataggaacacttttacattgttggtgggagtgtaaagtagttcaaccactgtggaagacagtgttgtgattcctcaaggatctagaactagaaatagcatttgacccagtgatcccattacggggtatatacccaaagattataaacacacatgcacacgtatgtttattgggcactattcacaatagcaaagacttggatccaactcaaatgtcatcaacgatagagtggattaagaaaatgtggcacatatacaccatggaatactatgcaaccataaaaaaggatgagttcatgtcctttgtggggtcatggatgaagctggaaaccattattctgagcaaagtatcacaaggatagaaaaccaaacaccgcatattctcactcataggtgggaattgaagaatgagaatacctggacacagggcagggaacatcacacacaggggcctgtcatggtgttgggggaggggggaaggatagcattaggagaaatacctaatttaaatgatgagttaatgggtgcagcaatccaacctggcacatgtatatccatgtaacaaacctgcacgttgtacacatgtaccctagaacttacagtataatttttttaaaaaaagtaacttccaatatttttactattagcactctccgaagaagtgtttgtggtggcggtggtggtggtggggagggtggcctgtgtgtgtggcgaggagagggggcgggtacagggctggaccttgagatagataaggcaaacaggaaggaaatgtgaacatttcattaatattcatttaaaaaatattcattgaacacttactacgtgtaagcaggcactctactaattaacagccatttcagattttcagagtgcaaagggcctcaagaacaaatgatttatttttttgagacatggtctcgttctgtctcacaccctgcagtgcagtggcattatcaccgctcactgtagcctccaccccctgccccacagctcaagtaattctctcacctcagcttccccagtagctgaaaccacaggcttgggcaaccacgtctggctcatatttttattatttgtagagacgggggtcttgcaacattgcccaggctggtctggatctcctggaaccccctttgcaaaattataactgaggaaattatggcagtgaaagaaatcagacctaacggattccatcttgcttctaacttttgtttttgagactagtctcgctctgtcgcccagggtggagtgcagtggcgtgatctctgctcactgcaagctccgcctcccgggtttaagccattctcctgcctcaacctcaggagtagatgggactacaggcgcccacccccacgcccggctaattttttgtatttgtagtagagacggggttttagccaggatggtctcgatcccctgacctcgtgatccgcccgccttggcctcccaaagtgctgggattacaggcgtgagccaccggccgcttctaacttttaagctgtccttcttcattcctgagcctaggctgaaccaatttagggaggaattcagtttatggtttgactctgaaacaaaattgataatatccctttcccaaaaagaccgcttttttgcctggggaccagtctgcctttgcagaaccaacagattagctacaagattagaaattacagtttagaggtcatgcagcctctggctccaagtttctgaacctccccaaattgctcctggggataacatcactattgtaaaacctaagataagttcttgagatattttgcagaccctgctctccatggatcagttgaaaccacccagattggtaatttggctcaaccagttctgccatcctacccaggaacagaaaacagcaagaaaaactcacgtctacccactatgagtccatctccaacctgacccatcagcactccctacttcccaagcccctaatcgccgaattatctttaaaaactctgaatactgcttggggagactccattgcaagtcccctgtcttgataaatgggctatcggtcagcagcaggcaaagtgaaccacaatattgggtggttacactcctaggatcaagcaatcctgctgtccggcttcccaaagtgctgggattacaggcgtaagccaccgcgtccagctagaacaaatgatttcttaaaagcaactcagatatttaaatattatttaaaactgtttctagacaaatcggagtgactatgggacaagcacatggtcgcaggactttggacgcaggcagtgaggacacctatgagcgatcagtggggtcctacggcacccgtggaactgctctgccttgcaggcgaaagtgtggtcagctatatcggagcgcgatgggggcctgagaggcgcatctgcgcaggcgcccggctcctaagtctacccaggaactgaccctgctctctcctttccctgttagacatggtaagtgtgagtttagcgctgctgtccggatgggttggtagcagacagggtagagtagggttaagcacactggtcaccttaggattggtttcctggtgctggagaatggttaggacacaggccttggaaggttttttgagtgtgaaatattactcagcgttttctgcagacctcgcgggcaatgccgcttctaattttatccaggccttcttctgtagggagggcctgttaagagttgagcagcccgatttctgaacccctctaaaaagctgtggctgattggtggcttttttttttcttggagagggggtgtcaaagatttctttaaaatcgttagtgatgtggtctcgctttaagatttttaatgggatcagaggaaaattcggtacttaatcacttccggtaatcttcatgacctgttatagtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaaggtgctttgaaacctgcatttgattaagcaagaattcgcttgcaagttaagggttagatttttttattttttaaaaatatgctttctgccacatgtaaaccgtaagttgtcctgaaatgataagctttgatattctatggtgtttattttttacttatctttttgaatgaaaagtgaacaacaagaaatgctggtggtaattttttgggtcaatgatgagttggcatgtattctgaatctaaagttgattattactactttagctctagaattactctgagacctgaaaattacctgaatcgtgactaagacgaagcctgaatgatttaagttcttttttgttggatacaatttgttgttgttgttgttgttttggttttgtttttgagtcggtctccggtcgcccaggatggagtgcagtgacacaacctcagttcactgcagccttaatttccctggctcaagcgatcttctacctcagcctccctagttagttacaatttttaaatggaacgttttcctattacaagatgaaatcaagtgaaaattgagatgtatgttgaatctatgctgtggggcagaagaacgttgtagaggtaaacattgatgagattaccactttattttgaaagggcactccacagaaggatgttattatcaagtcagatgcaccggacactttgttattggagaaacatgcagattatatcgcatcctatggctcaaagaaagatgattatgtatgtataatttttttatgttggaaagtttattttaaagaagtgtgacagtcataagcagtgagacagtatttatgtcttaaaatggcatccaactccatgcagagaactgaggatgtgctgtgcctttgaacttcagttaagtgtgctttggacgtctgaggctgtgggcttattagaatctcagtttttacctatactgagagggcttgccagacaaagtagatgagggtttgaggtacaaaacgggtttctctttttgtagttaggggtaatactttcaaggtcaatgatgtgttggcatgtattatctgaatctattgctgatgtgtaataacactttagctctagaattactctgagaccttgaaaaagttttaccttaaatttttaaatttcgaggaaaactctgggacaatcttagcaaaaagtagtaaacaacttagttaagagtaaatgtttttccctgtagtatccaaactcagttgtcttagtctaccgatttgtgggatatatggtatgtattaattttttacttaagtgttaggttcccataaccttgaaaatactctattagcaatcatggagttaaggccatatggatggggctggactcgtttctgcctttatctgctatctatctttatgccctgaatttgggttagtagcaaactaagatgcaccacctgttaaaaaaacttctttttttccttttgagagctataacctcactttgttgcccagactggaggacagcggtgcgatctgggctcactgcagcctccatctcctgggtttaagtgagccacctgaatagctgggattacaggcacattccaccatgcccagctagtttttgtatttttcgtagagactgagttttgctatgttggccagagtggtctcaaactcctgacctcaagtgatctgcctgccccagctttccaaagtgctgggattacaggcaggagccaccacccagccacaaaacttcttaaaatataatgcattgttgagtgtgggaaaaatttgtttctggaatcctaatactaattttcatgtatcattgattagccactgttttatctgggcttaaacatctttggcatgtttagggcattttgatttttcatgtagttatataatttactaatagataataggttttgtacagagtccacattaaaatagatgtctgataaatatggtataggtactcggaaagaaatactctccctgaacttcactgatgaaaaaggtagatgtttttctgtctctggctcatgggagaaactaaagcactgtttgtattgtcagccatagattaactaatcctgtgcttctcagataattgtttttttctgataatagttgtgtctgaagatggcttctaacattgagcagcacagattttaaactcactactgatcagtgctgttaaggtcaggagaggtaaaaatagcagcatggctaatgagttacctttgtgtttaatctctttataacttgttaccagttcaaatgacagatttaagaaattgtgtattattttaggaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccaggtaaatactaatcaaaattgcaacgatcttgatagtatgttctcttacttcagagttggaaattgaaactgtatcaggatttggtcaaaaagttttgttacaagtgaagctgtcctacaaggtcaatgatgtaatggcatgtattagctgaatctaaagttgatgtgagttctaaaattacactgagaccttggagggtaaaatttttatcttcagtatgtgtaaatactgtaaaatagctaaatggagctatttgattttgatattagtgaacatctacctggtggtttaaagtctttctggtactactgggtgctgagatgggaagatcaggactttgtgtggatgtgagttagtatacttgagtatcttggaatgccaagttaaaatttatatgtagaaaattatactttaaagatttgagttttcttgatactatctaattttattcaataacaggagagtctgcatatttgagaaaaggttatatacacagagacaaaaggatgtgcttgacaacttaaaaagagttgagcataagatcattagaataaacctgaaagggacatttacctaatacttgtctttattgcagattcttacgctgtatgacagtattaatgttattgacgtaaataaagttgtggaatatgttaaaggtctacagaaagaagatggttcttttgctggagatatttggggtaatgtcagatttagtccattctacccaaaataccaatattaaaatgtactggttttgctagtaaccagtttataagtttttcatcttttcaggtcccactaagcagctggtctaactggagttaatggtctgctggaacttccagcatgcactgtggtagttatatcagcatatacaggagcactggaacagagggggccagtctaaaagataaggtaggtggaatttttttccccaatatttggtggctttgtaaagttttttaaaaactacttgctggaaagggaaaaatatttaaaaaaaaactttacaaacttgctgaatatttgagtggagggagggaatagaattttatttgataaacgtagataatctctgctttagggatgaacacagtgcaggccagagagaccagctgcttcatgggatgtgaaaaatctacttttataaagtagggtaagtttatttcattattagaaatggactaatactttgggttctattagttttcttctctttggttttcttctctttctgggctttctttaagcagcttaagataatttgctgttacttttttgtggcagggtcttggctctgtccaggttggagtgcagtattttgggagacagttgctggggctggagagctctgttgcccaggctggagtgcagtggtgcaatcttggctcactgcaacctccacctcccaagctcaagcaattctcctgcctcagcttacagagtagctgagatgtgcaccacaacacctggctggtttttgtgtttttagtagagatggggtcccctggcctcatgtgatcctcctgcctcggccaccaaaagtgctgggatttcaggcctgagccacaatgcccagccccacctaattttttttaaaaagttttttgtagagatggggtcccattatgttgcctcggctagtctcaaactcctaggctcaagtgattctcccacctcagcctcccaaaatgttggaattataggcaagagctactgtgcctggtcaatttgctgttatttttgacaaaggaattttcttgggaagtaaaggcacttcagatttagctttcctcctgactaccctaaagtgaaagttaagcttgaactcaatttaaagtggtagttgtgcagtgtttgtttttagatgactcatgtatgatttggtaacacctgccttgatttgatctatttttattgtaggagaaattgacacaagattctctttttgtgcggtggcaactttggctttgttggtaagctttgaatatttgattgaaatgattaaagttcatgaatactctggaattttttttttttttgagtctgatctgctgaatactctggaatttaacaggcatctttttttttgtttgtaggggaagcttgatgctattaatgtggaaaaggcaatcgaatttgttttatcctgtatgaactttgacggtggatttggttgcagaccaggttctgaatcccatgctgggcaggtaatttatgaatacagatgaaaatgtattgtcattttggaagccagtgtagtaaaataagaaaattggttatttcagtgtttgtcaaatacacataaagttaattcgactgtaatagggcatcttacataagaattgcttaattgctatcattactttgctttatatactatatacctttctctgtcggtggattcgtctgacctaagcaaacataagtgggtttataagcaccaaaacacttttgttttccattaatttttcactaaccatacagataaaaaaaaaacaacacatttttctttctttcctaagataaattatgaacctcttttcttgtgccagagaacactgaatatgtgaatggatggctgtgaaatactagccatgaagaaattttgacaataatatttcagtgcagaattgcatactagtaatagtatgcttggattttttcagatatgtggtattaatacatgtttggaattttaagtgtcagatcaagaagaaaaacttaagatataaagtggtgttttaataatttgagttttatcacttttaatgtcaagaaattattatacacataaactttatgtctgtaattttagatctattgttgcacaggatttctggctattacaagtcagttgcatcaagtaaattctgatttacttggctggtggctttgtgaacgacaattaccctcaggcgggctcaatggaaggccggagaaggtattgtttgataagccatattctgctagctttagaaccttgagtgaatgctgctgctttgtcttgcctgtttctatattgtaaattggccatgagcttatttattacctttccctgttgtgaattttcagtaatatatcctactaaaagactccccttgacaaagtagacccccatgagttgaaatactcattgatcctaatgtccatttccagacagtcttgtacaggaatctccatgtttaaggacagttgattttggcaaattggattttttaaaaattagactacagaatttttgtttgcaatcttcttatttaaggaatacccagataatttggtttggagagaagattattaaattttcctccacataataggtctctcttatcaggtctgtaagggacaaatagtgaatactcatttgcaactatgtaattgtcctgtagagcaagtgcagccataagtggtaagaaatgaatgagtatggctgtgttccaattacaattattatggatggatatacttgtatttcctatgtcagatggaatcttgctctgttgcccaggctggagtgcagtgacgccatcttgattcactgcaacctccgcctcccaggttcaagcagttctgcctcagcctcccaagtagctgggactacaggcgcacggctaatttttgtatttttattagagacggggtttcaccatattggccaggctggtctcaaactcctgacctcgtgatctgcctgcatcaacctcccaaagtgctgggattgtaggcgtgagccaccgtgcctgacccaggactatatttaaatgatttataaatgtaaaaactattcctacactatagatttgactcaaggattgtagcttgctgtgcccctgccctctgaatgggacgtggtggtacagtagctgggattacagtcatacaccaccacgcccatccaattttgtatttttagtagagatggggtatcaccatgttcatcaggctgatcttgaactcctgacctcaggtgatctacccgcctcaacctcccaaagtgctgggattacaggcgtgagccactgtgctcggcctgtatttttatttttaaaccttagtatttctgaataacaacgggtagagaaacacccgcagtagctgtctacaatagagtgaaataaaaagcctgaggaactgtcaacagaaaaatgggtggccgtggggagcaccgggacctgcacttgcacacaatctagggcagcttctaatgagtctatgagttactcagggatctcattaaaatgagatcagccttgagtggggttttctttatagacttctgtcaccatattttgaagagcaagggtttagttgattttaagcaggtgtgtacccccctggacagtgcttgtagaaaaacagaactatacccatggatttcatgattatactgctagcttcttggttaaggggctgagttaggcattcattgcagatagaaacaaagcagatgcatgcttatcagtgagtactgagatatttagcatggttacctatgaattgaagtttggtctcttcttacccattaattgattatctttcattctaagcaagtatttcataccctgcatatcagtatatccctggatttcgtccttccacatggtttgacactttgaacatcagattacctaagagtgagacttaacccacttttaaattgttctcaaaattagggaaataaaagagaatgaaattgtggcaacttttttccctcctagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggcaagtaatatttctgacatatttctataaattatttcagcgtttgcattacttcatggttccatggatttccagggtggcattccgagtgttgctttgaaagcagtttttttttctatttattgtagagtgtatgaaggatatagaacaatcttacagaaatttcttgtcgcttgttgctaacaaaattagtatatggtaaaggtcaggtattcataatttgaagttaaagaagttttcattttgtgatctgtatataaattcttttttaaataggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaatgattgataggtttgaatatggttattctgaattggtcacagacttaggttaaatggcaatctaccatcttaaaatggggttgtgattcggactgtccttttttttttttttttttttttttttttagcattttatatatcagaattacccaaagaaggagttgtcttcaaataaggaaacactaacgggtaagttgatggtcaccacagtatttttttgcacctgtctttttcttaaaaagctaaaatgggtacaatcactcttttttatttttttgtgacagaatctctgttgcccaggctggagcccagcagcacgatctcagcttaactgcaacctccgtctgccgggtttaagcaattcagccgcagcctctcgagtagctgggactacagccgcacaccaccatgcccggctaatttttatgttactttagtacagacagggtttcaccatgctgaggagctggagaccagcctgaccttgtgatccacccacctcggcctcccaaagtgctgggattacaggcgtgagccaccacgcctggcctaaaatgagtacaatcactctaggggtttacagttttggtgaaagtgaggtattctctatttttaaattttattttttagagacagggtcttcctttcttccccaggctggggcgtagtagtgcaatcacagctcactgtaaccttaaactcctgggctcaagcagtccttccacctcagcctcctgagtaccagggtctacaggtacctgccaccatgcccactatgcccagctgatttcttaattttggggacaggcactgtcttccccaggctggtctccggaggtgaagtaatcctctggcctcagtctcccaaagtactgggattacagggaggagccatcgtgcccgatctgaaaataaggttttttgatggaaattgagatttttctcaagtatgtttggaatgccctgtgcaataatcattccaagaacagagatgttcttaaggactgttgtcactgcatgtgggtaaaccgctgtgcataactggtttattgagatactcaacagtggcaggatttcagtagtggtgtaaattaatgtcttctaatagcttctgtatggcagtatccagataatttcgtcatgtttaatccatggatctctggtaagttggtactattggccttatttaaggaattttctaaaggtcaccactgcaaagctggagtttgaacttctagtgtgccattaactgatttatatgttagaaaccacagtactagaaattggtagatggggaattgttaactgagagatcttacccagtcagtctttccctgtttcctactctactatgcacacagccatgtgcatactatcttttgataatataactatctttcctatatttggtcacaagatcaaccttaggtgggttatgctgtgtgagcattacacgttctcattgtgtcaaaggcactgggtgtactgtgttgggtggtttctacatttaaagataagctagtgtgcttggacgtgtgggaaatgcatgtaacatttgcaataagggagattgggtgctgtgagaataatggggctaacaaatcgggtggtcattgatgggccttgcagagttctggtcagtctgatacctgcaggctgaggatgttccagtgaggttcatgtggaaagtgatgggtttgggaatggctggaagcagggtcatagacctgaagtacgtgaatccatgtggaaagctgagcctgcctgcgcctgcgcagtgcagcttagtgcgtcggcgcgcagttctcccgcccgtttcagcggcgcagcttctgtagttgggctactggaggggtcgctcagaaacctcatacttctcgggtcagggaaggtttgggaggatgctgaggcctgagatctcatcaacctcgccttctgccccggcggtttccccgtcgtcgggagaaacccgctcacctcagggtccccgctacaatttcggactccaggagactccacagagccgcccttcggtccaggtggtctctgcatccacctgtcctggcacgtcaggagctgcgggcgaccggagcagcagcagcagcagccttccctgccccgcgccaaactcccggccagctcaaggcaaggagtgattgggtggaggagtctccttgaggctagaggccggcagttcatggaggctcgggggcacgtgggtggtggttaccacagtgaagttgtgatttggttggggcgtgagatctgagtgccctgggaatttggtgagtctgggtgattagaagccttgacttttcaaattggttctattgcaagaccttgactgtggatggctcagttctgagaaaggctgaagtatcccatataacgtccctcacagtgtctgacaaatgacagtttgtgcgtgagtttgctgatagaagttgtgagctgatctttggctgctgaatttaattctccaaatcctgctaaggtgggataaaatagattaaattgaacatttcatctaattcaggaaaataatatgtttagtattaaaagatgtgggctgggcggtggctgacgcctgtaatcccagcactttgggaaaccagggtgggcggatcacttgaggccgggagttccacaccagcctggccaacatggtgaacctcccacccccatcccctatctctactaaaagtacaaaaattatctgggtgtggtggcacgtgactgtggtcccagctactcaggaggttgaggtgggaggatggcgagtccgggaggtcgaggctgccgtgagctgagattgcgccactgcatttcagcctgggtgacacagtgagaccctgactcaaaacaaacaaacaaaaaagatgcatgtccttcaaatcatttattattttgttagtctctattcatgacaaagcatcaccatttttcacacacgattgcaacacaatggtaaagtaacaaataccaaatccaatggtcatttttcagttcatctcatgtgacctttctgctgtatttaatgttcttaatttctttatttttagaaacagagtctcgctatgctgcccatgctggtctcaaactcctggtctcaagtgctcctgcctcggtctgcccaagcattgggattacaggcatgagccactgctgcctggcctatgtttaatgttcttgactggtcttctcttaaactcttttaatttggcttccttgattccacttgcccctgtttttctgctacctcccagagaattgctgtgcccacctttgttcccaaattatgggcatgtcattaaagctttttttcctaggccacttctacctagatgtgactatctccacagctcagatctcatctacactccagacttacttcagactgtcttctgaagtttttattgatggactaatggatacctcaggctgactatatgattaattaaattcctctctgcacttttttttttttttttgagacagagtcttgctctgttgcccaggctggagtgcagtggcatggtcatgactcactgcagcctcaaattcctgggctcaagcgatcctcccacctcagcctcccgagtagctgggaccaaggcatgtgcccctacagatggctaatttaaaaaatttttttgtagagacagtgttttcctacgttgcccagcctggtctcgaacttctaggctcaagcgatcctcctacctcagcctcccaaaatgctgggattacaggtgtgagccactgcacctagccctcaaactcttaagtgttcttccatccttgtagcttacttactgtaccaccagagttatgtggaaaatgatcttatcatgtcccttgccacttaaatcagtagacctgtatctgcaggtaaaagatcaaactctctagaaggatagccaaagcaattgggatcggtttctaatctttacagatttatccctcatcatttaatatttaccctgctttctaacaaaactgagctacttgcaattcctttaaagcaacatgaatgttcacattgtcagtctaatccctctcttcatcagatgcttggtcacccacttatttatcagtaatgataacattcactaatttatatgcacctactttgttctggcttcttactaggcagacggtatctttgatcctcacaataattttgcagagtagattttttttttgttcctgttttacagatagaaccaaggcccaaataggcgaacaaaggttcaaattatgttagcagctggggataataatctgcgctctcaatgaacttaaggttcagtagagaagacagacttaaaaatcaacaaatacacatttaagaaataactgtatttgaggtatttataatttttgaggtaggtataattaaagtatggggacaaaagtgggaaaagacatttcacagagtaagtgcaccttgaactggtcttcaagaataagtaggaagaagaatgccagccaaagggaaacagctggagcgcattcttgagaaaaacacgtgcaaaggcacagaagaatcatgtaaaactgctaataattttgcttggctagagcaggagagtgatctaggtagataaacttgaatgtagatatagttgtgagaattagatctgggagacaaatttaacccagagaccccccatattcaacaccaggtctctggttttggtgactggatagatggtagtagtattttctgattctgggaattttgtaggcaaagcaaattttagagggaagatgatgagctctgttatggacatgctgagtgtgaaaagcctgtgggatatccatatatttatattaagataattgaatataggaaactagagctaagaagagagaaacttgagggaaatatggatttgaaagttaccagtatgttgggaccacagcagagaatatgaagattatatagcaaaatagaggtcaaggaagtaggaggagaattaagacaagtgaatgagtttcaagaaagggtatatagtctaaaagtagtctgagaacaagaaacagccctctccatctccagtttccgcatctccagtttctggcaaccactctcttccttagctccctaaagcctaggaatgctaatggagcacattttatgctggttctacacacgtctttatgatagcacccctacaccctgtccacacctttgtaaatattctctttatcaaattatcccagtttgagtatatcattgattcctgctggaacccatataatgaagttatattttaccctatggtgagtatggggagacacataggaattgtaagaaagagagatactgatcagatttgcttttcagaaagattattggtgatgattcgaagaatagattagagaggtgtaatactggaagcaaggagaagaagaagtaggaaacttgcacaaggaccaaagaagatacaggcttaaaatgggctgggaggagtagagagggatttaaattttagtgatgttaaaaaaaaagaattctagcactcagtcactgagtgttagggttgatgaaggaagaattgagaatgtctcctaagcttatgacttgagtgacaagggacaagctggtacaattaaccatactggtaataaagaattaattttgagggaaagatagagttcacttttggacatttagaatgctgggaagatacctaaaggtttatgcccaagagatagatatagtgacctggagctacattgtctgatagaatattctgtgataatagaaacgtttcatacttatgctgtccgatgtggtaactagtagccgtatgtggcttttgaacatttgaaaatgttgctagtgtgactgaggaacagaatttaaattgtatttaattttgatttagttaaatactcacatatgctgctttattgaacaatgcaggtatagagctgagaacggtttttgcacttttgaaggattaaagaatcaagaatattttgtgatattaaaattatatgaaatttagaattcaatatgtagaaataaagccatttttaattgaaacatagccattctcatttatttatgtattatctatgactgcttttctatgatagtgtcagagctgagtaattgtgacagtgattatatggcccacaaaagcctaaaatatttgccatctggtcctttatttaaaagtttatgggctgggcatgatggctcatgcctataatcccagcactttgggaggctgaggtgggcagatcacctgaggccaggagttcatgaccagtctggccaacatgacaaaaccctgtctctattaaaaatacaaaaaaaaaatagccaggtgtggtgggcatgcctataatgccagctgcttgggaggctgaggcaggaggattgcttgaacctgggaggcagaggctgcagtgagctgagattgcgccattgcactctagcctgggcaacaagagtgaaactccatctcaaaaaaaaaaaaaaaaagtttatgctgaggcatggtggcttatgcttgtaatctcagtgctttgggaggctgaagtgggaggattgcttgaggccaggtgtttgagatcagcctgggcaatgtagcaagaccctgtctctataaaaaaaaaattagctgtgtgtggtgaggtgcacctatagtccatagttactcaagaggctgaagcaggaggttacttgagcccatgagcttgaggctgcagtgagctgtgatcacactactgcactccagtctgggcgacaaagagagaccttgtctttataagacagtaaaatagactgggcatggtggctcccgattataatcccagcattttgggaggctgagatgggaagatcacttgagcccaggagtttgagaccagcctgggcaacatggcaaaaccccatctctacaaaaatacaaaaaattagcctggcatggtggcatgagcctatagtcccagctactcgggagggtgaggtaggaggattgcttgagcccaggagttcaaggctgcatttagccaagatcacaccactgaattccagcctaagctacagaacgagagtctcacatacagacaaaaaggaaaaattaaaagtttagcaacccctggtttacagtttaaggagtcgttacagctatatacgaaggcttgagagttgtcagaaaatagatgttaatagaaacaaagaggagagatgagatgcctggagatgcataatgttgatttgtgagggaaagcttaaaagtatgaagccctggaggccaacagttaagaagcagaggaaaaaggagatggcaaaggaaactaaaagtggtttaaagagaattcaagatagagagttgtggaaatcaaagagaataggtgaacagagcccaaacattttaaaatttttttagaacttctatgtgccaagaggctatgctaggttgtttatgtacattatttaaaaattttatgacaatcctgtaaaataggtaatagcttacatcagtagataagtacctaaataaggaactgaagccaattgagtctaaaatgccatttgcataggggagagaaattcaatgaagaaattaacagaagaaggttaaaagaggtctaataattattatacaaatgaaacatatgtcttagtctgtattctgttgcttttaaaagaatacttgaaactgggtgattatcaagaaagaaaacatatttcttggaagtctggaggctgggaagtccaaggtcaaaggaggcacatttagtgagggtctttgtgctggtggagtctctgtagagtcctgtagtggtacagggcatcacatggagagggagctgagcatggtagctcaggtctctcatcctcttcttataaaaccaccagtcctactctcgtgataacccattaacctattaaatcatgaatggattaattcattcatgaaggcagagccctcatgccccatcacctcttaaaggccccacctctgtcctgccacacttcactggggattaaatttcaatgtaagtttcggaggggacagatattcataccttagcaacacatctggtatatttgaagattaaagggtaatttatgattttagccagagtagttgcagtgaacttgtagaggcaaaagctatattagcatatttttgtatatttatcaataatgtcattaattttgttataatctgtttattttcaaaaatcattttcacatgaaattttatagaaagtgaacatagtggttgggtgcggtgactcaggcctctaatcccagcactttgggaggccgaggcaggcagatcatgaggtcaggaattcgagaccagcccagccaacatggtgaaaccccatctctactaaaaatacaaaaattcaccaggcgtggtggcgggtgcctgtaatcccagctactcgggaggctgaggcaggaggatcacttgaacttgggaggtggacgttgcagtgagccgagatcatgccactacgctccagcctgggcgacaagagcaagactctgtctcaaaaaagaaaaaaagaaaaaaaaggaaagtgaacatggtataaattataatgactaatacatcattgcataattcaaatctttaagaattgactgttaatttttcaaatttaggttcatactttggaaacaaaagagcttatgcagaaaacacagttgcatcaaattttacttttggtgcaagctcatcttctgcacgagatactaattatcctcaaacacttaaaactccattgtctactggaaatcctcagagatcaggttataagagctggacaccacaagtgggatattcaggtaaaataagtggaagattaacctagatgatgttttgaaacttaaaagttttataaattataaattagggttattaagttcatttgaatttatctataactgatatgaatgaaaaataaatacattagtttacctctatccataatttgagtctagattaataaggcaacatagtttctgaaattgtttgttaataaatgtaagtctacattattttaaccattctgacaaaaaaacacacaagaaagagaaacctctcccttttatacatgatggcatttaaatctaaaagttgaccctgatattactagtgagtggtttttttatacttaaattttaatttttatctaaatctatgagattttcttgaagagtagatagataaaataggttttcatgtataacagttttctaaggtatatacaacagaatttcttggttacagggtaagttatgtaaatgcatatatttataagataatgacaaattattttttaaagtagttctaccaaagtataaatggtagttaagtttatattagatctacagaagtcagttttagctctgtagtagaatatgaccttcctttttttttttttttttttttaattttttgagacagaatctcactgtgtcgcccaggctggaatgcagtggtgtgatctcgactcactgcaatgtctgctttccgggttcaagtgattcttctgcctcagcctcctgagtagctgggactacaggtgcttgctaccacgcccggctaatttttgtatttttagtagagatggggtttcaccatactggccaggctggtctcgaactcctgacctcatgatccacccaccttggctcccaaagtgctgggattacaggcatgagccactgtgcctggctgacc

SEQ ID NO: 1817 - DNA, 1159 bp, Homo sapiens
gaaagggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagacc

SEQ ID NO: 1818 - protein, 330 aa, Homo sapiens
GTPQKDVIIKSDAPDTLLLEKHADYIASYGSKKDDYEYCMSEYLRMSGIYWGLTVMDLMGQLHRMNREEILAFIKSCQHECGGISASIGHDPHLLYTLSAVQILTLYDSINVIDVNKVVEYVKGLQKEDGSFAGDIWGEIDTRFSFCAVATLALLGKLDAINVEKAIEFVLSCMNFDGGFGCRPGSESHAGQIYCCTGFLAITSQLHQVNSDLLGWWLCERQLPSGGLNGRPEKLPDVCYSWWVLASLKIIGRLHWIDREKLRNFILACQDEETGGFADRPGDMVDPFHTLFGIAGLSLLGEEQIKPVNPVFCMPEEVLQRVNVQPELVS

SEQ ID NO: 1819 - DNA, 21558 bp, Mus musculus
  misc_feature (1)...(21558): n = A,T,C or G
gattatttcttatggagaaaacggggagggtccacagagtggcaagccaaaaaagattggtgaaaatatttgataaaagtaaaagtatgtcaatatcttcaacagaacattataaaaaatttgagttttcagcttcatggttcttgtactcagacaggtacttcatattggaataggatgatggatccctcaggataagatagaaacctggtccctgatgctgtggggacaatgaccaaggagtaacaatatatattaagtatatattctaagaggggctctgtgaggggaacacaagacattccagtcacgccttgtacagtgatgcttccttccgtcaacaatggaacaagcataagacagtggtccccagagattgcatgatgaagtaaaacttagctcttagtttacttaagtgctctctacgaagtttgcacaatgatgagatctcttaatgatgcatttctcaaaacatgtccccacggttaaatgacccgtgactacatacatggcagggtcaagcaatgatgagaacctgacctgatctgctgctggggaaattgatgcatagcttcacagaatgacaaagcataagaagtgtcagtgaattgtagtaattccagaatcacgactgtactaactcagaatttcagagcacatcaacagtaccagggatggagggaggccaaaccatcgaaacgttcttcctatgcctttcagtaacaagccactagaaaccaaagttggtcttcagctcagctggcccatctagcctgagccccacaggctttcagatcagtcaaacgggagacgggggatgaaaaacacttgattgatttatagaggggcttttgtttttgcagcattggtccaggataggccaggaagttggaattttcctgctaaattctctgatcttctcttgtaaatgtttatggccctttctctcactcacagatgataacattatttcaagttctgtgggtccttccccagggccgtcatcacacactggttctagaagctccatcaatttaacctacgagttccttccctcctcactagaaacagagggtgtaaagaagagtgtttaaaatacatagagaggttacacctgcaagcatttcagatactacgatctaaactcaaaagaaacttatatactaatgtacatattcttatataattatttcccaagtcatgtaagaactctgccaaactagtattcagaattaaaaaagaaataacagaaatgacaaaaaaaaaaaaaaaaaagaattcacagatcacctgtttgtttgagagagaggtagggggaacacctgcattttgaaaaggaattttgtaatgtaaaacttcccagtgaattagctttcctatcctttttctagctcacccattaattcaaattattcataataataatcacaagatctacagcatttatagtgaatatcacccaaactactatatattttattgaccttcgtgtcaccttcacagtcctaatttttttaggagttctcttttccacttcaagaaatctttaatttaagccagatttagtggcatccacctttaatccctgctgaggcaggtggatctctgtgagtctgaggccagcctggtcaagagtgagttccaagagagccagaaataaatagtgaaacactgtgcaggatgcggtgggagtgaaaaaagaagcaatctttgggtgatttgggtaacttgggacagataggttggctcagtgggtaatgggtaggcatgcataagtgtgtgggtacatgtggagaccagagggtaacctcatttgtggcttccacttctttagagacagagtctctgattggtctggaacttctcagttaggccacacgggttggtcagtgtgtcctgaggagcctccccccggcccccgtcacctccccaggactgggatcacaagtgcgtgggcatcactatgcccagatttgtgacatgagccctgggcatggaactcacatgagcactttactgatgttactcagtttaccccttaattccaggttttagagtggaccaaataaaagaattgcattgcatcctacgctgagctcaatggaggaagtgtttgaggcagcagttgctagtgaatccccgcaaagcttgctgtgggaatgctgctcacttcagacgttactggttttccaattccatttctagttagcacgtaaaatgtgtcctgataacgtagttacacaagagcggtgaatgtaaggatgtcactgtcattttctattttcatctacatcaacctaatacaaatcagttactgactcttcaagactctggaggagttctttcttttgggttttctatattattattaagaatcactggcttcaacttaacatttttttttttggtaacatctctgtcatgtgaatcatcttcatcagaatctctgaagcatgtaggcatttccaggtcatttaaaaaaatttttcacgatgcataaaaatatgagagttcatatcaaatatgttttatgtttatgtgtatgtagctgaaatttgtttgtgaagcttgcttttactcatttttgcataatttattaaaaagttcaaaattgagaatatacctttttggattttgaattaaatacattctaaatatattagatataactacatattaccagatcagaaattgacaaaatgtttccatttcctggggggggggggggaggttctcagcttcatacttcaaaattagcttggaaaataaactattttcacaaaaattaattgagattttcttaaaaatcaacatgtgcactttgtttttaatacccagatcaaaagaatagtttcaggctataaatcagaaacccaccttagcaattattccatatagcagttagattgttcttaataaactgaagactaagttaggtaggtcattataattcttagcactgaaattttgcttcaagaactgtgtgtttctacagtataaaatgactcaggtctggagagatggctcagaggttaagagcactacctgctcttccagaggtcctgagttcaattctcagtacccacatggtggttcacaaccccctgtaataggatccgatgccctcttctggcctgcagggatacatgcaggcagaatgctgtatacataataaacaaatctttaaaaactgctttaaaaaattgctttggcaaacgcaccttctggatgtggtgagcattatcataagtatttcgaaaaataattgtggtggccacatttctcagtgatttattttactcgggacagacagacggacagacaggacaaagaaattaaagcatttaaggccagatgtgatggcatagttacacaagtctgtccagtgctcaggagacagaggcaggaagatttttgagaccagtcttggctacagagtttcgacactctgtttcgaaaaccccaaacaaaacaaaacaaaacaaaaaccgccaactgtaagctgtaagaccagccgtccagcaagagtatgtaccagtgagtaacaggtaagccaaccacttagatgtctgcaactgcctctcaggacacacaagcggaaactctaacactccctgcttgaactggaaaataattttaaatgagttgacttcatacttttgcataaaagtagaaattcctacagatactgttaatgtgccatccagttcagttaattatcagaatgtaggctggtccagccagtcagcacgttatatctgttttgctcatgtctatttgagtatgctcctctgactgtgagcactgtttttggaaatcctggtgtttagggagtcatgaagaactcacgtaacctctcacaaccttcaatttctcatctaggaaatgaaagaattggggtaaatgtttctttttgaagctctatctacaggtacttcatggtttcttttttaggagttatccaaaacattctatttcataactatttaacatcagggcaatgttttgaaacaaaataaaacaatacaataggcacataaaagcaaagctgtagatattctgcatctaaggggtccaggatgggaaaccctgactgagctctcttctctaatcaacttctttttttcttttctctgtctctcggtctctgtgtttcccctccctctctcagtggaaaaagaaagcatctggaaaggatccagcatgttcctctccctatgtgcacaccagaaacatatgtatcaagtcacctgacagcctttttccctccagattaaatagttcttccaggttccatttctcatctccttaaaatatacttatttatttatttatttatttatttatttatttatttattcattcattcctttcttttttctttctttctttcttttttttttttttttttttccaagacaaggtttctctgtgtagccctggctgtcctggaactcactctgtagaccaggctggcctcgaactcagaaatccacctgcttctgcctcccaagtgctgggattaaaggcatgtgccaccaccactgtccggtaatatatttatttttaagaaagaaaaataaacaagtcttctttggtttctgtaactctttattaaaatggaatagttttaatcaacttaaaaagagccaaattcagcaaaaggattatttccagctctgtcatatgatagccctacccttaacatatttcaagttgttccctttttaaataatatcttctttgtgcatctgattcaaccaaccaatagctccgggtgatccacatttttctcttttggctgaacttgctacatctattcaataatctcccatctaatacccacataatctgtaattgtccttgcggagcttctctggtttttcttactggatataatcttgttttgatagagcatttcctacatgattcacccactgattttatttttcttttcaagctttcaacagacctcacgaaacttcaaaaccaaggtgagtgctcctagtttgctgttaaggctgcaaactgataaaatgtcagttaactaaaatgaatttgcacaaaaaaaaaaaaaaataggctgaacagtgtcccctcaaaattcctgtgatgaagggctagccccatttttcaatgcttcaggatgttactgttggtagataagacctttaaaggggcagtgacattgaaaggaaaccatctgagctattcctatctaatctggctaaagtctttattaaaaacaacagcagcaacaacaatgtgcatatgtaggcgagaacacgtgtcatttgattcaagacaagaggacacaagcaggatgaccaactgcaaaccctgaatagatgcctcagaacactatctactaacagtttgaccttgggcttacagcctacacaactgtgagaaaatacatttcctttgataaccttcctggtctgatttatgaaggccgtgctagtcatctgatataatattagccttattattggctgtatccacggcattggatagcactttagggctcaccaagcaccctctatccttactggatcagcgacagcaagcaccaccattttgttgttgttttgttttcagtttcttaaacctctgaatctcaaagtcctcatttaaaaaccccatatatccttactttctaaggattaagagaggttatctaggtaaagcataaaacattgtcttagattcccctactacccacaccacacatgcaagaatgaggtttttttacattattagtcttttgtttgtttgtttgtttgtttgtctgttttaagcttagattttagctaaactggaagctcacacttaaaagctctgtgtcagtcaaaaacccacaccagtagacctgattgcacttctgtttctaagctgcgaatgagcccttggtgagctatctgccttcaacagatgacattcttgcttaagtgaaagataggccaaggttcgcactgtggtgagcagctgtttttttccactggagagctgttgttctcattgctgttgttgttcagatagggtctcacatagctcagtctggactcaaaactttctatgtaaccaaggatgaccttgaactcttaatacaccccaagtgtaacgattagtcacatgccccatgcagtttgcaaggtattagagatggaactcaaggtctctgttatgcatgcactctaccaattaggctacacccactcccagccctctgctggatttttctacttctcgcttaaaagcaacctctggaagactcttccctcacttttcattttggttcccttgatagttattccaaggtgtatcaatctttattcaccgattcattgattcacagattcattcattgtcgaacatctagttagacttgattcagatctacagcgaacaaacatacttttactcatacactcatataaacatactctgctttcctggagccccgttcctagtgggaaaaggcagttaacagttaagtccatttactgtgccaagtatcaggtggaaacaaacaccaaggagaaaagtaaagagtagggtgaagtaatcaacgaaaagggttttgaatgggacgctgagcaagacctctgggtggaatttgagcagagccacagaaatgaggacaagggccatcggagtgtatggaaaaagaactctagagagtttcttcctcatgacctgggatcttagatctcttagttcttcactgttgttatgggttgggattggcttttctaaaaacctaggtatagtcttaacctcctgtgcctcaaaatgtgatctgatttgagtataggatatattcagaggtcatcaagaccaaatgaggtcattacgatagatccagtacaagtgacgtccttataaagtggtggcacagagagacacacgctgggaaatgctatgtaaagacaagggcagaaacagaaacggcagggatggatttaccaagtgctgccagcaacctgccagacgatacaagacagacaggaccaatcctgccaactcttgaatttggacttccggctccctaatataaatcagacaataactttttgttgcttaagcatggtgttctactatgtcaatcctaggaagctactacaactgtctagtgctcgctggccacacctccccaggttcctgggagaaacctcaggggacttcctgtatttgtggataactataaccacaaccacccccaacctggactccctgtttcaagtcttccttttccacactgcgctccacaatactacctctgaagctttcacccacttctctgtggcactgggacccaatccaaattctcagcctggaaacaccggggcctaaggacccaactgtagtttggacccaaaaagagtttggcccttaggactcatctatccagtttgcttctctcttctttgccggaactctttgatccatgcaaccaaacgtttactcatcctctggttttaactagtttactatgcccgctgagaagcctcctgatgcctctgagacatggtatggtatccctcctatacactctgggatggtgggtgtacccaaacttggttatctgaggtctccttctaagcatgagttgccatctttacatcttagggcactaagaagttcctggaacccagagaacatgcattgggagaataaatgagcaacgcattctgcatcccatccagttggactcagaagtatttattttcccttttactggtggatgatgggcaagtggcctttccagagattgcccaatagtctacagaaacattggagcacactagtgggataccttcccttaatggctgcaggaggaatttagattagacgttcgaaagctgttccttgtgtcgcaagactgcacgataggaaagggaagtaaataatctattcaaaaaaattatcttggcttggccaagattttggaatgcaggtttttgataggaaacgtcccttctgatctccgtcaaaacctcttggttttttcagcgtcatgttcatgacatacaggccaaactaggagttggacaaaagagagaattgttagaactgaaagccatgtatctcttgctcacttctccaaaaagtaaacattcttgaggtttcaaaatcatttgcatacagggttataaatgcttgacagtctggaaaaagggtagacaggaagagagaaggttttgttgtttggggtgcttgaaaagggaccaacttggggaagacataggagtaatgccaaaaaaaaaaaaattactgaatggggcaggcaatgtatcagaatttccagttctcaagaaatacaggagagagagagagagagagagagagagagagagagagagagagagagagagagagagagagactgttagctagaagggtgaaaaagaaacgagatgggggaggggtactggctctttacagcagggaagtcgtccatggacatcgagttatgaagaaacaaccgtactcagaagtccttattcggagcgctaaactcgatttcaccacttaaagagagagatacacgctccaaacagcctcatcctggtgtaggaaaaataactcgcaaagcaagagagctaggactggatagtggcccagaccagtgttaggggttttatttgcaagtcaatgagccaaatgggcgatcgggctcgttgtgcttcgttctgcaagcaaggttattattatcaccgcctattgctccactgaacaatttcactgaaaaggaagactagtagccgtgtgtgcgcgcactgtgccatacaggacgtgctgctacgtgcccacttccaaaacgactttatttacaaagcgattaccaagctatctatctgttttccttttgcagcagcagcagccttactcagccctcgaatttcttaattacaaacccgtttgcttctaaatcaaccccaaaccgtcaggcaagagcccggagggaggctgtgcaagtttgcacacacccccacctcctggatcaagggcaacagcagaagcaagtaactgtgtatgtgcaaaaaggtggatctggggacgaggatcgctgagtttgtttacagagcagggacgcctcagctcggatgccaaagctaccaagagctgcaaacgcaaacttagcagaagcacacgtactcccggagcgtggagcaggccgtaaagtgcggagcggattccagaaccccgggagtggagccgccccggcctgtgagcgcgctcggtccacctgcagccgctgccgctccccgcccccaacccctgtccttgaaaagagtggaggtgcggagcgggggtgaggggtggggagttaaagggtgcatccacactaagaaaaatacctcagttaggtgtacgtgctgcctgtatataaaaaaaaacaaaaccacaaacacaaacacaaaggcgcggctcaggaaagcgcgctcagaggacaggacacgatcggcccagggctttaaaaatctaactcgggaaagcatagccattcttcgtaggttgggaagagtttggcacctaagaaaactctgcagggcagggaggctgagcgaacccctttttcctgtagagggcagggcagatcactaggtaagccgggtgagcgagctgggggtggggagatctagccagaaggaggtggggagtgctccttgctcctctcctgtagatgcttccgtgcactgggtggccgggaggactagctccgtgtccctgaggtggcaggcacaacctcgcctttgggagccagaaagccacttcggtccggagacctgctgggcggcgccggggcgcgcagccgctgcgcacgtgcagcgcggactcgcggacgcggcagaggacccgatccagggtgctgatgttccgggatccgtgtgtttgcgcttgccgccggggaggctgtcgctccgcccttcctgagatccttatattaacagtggccaaagcccggagaaacacagctcattgttggcagctgcctggcggtcttgcggagcggctagggcagcggaggaaaagaaaagggaacggctcggaatttgctccagcggctgctgcaagacctcggcgccaacctcgcaccggcgagcgcctcacagcccatcggctgtccctctatgtgctgctgagccggtcctggactcgacgagcccgccttcggtgttccgagcagaaatcgcaaagacggaaggtgagcgcggcgggcgaagctagccagggctgctgccagcctagtcctccgagggcagggctggctccggggacaagcgtgaggcggagctggggaataacaacaggatgtgcaaccacagggtgaggagggctgattgaatgcctgaagttcgcgnnnnnnnnnnnnnnnnnnnnccggggcacttcctttattaagccacttgggggaacccaggggggtgtgggctccggtccccctccccccgccacactttcccggatcctaggggaaggggcaggtcgctcagcgccaggctgtgcgggtccggcaggcagcaggtccgccgaggtagcgagctcgggtgcacgggctgctggtgggctctctcgggggtggtggtctgcagcttgagacgtgctcgcgggtacggggggctacagaagtggggtgcgctctggtgggcgacacgtgtggcgcgggtctcagcgtctgctcgtttcgctttcaggactggaaatggcagaccatatgatggccatgaaccacgggcgcttccccgacggcaccaacgggctgcaccaccaccctgcccaccgcatgggcatggggcagttcccgagcccgcatcatcaccagcagcagcagccccagcacgccttcaacgccctcatgggcgagcacatacactacggcgcgggcaacatgaatgccacgagcggcatcaggcacgccatggggccggggactgtgaacggggggcaccccccgagcgctctggccccggccgccaggtttaacaactcccagttcatgggtcccccggtggccagccagggaggctccctgccggccagcatgcagctgcagaagctcaacaaccagtatttcaaccatcacccctacccccacaaccactacatgccggatttgcaccccactgcaggccaccagatgaacgggacaaaccagcacttccgagattgcaaccccaagcacagcggaggcagcagcacccctggcggtgcgggtggcagcggcacccccggcggctccggcggcacctcgggcggcgcgggtggcagcagcgcgggcggcagcggcggtggcagcaccatgcccgcctcggtggctcacgtccccgcggcaatgctgccgcccaatgtcatagacactgatttcatcgacgaggaagtgcttatgtccttagtgatagaaatgggtttggaccgcatcaaggagctgcccgaactctggctgggccaaaatgagtttgattttatgacggacttcgtgtgcaagcagcagcccagcagagtcagctgttgactcggttaacctcgcaggcggaaagaaatcaccctccccaccccacccccacccccaacttcttcggtgtgaattaaaaaaaaaacaaaaaaacaaacattcccttagacgcagtatctcgcttttcagatcctgaaagggttgagaacctggaaacaaagtaaactataaacttgtacaaattggtttaaaaaaaaaaaagattgctgccactttttcctattcttgtttcgttttttgtagccttgacattcacctcccttatgtagttgaaatatctagctaacttggtcttttttgttgtttgtttttactcctttatttcctcactttctcccgtgctcaactgttagatattaagcttggcaaactgcttaatcttgtggattttgtagatggtttcaaatgactgcgctgcgttcagattcatgagtgaaaggaaacattgcatttgttggctgcatgatctttgaagggcagatattactgcacaaactgccatctcgcttcattttttttaactatgcattcgagtacagacttaagttttcaaatatgctaaactggaagattaaacatgtgggccaaaccgttctggatcaggaaaagtcataccgttcactttcaagttggctgtctcccctcccccatatgtacagacaataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgagaaaatacttgttaatttattctattttaatttgccaatgtcaataaaaagttaagaaataaacttgttttctaaaagtcagtcatttggggggggttgtctttacattccacttgttattgcgagtaagctttcaaaggataataagtttcaggacactaaaacaggtcaccgtgagcttaagggaaagcaggatttaggataattgacataatgctgctggttacctttgtagcatgcctcttggtgtggtttaatcaaaggctgagaagttgtcacagtgtttttgttgttgtttctttgctgttgtttccatttccagtgctccttggctaggaaggctagcaatatttaatctttctcactgcgtgggggtggggggagaaaactgtttttgattcaactacttaaaaggacatggactagaatattatactgagtgattgatggggtggcattaaatataaattacctttatttcaagtgatgaattttatttctgagcaaaggcgctaaggatagacacatctgccagcttaacctcaaatagattctgactggtttgcagttctgggtgcaagaggggggtggaaacctaccttgaggcttccaataatatttaagttttgctccgaggttgactcaaaggtcaaattacaaccttcataacatgttccctcccaagcgtgccccattttccagaattctgagctgccgctgtcccatgcattaggtgccagggacctcagtataaaatgagtttaacagcctgggtgagctgagtctttaagcagaccaaacccacattcagtgggtgtcagggatagccttacataatcaagcagaagagaaagaaagtgtcagagcatcccaggtgagagaggagttaggttgttgttgcctgtcatgttttcacgctttcaagagcagcataccctcagccaagaacagagactcccactgaccctatggagagaccaaggaaatgcaggccaagaaggtcttacagcaaaccttgcttcaaaagagcggtccctttttgtgctttgaatctgatcctaaagcccatgtttgcagtcagaacaagcaggtagggctgccctggaatctggcacataggctgactgagaaggactccgagtggctcgactctgttaagttctatttccaagcaggacaggtaaaattaagatgcatagtgcactgggctttttataactctataattgacaccatcctattaataattgtgttctatgaaatcacgcaaagctcattcaccccaattttcaaacaaccccatttctccaagagttaaagctgaagttctctttagctacggcatgtcaatattgcatctgcaatccggcagtaaatcttcctagccaagcatttttcacagtaagtttttctttccttttttcttttcttcccccctctcccaggctcaagtgaaaaaaaaaaaaaagtttgcatacagcaaatactggtttgttctcccagggagtgtgtgtgtgtgtgtgtgtgtgtgtgtgtgtgtgtgtgtgtgtcatgaagaggcaagcaaagaattgtcataccaccccgattcaccatttattctgccagggaataagccataacacctgctctgtcattaaatcgctcctgctgctccaatgccggacacgtatgtagagatgcagagctcaaggaactattattagaacttggacccatccctgttagaacagaggactcagagagctggctaaaagcacaatttgtcctcagtgcaaatacaaactcccctcccccacccaccatctctatttcattaaaactctcttgatcaacaattgagcagatcctacgtgatatctgcaggtcgctttaggcagagaaaaataagcccttgtttaaacaacctgattaatgaaacctgtacagtgacctagatcacccggctcctggcagacatttgcaaaaccttctgtggtcttgcttcctactaagttgctgagggcatatggggaaatttgacctctgtaccttggctgtttgtcagaaagttctaacgtggtacaagagggcctctgttctttaggttctgctcacaaacagacactgcacgcttgattttcaagacgagatcagtgataagcacagccccattgacacacaacagaggaatatgtctgcgtgaatataatcgtgctgctctgccgggtgcttgctaaaatcccggtggcagcatctttgtggctgataaagacgttagagccctggataggtctttgaagaacagttgcctaatcaccactgtttatggggtgctaggctagagcacttgttccaggaggctgacatctattgtgaagtttacggtctctgtgacttttactactgtaaacgcctgggatggctataaattgatgtcaacattaaaggccagatcctttagagcaaaatattaatccactaatctattatgggtggctggctttcaaatacaaactttgcagctctggatcattaggtgttttcgcccccttgtggaatttattcagaaggttaaaggaaagcgcctctctggagaggttttttttttttttcttcgttgctgaagactttggtttttttttttttttttttttcccttgagcaaatattccatgtttgttcaaccattttttttttttaaatcaacaggactggagattaagcactctttataaaaataatagtatcttacctacctgtggttaaaggtgcataatttgagattggcttcctctttggaaatatacactggcttagggattttccttttgaaagagcaaggaatggaggtttgggccaatgctttagcgtatcagatgtggggatggcaaacatctgaagccccacaacaggactgctggtttgtatatgagggtcaagaagactatactcagttggggtgaggttgaagacatggtgggaaatattcaggaatgcagaatgcaattatgcacgttggaatgtgacctagccactggctctaatctagtgaaaaggaccacgggaactctaatgagaataaatgttgctgtctaattgagtcaggaaaatttacttcaacataaacctggcagataacattgtctccaaaagaataaatggagaacttggagaatgtaggctagcagccactggccattttttttttttctgttatgttttgtttttgcttgcataaagggactatttcctgtagcttcagagatggtatttaccagctcagtgttataccactatcggcaaaatctacgttcccagacaggctgaggcaaacctcagcaagagaacaccaaacagcacatcaaaggcctgagccaatgaaaccctattcacacgtgttgtgtttgtcttcccccccccccttaaacagaagggacaatggcagtgtctgaattttaattgcagtggactggcttaaattatttgacctatttttttttttatgcagcaagaacagaaatgatttttttttttttttactgatagccacttattggaaagggaaatattagaacattttcctcaagcagtaagctgccgataaataatttagcttgctttacagcacatgagacccacctatattttggggggggggactattaagatgccagaaagaaagaaatttctcttcaaagggtgggaatgctaagttttgctaaataaggggctttaaatagttcaggtgccttgggtttgaatttctattatgtttagctgtttataggcttgaaataagctaagaaaactagggggctgtgtgaacctagagaaggagatcctatcaggcctccttccttccacacttctataaataaacagtgccttttgagtgcattgatcctaatcaggtccccccctccccaagataagcacaaatgttaaaagcaacccagaaatgtcagaagcctgggtaatggtgtgcttccagagaattctgcttggctagcccaggacctgtgaacggcccatggcagatcacagatgagtgatgggtcctgctgcttcctgttggtactgttggtttaggctgacctgatctgagcgattagcgaagccgctgtccatcatggggtgaaggttgaatatcttgagtcacaggtttcttggcatttttccagagtaccccaggcatgctcatcactaaaagccttccctctcttcccttcactgtagaataattagttggtgacacggggttgcagaactaagccgggagggagtctgtgtctccggaggcagcagccaggtaacgttagctggtaccatcaccggttacagacacagaaggcttaaggaaccctctcttggcctggaaagctgtgtagaaaataaaatgtaggctgaggggaaactcaagctaatataaaataacaataatgttaatactaaagaagctaactacaagatgtagatgaacgcatgaaggacagtcacagccaagtgggtgggtcatggctacttgagccccctctcattgtgtctgctatggacctggcggctggcacctttaatccccaaacctgagagacagaagcaggaagatctctgagtttggagccagcctagtctacaagactttctcaaagttttcttggatgatgggacaccgatttttaagacggcaagaatcacactgtttaggttgcctgggaccaaatctatcaagttctaagacagtcaaaactacacagagaaaccctgtctggaaaaaaaccaaaacattagttgtccacaaagagtatttctatccattcattggtattgctatttcttgcaacgtgtagttttggacttggtttggcaaccccccccccccccaccccaatgcacacaggattaagctgtgaagccaaacctttaggctgccaggcaagcaccgccctgctgtagttattttgcaaagctctgtgacaaaggttgactgagacgtcccttccagggttctctctccatgtgactgcgctgcctctccagtgcctaagataaccatcctgaggttctgagatccctgtgttgacagggatcgattcttagaacccctctaaggggtaagtcatgaaagaaagaaagaaaaaagcagtaacatgaaaaagaattccacacgggttatgaaaaatatttaaataaataggttagtaaaacaaaataaagggaagtctccattgtgtttttttggggggggtggtttttggttttgtttgtttgtttgtttgtttgtttttcagattttactcgggcagtgggatgtgggctttaagagggcaaaaagaacgctctttaggcttcataggactgaatcagagagaacaatcataaccgatctcgtccttgacactgagtttcttgtggctggctcagttgagtgcgtactgtgcttcagaaattggaagaaggcgcctcacgcgtgcacacttctctaatacagcggtcccgcaaaacccgtatcatcccaacgtaagttaagaatgtggcattcagaaaagaagcgatttgctccagggcgtgggaggctgcggtgggacttggagatggtgcttacacagcactcttgagataagccaagacgtcttaagatggcaccgactgcacaggagaaaaagctctatattagccgttctcaacccgtgagtttcaaccctttcacgggaatctcctaagaaaacccttagaaaacgcagatatttacattacggttcagaatactagcaaaattaaagttaggaaggaacaacaaaatcatattaaggttgggaatgaccacaacatgaggaactgtatgaagaggtcccgttattagaaagggtgaggacccctgctttacatggtcctcagctataaagcgcacggctataaaacaactacagatgtgtctgcccattcgattacacatttgaccttttaggagtctcaagatatggctgtacacgtttccagacccagtcaaactattctgcaaggtacatgtgactctgaaagaacacggactgtctagtgtaaaccttgtttcacagttttaaccttgctagaacttcaagtacgatcaaagcgaagtacaataggttgtaattttgtttccctttttactgaattccatgttgctgaatgcggccccctttccaaattaagctaatgtctggggtttgccaattctagaacccgatgaataaaaatgtttgtggttaagttctcccaggttgagaaaaaaaatgaccactttgtaacttgccccagtggctgataacaattatacctgagtattgattataattctcagaatgatattgtgtaagaaaatgaatctctcaagacacaagaaatggccacaccattaatcccagcacttggtagtagaggcaggcagatctctataaatttgaggccagcctggtcttcagaggtaggcccaggacagccaggactacacagagactccttgtcttggaaaagaaaactagtggagatgtagcattccgtcagtttacacttacatgatcttcttggacatacccacactgtctgctataagggtggcccactggctctcttgctctcttctgccacatgaagggttcttctattaatagttgtagtgaaatgaatagtagaccaggattaaaaaacatgggccttactctgcaactaaatagcggtgtaatttaatcactgctggcttaagtttctccatcagtgaaatgaagatgtttaattaatataacgtgtatccaaattctcatgaaagaagcattggcctactcctatcgtttttcttcctgtggaaagatggactacgaggtgctgcttcaaaccctgttacagcgtttcttgcttttctgtttccaaggtaaatgggagcctggcgatgggccacggacttgattcagctgggctgatgctctgagcgctgaagtcatctctgtaaacattccctacattgtcataataacattatactgttgttgtcgtctgctgagatttactggccttcaaacaaatatccaaaccttaccagccatgaaggatttcttgtgcacaacacttttaatgttttaagtgactacgagacagccattgccggtacagtagttccaattatgtgtgctacaatttttaaccaactcttcatttcaagttctgcctcacatactcccttacatattaataatttggttacttgggacttagaaataaaaggcattcaatcaatagtggggctctgacttcttcaaacaactccccctgatccacgattatcatcaccatcacttttattgttatttaattcctcagaaagaaaattctataattgaagctaactcagaagaagcaaagcaaaactgtgagttttaagcaggaaagagctaacagtctatatctgtttgtctagtttctcttatccaacttcccaccaacataggcctccatatagcctcagttacttggatagatgacagactgatatgttaaaactagttacacaaaaggaactgtgcatcatgtgtgtaactatccaggaaatgactcttgattttacatgctaaagtgatgcttctagtacatggaagcatttcactaactggccaccaggtggcgctaaggtcctatcaattttattagcacttccttctgagcagctaccaagactagattgacacttgcttcaagaatgtatctccacccgatttgtttttagtgaaccataacaaattcggtatgacctaccataaacttcaaaacagaaccaagtcaaagatgcctgcacacacccttccccaccatcacttctcgctacagtccaccaaaattagaattcactgaaggtggccttttcctaggggcttcttcctttttgaaatattctcttcctgacttcctttcactcaagcgccagtggctcaatttgatgccctgctaggaacatttttatcttaagaaagactgactgaacaggaagaaagtttgaatggcaggacttagtgtattagtccaaaaataagtattggaaagcgtttgtgcctccctctacctttgtctggtcctaaaatcacacctgtttcttctctcatcctgcaagccagccagctccaaggtcagttttgctcctctgctaggtcttagatatggatattgattcccgtttcaccaccagccaattcctccattactcaaggttcggtgattttcatctgttgtccctctgcctaaatcgagtgctcctccccaagattcaagagaccttggtcagacttcgtcctgcaagtgaacagatcctggacactactttcttttcccccatggaacttaaagctcttcaaccttactccagtttgccccttggtccttggtgtgcgtgtgtgtgtgtgtgtgtgtgtgtgtgtgtgtgtgttgacaaatcatttggcattcatctcatcagatgatggcatgatatggtgtcttagctagggttttactgctgtgaacagacaccatgaccaaggcaagtcttataaaaaacaacatttaattggggctggcttacaggttcagaggtttagtccattatcatcaaggtgggagcatggcagtatccaggcaggcatggcgcaggaggagctgagagttctatgtcttcatccaaaggctgctagtggaagactgacttccaggcaactagggtgaggatcttatacccacacctacagtgacacacccattccaaccaggtcacacctattccaacaaggccacaccttcagatggtgccactccctggtccaagaatatacaaaccattacatatggcttccacagacttggggtttcactctcttgagttttctaccacgtgacttgccaggcccactcagaagagaccgcacagttcccttcagcttctctaaggacacacgcctttagagccctgagcttcagtggaagtcccactaccttgaggctgtcaggctgtgaggaagtcaggttacatggaaaggccacgtggagttgctcctgccaccaacacccacggaggttcccagtcggtgacctgtgtgagccttcatacgtgaatgaagatgactgccagcacttcccgtctcagctactgaattagcctccaacgctgcgccttcccagctcagacatcatgtggcagagagaagtgtgaatctttacttcc

SEQ ID NO: 1820 - DNA, 900 bp, Mus musculus
cctggcggtcttgcggagcggctagggcagcggaggaaaagaaaagggaacggctcggaatttgctccagcggctgctgcaagacctcggcgccaacctcgcaccggcgagcgcctcacagcccatcggctgtccctctatgtgctgctgagccggtcctggactcgacgagcccgccttcggtgttccgagcagaaatcgcaaagacggaaggactggaaatggcagaccatatgatggccatgaaccacgggcgcttccccgacggcaccaacgggctgcaccaccaccctgcccaccgcatgggcatggggcagttcccgagcccgcatcatcaccagcagcagcagccccagcacgccttcaacgccctcatgggcgagcacatacactacggcgcgggcaacatgaatgccacgagcggcatcaggcacgccatggggccggggactgtgaacggggggcaccccccgagcgctctggccccggccgccaggtttaacaactcccagttcatgggtcccccggtggccagccagggaggctccctgccggccagcatgcagctgcagaagctcaacaaccagtatttcaaccatcacccctacccccacaaccactacatgccggatttgcaccccactgcaggccaccagatgaacgggacaaaccagcacttccgagattgcaaccccaatgtcatagacactgatttcatcgacgaggaagtgcttatgtccttagtgatagaaatgggtttggaccgcatcaaggagctgcccgaactctggctgggccaaaatgagtttgattttatgacggacttcgtgtgcaagcagcagcccagcagagtcagctgttgactcggttaacctcgcaggcggaaagaaatcaccctcc

SEQ ID NO: 1821 - protein, 286 aa, Mus musculus
WRSCGAARAAEEKKRERLGICSSGCCKTSAPTSHRRAPHSPSAVPLCAAEPVLDSTSPPSVFRAEIAKTEGLEMADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPTAGHQMNGTNQHFRDCNPNVIDTDFIDEEVLMSLVIEMGLDRIKELPELWLGQNEFDFMTDFVCKQQPSRVSC

SEQ ID NO: 1822 - DNA, 21532 bp, Homo sapiens
  misc_feature (1)...(21532): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttaaatagtgcaacaaccactctgacatgagtatttagctgagagagtaactacattacttaatgcttgtcatcaggatgtctacaaccagctctgtgggctcactcagcacaactcagagactctcaaacttccatcttgctggggtttttttgttttgttattgttttgagacagggtttcgttctgtcatccaggctggagtgcagtggcacaatcacagctcatggcagcctcaagctcctgggctcaagtgatcctcacgcctcagcctctcaagtagctgggattacaagtgtgtgccaccatgtctggctaagtttaaaatttctttttttttttttttttgagatggaatcttgctctgtcaccaggctggagtgcagtgacgtgatcttggctcactgcaacctccgcctcctggattcaagtgattctcctgcctcagcctcccaagtagctgggaccacaggtgtgcgccaccacgcctggctaattttgtgtatttttagtagagaccaggtttcaccatgttaaccaggatggtctcgatctcctgaccttgtgatccacccgcctcagcctcccaaagttctgagattacaggtgtgagccaccgtgcccagcctcaaatttttttttgtagaaacaaagtctctccatgttgcccaggatggtctcaaactcctgggctcaagccatcctcttgcctcagcctcccaaagtgctgggattaaagacgtgagccactgcacccagccccaaacttccattttgaactggaaaactacttttaaatgattttaattcccactgttttaaaagtagaaattgatatagattctattactgtcttctgcaatcctatccacctataatatagaacatcagctgggaaacgctgatctaaaaaaccactcaacacatctctatttcacttcagtgaagtcttcataaagacttggtctgctccgataatccataccagtgtttttaaatcctgatggttaggaagtcctttatgagcaagtcacttaacctctcaggacctcagatttctcatctagaaaaggaaggagtttggataagattatttttaaaagtcctacccacactagaattctatgatttttatgtattatccaaagcattagttttcataactgtttaacatcagaacaatatgtttttaaaacaaacagaaacccttaatatataaagcacttaaaagtgaagctgagaatacacaacatctacagaacacaaatttggaaaccactgatctaaagctctctttttaaaaacgccttccttttttctttgtctcagtggaaaaggaaaacatctggaaaggatccaccatattagttttcctctatgtagaccagaacatatgtattaagtcacctgtcagctttttcttccccagattaaatagccattataagtcccatttcccgtccctttaaaaatatatttccttttttttttttcaatgaactttctttggttttggtaactctttattaaaaggtaaagttgcaaactaaccatgatctctcagaagagcccagtgtagcaaaaggattacttccagctctgtcatgtgattctcactcctgatatactccgagttgtgtccttttcaataacagcattccgtggctgcctctgattcaaccaatagcttaggaggacccgcagttttgttttggtttggtttttggctgaacttgttatatctactcaataatttcccatccaatacccatgtaatttgttattgtcctcgtgaagcctctgcagtttttcttattgaacataatcttgtttttgatagagtgtttttctaattatttaaggtcactgaatttttcttctgctttccaacatacctcatccaacttcaaaaccaatgtgaatgttctctagcttattgttaaagctgcagactaagaaaatgccaattatctaaaaaagaatctatatgtgacgtgtgttatataggctgaattgtacccccacccaaattcctctgctgacagctaactcccggtatctaagaatgtaaccataactagagataaggtctttaaagaggtgattcagttaaaatgaggacattagggagggtcctaatccaatctgactgatgtcctcataagaagaggaaatttggacacacgaaagagacaccagggtttcctgtgcacagaggaaagaccatgtgaagacacaccagaagcagccatctgcaagccaaggagaggggtcctgacactttgatcatggactttcagcctccacaactatgaggaaatacatttctgttatttaggcctcccaggctgatattttgttatggcagccctagcagcactagcaaacttatacacatgctcctggcttatgatggtttcacagatgatgttttcaacttatagaacggggtttatcagagcatgaccccatggtaagtcgagaggcatctgtcgaaggttgaccttattctgtgcacgacattttgcagccccttggagctcacctgggaacctctgccatcacagagaaggttacagaagaatacaaatacccataactcaagtcagaataggtcaaaaaagaagatctgagtaaattgccctggaagcaccaacgagccagaattcttgccatctaggggatcaggggaggctaaaaaagaggaaatgtcatctgagctgggccttcaaagacaggcaaaattccagtcatgggcgggaggcggagaggaaacgggtggcagtccagggaaactggacattatgagtgtgaaccaggttcacagtacacccatgaaccctgtgagaatgaccccagttgtcatcaacctataaacaaggttggctgtttgcaaacctagctaaatatcagaaccaaccgggagcttttaaaaaatatacagctcctcaggccccactcccagcctgatgaatcaagaactccaggaatgacatcctaaaatatttattttaatcaaattctcaagcgggatagtaccaacttcatcaatttaaagaccctttaatacaaacatttcattgacctctacgtgataatggctatatttctcttgaatgaaaaaatacctaaagacagaaaaactattatgagtttggtaataatttcaagtgaatttgtattttatgagttagaaccaagtttacatgtttaaaagtgatattcacatctcagtttgacatatatactacatgtaagacattattcagtttgcagataacaccaggttgcatatagggcctctgtcactattaaatcatgtgttaacagactctctggctacctctctcctcttttccctattcctctccttctgagaaggtggccatgtttttcattgtttttatttttatttttaaaagattctctgagactcaaagtcctccttactaaagtgatgaaagtaatccctactccttacattgaggattaagtgagctttggggttttgtttcattttgttgttttgttttttgggttttattttttttgagacaaggtcttgctctgtcacccaggctggagtgcagtggcacgacctcgacctcgacctgcagccttgacctcctgggctcaagtaatgctcccacctcagcttcgcggcttcctgagatgctggaactacagtcatgcaccaccatgctcagctacttttcatattttttgtagagtctggggttttgccatattgcctaggctggtctcaaacttctgggcttaagcaattctcccacctcagcctcccaaagtgctggtgattgtgggcatgagtcactgccctcagctgagataatttaaataacgtacaaaatacagtgctaaatctcaccttcctcccttccctagctgcaccacacaagtatgaggtctttcaatatattttttgaagctgggtccttcagtcagccttttctcaattcaggttttagctaaagccagagactcacctctaaaaacttgtttcagtcaaaagttcacaccaatggggacctttgtccattactcagcagtcagtgatgcccaggtgagtcatcttcccaaacagataacagttttgcccaagtggctgccacaatgcagacaaaggtaagctgctgttctccttttccacttgacttttctacctccagcttttttttggtagaagggatgaaggtctcactctattgccaaggctggagtggagtagtgtgatcacagctcactgcaatctcgaactcctgggctcaagcaatccccccgcttcggcctccccagtatctaggactacaggtatgcacctccacacccagctcattttctaattttattttgttgagacaggatctcaagatgttgcccaggttggtctcgaattcctgggctcaagtgatcctcccacttcaacctcccaaagttctgggactacaggtgtgagccactgcacctggcctacctccagccttgagagtgaccttctccagaaagtcttccttggcccctcattggggttcccatagtgccaatgccatattttattcatgcattcacccttcaattagtaaaagtctaatacctgccaggacttgtttcagacagtgaatgaacaaccaggctaggtctctgctctcatggagctgtcattctaatggggaaggcagtaaactgtcaatttaccatgcagcatgtcaggtaggaagatactctaagatgaaacataaagcagggcaaggaaacaagagagatattgctatttgggtaggacagtcagggagagtttgttgaggtgatatttgagcagagacatgaagaaatgagaatatgggccagtaggacgtctgggaagacagttccaggtggcaactttctttgtcagcagcaggggtcttgtattactcagtttatttaccactgttattagtcaaattgtgtccccgcaaaaatatcttggagatatgttggagttctaacctccagaatatgaccttctttggagtcaggagcttatagaggtgatcaagttaacatgaggccagtaggagaagccctaatccaaaaggactagagtccttgtcaaaaggggaactttggacacagagatacacatacaggggggcggggggtggaaaacgtcacatgaagatgaaggtggggatcagtgtgatgcatctacaagtcaagggacaccaaagattgccgggaaaccaccaaaagccaggaaagagacacggaatagattctctctcacggtcttcagaaccaaccctgccaacaacttggccttgtacctctagcctccagaactgtgagacaataatgttttgttgtttaaagcttgatcagccttaagtttgtattagactggtgcaaaagtaattacagttttcgccattgctttcaatggcaaaaatcacaattacttttgcaccaacctaaatagtactgtgttatggcagctctgggaaatgaatacaaccattcagtgctgtgagggccacagacagatcacttgctcgctcacccaggttcacgggataaaccctggttatacggaacttctgggagccctgggttactgtaagtgccccctaactggactccctgtttcctgtcttactttctctaaccattctccacagtactgccctgatctttctaaaatccaaatctttcctatctcatggcttcacaagcttttacctgcctcccaatgtctttgggatacagcaaaatttctcagcttgaggccacaatgcccttggcatccggccccagcatatttctccaaccttatttctctcatctttgcattcactccctagccatacattttctaccccactcctaatgggaccaaacttccattcatcctgaggcctccacttagtcaccatctccaccggaaagccttcccaaagcacccaggaggggggtaggtgtccctcctatgtgctctccaaagccctttccttcaatgcctttgtggcatttatcacagtgtgttcaaggcctgtttgtcagttttctccctgtgaccatgagttcctatcttgtttgtatctccaggcaccaagaaagcacttggcacttggaggacattcagtggacggatgagaataaatgaacaaagcatgccatgttccaaccagctggtcccagaactattttgttctcctttaagggatgggggatgggcaggtgacctttccagggatttcccaatagtaggtagaaccactggagctggatggagctccacctttccttagtggttgcaagaggaatttagattagacattcaaaagctgtttcttgtgtcgaaagacacttgcagtacaaagaagggaaagtaaacaatcccgcgatttttcaggttgggttttaccaatattttagaatctgtttttttataggaagtggccccttcaggtatccaagcctctgatacggtaaactgcatgtcctgacctacaggtaaaggtggtgggaggttaggagaatagggaattgttgcaactaacaatgcaatgtgtcatgtgcccgtatctctaaaaagtaaatatttttgaggtttaaaaattatttgcctgcacggtttgccggagagcctggaagaggaaagaagacaagacacaaagtaacaacatttacaaaaatatgcctgactaggaaaagacagaggggtcatagacgaaaataatcaggattgggtctcttttgcaaattcctgaacggggaaatgtatcagaatttccagtcctcaagaaacagggcctttaaaagtcttgtgtgcaagaagggggaaaaagacgaggggggggcggggaggcggactcgctcttcgcagcaggaagtcttcaatggctatcgagttatgaagaaacaactgcccagaagtccttattcggagcgctaaactcgattttaccacataaagagcaatgtaaaagctcagaacagccccatcatggtgttggggaaacaactcggcttccccatgtgagaaagccagagagctccgacttggtagtagcccagacctgtgttaggggttttatttgcaagtcaatgaaccaaacgggcgaccaggctcgttgtgccgcgttgtggaagcaaggttattattatcgcccattgccccactgaacaatttcactgaaaaggaagagtcccagccgtgtgtgtgcgcgtggtgccatacgggacgtgcagctacgtgcccacctccagaacgactttatttacaaagcgattaccacgttatctatttgttttccttttccagcaagagcagccttactcagccctcaaatttcttaattacaaacccgtttgcttctaaatcaaccccaaaccgtcaggcagagcccggagggaggctctgcaagtttgtacacacccccacctcccggatccagggcaacagcagaagcaagtaactgtgtatgtgcaaaaaggtggatctggggacgaggatcgctgagtttgtttacagagcagagacgcctcagctcggatgccaaagctaccaagagctgcaaacgcaaacttagcagaagcacacgtaccccgggagcggcaggcgggcccgaaagcgcggactggaattccagggcgcgggagcgggggtggccgggccctcgagcgcgctccgtccacctgcagcggctgcccctccccgcccccagctcctgtccttgaaaggagtggaggaaaaaaatgcatctacaagcggtgatctagagtaggtctacccactgcccgtatgaaaacacaaaggcacagcctaggaaggcgcgctcaggaaagggcgcattatttgtccgggtctttaaaacccaactcgaggaagcacagccattcttcgctgcctgtggaagcttttgcaaaaccggggaggcacaagggcactctggagggcggggggcgctgggcgagtccccttttcccgtagagagcggggcagatcgctaggtgaaccgagtgagaaagctgggggtggggtagatccagcctgaggggggcggtgagctctcctcgtggctatcccggcaggctctaccttcgggcggggcggcaggggaggattttccccctgcctcgggggtggctgagccaacctcgcgtttctgggccgggaagaaaccagagtcggggggcgacggggcgactgggcggcccccgggccccgcagcctctgcagcacgtgccgcgggcggcggggacgcggctccgggacccggtccagggtgttcgcggtgttccggaatccgcgtcttggcgccgcccgccctggaggctctcgctccgcctttccgaaatgcctatattaactgtggccaaagccctaagaaacacagctcattgttggcagctgccgggcggtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggtaagcgcgacgggcgaagctggctggggctcttgccagcccagtcctccgagggcagggtttgcccggaggaagagcgtgaggcgaagctggggaataacaacaggatgtgcaacaacaggatgaggagggctgatttaatgcctgaagttcgcagcagggctacggggcacttcctttattaggccacttcggggagcaaagggggtgtgggctcgggtccccccgcccgatcgcaggggaaggggctgtttgtgcagcgtccggctgtgttatgagtggtagctcttccgtggtggctagcccgggtgcacaggctgttagtgggatcttgggggtggtggttcgcagccgacgtgcgcccgggaatcctggggggcagaggcgagcaaaagtggggtgcgctgtggtgggcgacacgtgtggcgcgggtctcattatctgcccttttcacttccaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagccttttaggaaattttgacagtatttttgtacaaaacatttttttgaaaaaatacttgttaatttattctattttaatttgccaatgtcaataaaaagttaagaaataacttgttttctagaagtcatttgggggtggttgttccctttggtggcttttttccccccgtctttgagttgaacactattgatgagagtaagcattccaaaggataaattacaggacactaaaacaggtcatgatgagcttaagcggagagcaggatttaacataattggcataatgcttcattgttatcattgtaacatgcctcttggtgtgctttaatcaaaagctgcaaagttgtcactgcttttttttttttcttaattgccatcatatcaagtgtactccagagttagaaaggtttgcaatactcaacattatctttttcaatgggcaggaggcaaaaaaaatcaagtgtttctgtttatacctgattcaactacttaaatagaggtagattggaataatacactgattgattgatgggtggcattaaatataaatctacctttatctccagtgatgagagttttatttctcagcaaaagtgccaaggataggtacatattttctagcgtaatctctgaaacagtgtctgactggtttatagttctgagaaagatgaggcagaattccactttgaggcttttgtcctataatatttaaaatgtactcaggttgactcaaaggtcaaattacagtctttacaagatgttccctcttaagcatgccctgttttcctgaattctgagttttcctgttgcatgcatgggatgcaaatcacctgaaaattatactttaattttacctggatagatgtcttatcaagaagaccatagctacaactaagtgggtatcaagttttgccttatataatcaagcaaaggaaaaagtaatattgtgaaaatctcaaattatcccaggtggaaggagaaggaattttgtttttcatgttttcatggcttatcttatgtttataagagcaacacacctaccttcaagaaaaaatacagacttttgtacgcaacttactaggggaagtaaaaaatgtaggttgaggaaaatcttataaataatgctttaaaagaacatttcatttagactccgattctcatcttaaattccatattttataagaaatcaggaggagcggatatttagaagtgttatgagagagtaagttgggcataaaggctgctttaagtataattcagatcacctgcattttataattttatttccaaggtaggccatgtaaaattaaaatgcacacactccactgggttttttatatacctctataattgacactttcttctttaaaattatgttcaaataaatatactgaatcatccaaaactctttttaccctactttaaaagctgatccagatttccacattaatagttaaagctgaagttttcttcagctaagacatgtcaatactaaatctgcaatcagcaatgaatctttctggctaagcattttcacagtaagtttttctttctctctctctcttttttttttccagaggcttaagtgaaaaaatatgtttgcatacatattaatacagcaactccaatcctttttcactagtgccaggaaaaaaggaaagtgattaaatgcatttttttttttttttttgcataaagaagccaaagaattgtcttgccaccacccttcaccatttattctgccagggaataagccacaacacctgctctgtcactaaattcctcctgctgctcaaacgccggaacacgtatgtggagatgcagagcccaaggaactattattagatcttgagcccatccctaccagaacagaggactcaaacagaggagctgggctaaaaagcacaatttgtcttcagtacaaatacaaacgctcccgcaccccagttcacttgagtgatctctgtttcattaaaaactctttcttgatcaacaattgagcagattctacatgatatctgcaggtctcttaagcagagaaaaataactccttgtttcaacaacctgattaatgaaacctgtacagtgacctagatcacccggctactggcagacatttgcaaaaccttttgtggtcttgcttcctactaagttgcttatagcatatggggaaatttgacctctgtaccttggctgtttgtcaaaaagttctaatatgatacaagagagcttctgttctttaagctttgcccaaaaatagacactccatgcttgattttcaagaagagatcaatgataagctgcagtgcaacctcatagctacatgtcagaaaaataagtccacattaataaaaacgtatacttctgtcttgtgcctgataaaatcctcgtgacagtatctttgcgggagctgataaagacgttagagctatggatgggtctttgaagaacagttacctaatcaccactgtttatggggtgctgggctagagcactagtagcagaaggctgacatctattgtgaagtttatggtctccatgacttttactactgtaaacgcctgggatggctataaattgatgtcaacattaaaggccagatcctttagagaaaaatattaatccactaatctattatgggtggccagctttgcaataaaaactttgcagccccggaccattaggtgttttcgcccccttgtggaatttatttagaaggtcaatgaaaagctgtttcctcaagagctttttcgcttttttgtttgttttgttgccatttctgaagactttgttttcttctttgagcaaacagcacatattcgagcaacacattttttaaatcaaagaagattccaaaataaacatcctttataaaataagaatattttacttaccaaaaaccttaacctatgattaagtgtgcataattgagatttgcctcatatttgaaaatatgcattacctaaggggttttcttttaaaagtgtaaggagcagtggtttgggctgatgctttagcctgcaaactgaggggatggcaaaccctcagcgcctccacaacaggactgttgatttgcagtaagggtaaataacaatgcatttgacggtatgaggttggaaaggtggagggaaatatccaggaatgcagaatgcaattatccacattggaatgtgaccaagccaccagccctaatcttgtgaaaggactgcaggatctttaatgaggatgagtgttgctgtctaattgagtcagtaaaatttactttaaaataaactgggcagataacattgtctccaaaaaataaataaatttagaaatcaaggaatttaagacccatgccattggcaattttttcctctgcagtggaaatgttttgctagcatgaaagcagcagtacacctcttcagaaatgcatgcttcagagatggtatttatcattttgggactgcaccactatcatcaaaatcagcgctcccaggcaggttgaggctgagcctccagaagagaacaataggtagcacatcaaatgactcagccagtgaacccctattatcatgggctctgtttgtcttctccccctagaatagaaggaacaatggcaatgtcagaattttaattgcaatggactggcttaaattacttgacctatttttatgcagcaaggagaaaaatgattctttttttttcctggtagccatacttttaatttaaactggaaaaggaaatataagaatattttccatcaaataacatactgctgataattttagtttgccttgtagtgagacctacctatattttaaaaaaatattaaaacatctgaaataaagaacttcttcccttcccaggaagaaattaaactcataagtaatgcagtaatgctaaagagtgagaaaatattctaagagcggctggcgtgaatttctatcatattttgatatttatacacaatgaaagaaaagctatgataagtaagagtctgttgtgttgaggaactgaatccatgatccttgggaaagagaaactatcagaccgacctcttccatactgtctatgaacaaataatgactttttagcggctggattcttatcagttacttccttcccctagaggagcactaaatgaagcagccccaggaggcagttagtggtgctttttgagaattcagcttggctaaatcaggacttgcagagtgagcaaaaagcacatgaaagaaagatggacggtgaatattattacttgctttatatgttattagttttcattaggctgaactaatctgaaagattagtgaggcaggggcacaaccaggggtgaggactgtggttcacggaattcttggaattttcccatggtatcaccattgtgctcagccctgaaatccctccctttcttccctctacagtagagtggttacttgattacattttgggttgctgaacaaagccgacaggggaatctgtctcctgaggagcctgtagcaaggcaaggttagcgtggtgcgcattgcaggagatatgcaaataggcgagtggcttttgaaaagttaatagtgcccaaagaattctgcctgtccattcctgaaagctgagtggggagcaaaattaaggcttgagtgcaagtcaaactagcacaaaatcaggaaaagtcagccaactccagattgtcagtactgtttttatgaacacatgctacagtgaaggaaatgggattggaggctattgaggtcttttctctttgggttttcctatggattggtataacatttggccttgtgatttccttagtcactaggccacagaattttattgttgttagtggtggtggtggtttattctcgtaacccactgggtttggggtttggtttgggttccgttgggttttttgcttcatgacagttgctatctccttaaagcacatatagtatacttcaattgtgcatacacattcttagatcaccttgtaaatatggccccgttgcatgtattttggataactcttgaaaggaggataagcaagatgatgaccagtttcatacatctctcttcaccctatgtgtttagcaaacataaggacgatgaggccagtaggtgaaaaatgattgaactgactgttatgttcctaatatgaacttaaatatctaaatgtttctaagatccccttctgacaccattttttggatcaatagttctcagctgggtagaggtacctctcaggctggggagaagggagagaaaacagtaacttataaaaacatattccatactatatttggacagatgttttaatacacattcttttagtaaaacaaaatgtagaaagacatttcaaactcttattatttttttatttattttgtttgagacagagtcttgctctgttgccaggctggagtgcagtggcgcaatctcagctcactgcaacctccacctactgggttcaagcgattctcctgcctcagcctcctgagtagctgggactacaggcacgcaccaccatgcacaactagtttttttgtatttgttggccaggatgatcgcaatctcttgaccgcgtgatccactcacctcggcctcccaaagtgctgggattacagcgtgagccactgcgcctggcctcaaaatcttcttgactgatagggcatagatttttaaatggtaagaaacactgtttagactgcatgggatcaaatcgaagaaatttacccttcaatcaacatctcttaacaaatctctctgttgaccataagtttcctgtggctgccttggttgagcacttactatgtgacagatattgtggtaggcactttacatacataatctcatttaatgctcacaatatgcttgcaagattcatgatattcttccaaatttacataaggaaattgacatttagagaggaagtcaactgctcaaggacaacacagtagcggatagaggagcagagtagtttccagacctagcttccgagtcagtgctctttctaagacgcagtgctgctgtgataaaccaaatgacacctattcttaaatgccactgattgtaaaatgatcaataagtgattaagagaaaaacccattacattacatgaacacaagttctaaaatatatgaacacaactataccatgtatttatccgtacaatcacacaccgtttccttttgggattcacaagattcgggtctacgctttttcaaatttggtataaaaattcctccaaattaagtgtgacccctgaaagtgcatgagtagcctcatggtgagctgcttaccccttcttaatattttgacctcgttagcacttcaagtcaaatgaaagaatatcagtgatttaaattgcggtttcagtttttttttccttaactgaattccttcttgctggaaataaacagtttctttcagaaattaagccaatgccttaccctcccaattctatactctattaaatgagaatgttagttactaaattctggcacataaatatgaccgctttacaactcgcccaactgcctgccagcgattatgttttaatattgattataagattcaggctgatttcataatgttaagattttttttaagtacatgttagaataaaggaaatacaatatttagttactttacacttaactaatcttcctcaatttatccaaagtttcttgatgcaaatgtaaactcacattctcttactttggtcttctatggaaatggagaactcttctattaatagttactgaaaagaatagtagatcaggaataaaaaacataggtctagtcttaactctgcaaccaaatagctgtgtaatttaatcattgttgactcaagtttctccatcagtaaaatgaagatgtttaattaatacatcttgtattcaaattctcatgaagaaaacataagcccgttcctatcatttctcctcctctgaaaacatggagtacaatattataagaccacctcaaaacctgttccatcattcttaccattgtttttccaagctcaccgtgagtctgtgggtgtgccatagacctgacccagttgtgtcaactttccaaagattggaatcgtctctgtaaatattccctttcattgccataatgagcacaaattttggctactgagatttatcagcctgcaagcaaatgccaaaaaagcttgccaccctaggaaatatttccagaacatgacattgcaaatttgctgatgcagttgtttaaattatgtgtgtgtgtgtatggtgtgtaacttactgaaaataattcgatcaattctttatttcaggttctgttttatattcttacagattaatttcacttttccaacctcataaataacaaaccataactatttgaactctcttcctttcaaacatcttttcctgggccacaattattatcgtcatcattagcataactgttagtattatttactttctcagagaggcaatcctatatacaatgctaagtcagaggaagctagcatgtgttgaacactataataagcagatacgtaagagttttcaagtagttaagaggcatttgtctatatccatttatctatttctccctccccaactttacaacaccacattccaccagtttgggaaatcaattatttagctagatgatcaactaatagattagttgaaaattgttaaacaaaagtgtatcataatacataactatccaggaaataattatagactgacatgtaaaagtaatgtagctaaagaaccatgataatgttacaaaatatttgttcctttcatcacttaaccactagatggagctaaaggtctgtaaattcaaatttgcgcttttctcctgagctgctggactgtcatttccttaaagaatttgcccccatccccacttaccatttcctgtttgtattactgaaacaaaaaatatcctatgtgacctattttaaccctcaaaattaaaaatatgtcaaggtcacccaaatacactctgcccaagcaccattgctcgctacagtctaataaaaataggaaattgacaaaagatgtctttgagcaactccactttttttttcttttttttaaattatactttaagttctagagtacatgtgcacaacgtgcagatttgctacataggtatacatctgccatgttggtttgctgcacccattaactcatcatttacattaggtatttctcctaatgctatccctccccctaccccccaccccacgacaggccccggggtgtgctgttccccgccctgtgttcaagtgatctcattgttcagttcccacctatgagtgagaacatgcggtgtttggtttcctgtccttgtgatagtttgctgagaatgatggtttccagccgcatccatgtccctacaaaggacatgaactcatccttttttatggctgcatagtattccatggtgtatatgtgccacattttcttaatccagtccatcattgatggacatttgggttggttccaagtctttgctcttgtgaatagtgccacaataaacatacatgtacaagtgtctttatagtagcatgatttataatcctttgggtatatacccagtaatgggatcactgggtcaaatggtatttctagttctagatccttgatgaatctccacactgtcttccacaatggttgaactagtttacactcccacaaacagtgtaaaagtgtttctatttctccacatcctctccagcatctgttgtttcctaagtttttaatgatcgccattctaactggtgtgagatggtatctcattgtggttttgatttgcatttctctgatggccagtgatgatgagcatttttctcatgtgtctgttggctgttacataaatgtcttcttttgaggagtgtctgttcatatcctttgcccactttttgatggggttgtttttttcttgtaaatttgtttaagttctttgtagattctggatattagccctttgtcagatgggtagattgcaaaaattttctgccattctgtagggagcaactccactttcttcccctttttaaccccttccctttttgaagtgttctcctgcctttcatttgctcaggtatcagtggctcaattttctgccctgctgggacgtttatatcttaatagagaaatttgagagagagagcatttaaaactaaaggaagaaattttgaatggtaggattttgtgcatcattcagaaagatatttgaaggtccctaagcctttctctatctttttctgaccctgaaatcattcctttttcctgtctctcctacctctcaagccagtgctatt

SEQ ID NO: 1823 - DNA, 901 bp, Homo sapiens
gagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaa

SEQ ID NO: 1824 - protein, 213 aa, Homo sapiens
MADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPNVIDTDFIDEEVLMSLVIEMGLDRIKELPELWLGQNEFDFMTDFVCKQQPSRVSC

SEQ ID NO: 1825 - DNA, 25802 bp, Mus musculus
  misc_feature (1)...(25802): n = A,T,C or G
aggcctcagccttgggtctgcagcccacttccactttatccaacagaccccctggcaaaccctctagtccaacttcagcccctagccacatgtcttgtggcttcttggggagtttctcccactctctgagcctcatcgacaagataaacagattgggcctggtgggtcctgaagcagttttcagctctgtggtttaatggcacggaggagagaagcctgcctgcggggctcccagactctgaccaccccagtgctctccagcaagtagctcccacctcacaaagggattgtgtcctcctttgcctgcaaacacatagcttcccacataacacttctcatagctgtatctagagatcactctcctgcagccccaagcagagaggactgcctagttcactgagttccatctctctaacccttgggtgggagacccaggggctcacagctccccactctttagttgtctctttcctttccctcctgacttggtctggctctttctagagtatgacccttttcttctctgcttcccccacccacatctccaggcaaactatgacgtgtggatcctcctgaccgtggtgggtaccgtctttgtgatcatcctggcctcagtgctgcgcatcaggtgccgcccccaccatagcagaccggtgagcagtgtgggctgcctaatagaagtgggtatgggtataaacgtggagggagaaaggagaatgtgagacagacaggtgtctttatggccatgaaaccacctccttttaaataaacactctatgctctctgttgcttttagcagcctctcctcatattccttgtttatgtatccatccatccatcagtccacccacccattcatcatatatactgagtgatatatatatatatatatatatatattatcagtttcaggtgttggcaacagcaccatgagtaaaaacgaccaaaaaaaaaaaaaaaaaaatcaaaaccctccactcttatgaagctttcttccagcagggtaatggtgacacacacctttaatcccaggacttgggcggcagaggcaggtggatctctgagtttgaggccagcctggactacagagcaagtttcaagacagccagggctacacagagaaagcctgacttaccaaaacaaacaaacaaacacaaagcagctttcgtcctagtggcaggggtgggggaagcagacaatgaagcgaataagatgataatagttttggtggtagcttgtgctcgataccgaaaactgtgaaatagcaaagaggagcaggcatgctggagagacagggttagccttttctaagccagcacaggtgagtctgcatcaagaaaacgatgatatagcacagaccagccatgggtgagcaaggggcgagcaatggacaagcttgggagtcactgtctgtcactctggttcaagaggatccaacaccctttcatgcctctgtcctctgtggggcactaggcacaccccaggtgcatagacacacatgccgacaaaatacccacccacacagactagaatagttatacttttttaaacaattatttatctgttttatgtgagtgcattgtcactgtcttcagacacaccagaagaaggcattgaatcccattgcagatggttgtgagccaccacatggttgctggggattgaactcaggacctctggaagaacagtcagtgctcttaaccgccgagccatctctctagcctcacataataatatcatgtgtcatcaaaggaagaaaagcctaaagggatatagggagctggtgggacggaaggtcacagctgtgcaagagctcagaagggatgtgccctcaagggcattcggaactgaggcgtggctggggcccaggagcgaggaaagcagagctctcacttcagtgtgaactccatccctgtccccaggatcctcttcagcagcggacagcccgggccatcagccagctggccaccaggaggtaccaagccggctgtagacgagcccgagccgagtggccagactcggggagtagctgcagctcgacccccgtgtgtgccatctgtctagaagagttctcagaggggcaggtgagatgggcccggctggagatggggagggtacctggggcggggtggagaggtctaggtatgactacgtcacaactacatctgggtctatgtgtcctccaaggcagggatcatgtataagatctggccactttgctgggcttctaagaacaagctttcatatcgttgagagggagcctcatgtcgggctccagcagcggcactttaaacacattatctcacgttagccgcatggcagaggaggttggagaatagattgtgtgcttatccttactgacagcagaaactgctgagaaacttgagccaggcattgtggtgcatgcctctaatccagccttgggggtgataggaaaaagacctatgtaaaactgtctccaaaaaaaaaaaaaatagagtaaaaccccaaacttgcccagagtcaggcagcataacacaaatccaccagcaaccaaggcccacaccgccattactctctattcctttgcaagtaggtgactgcaggaaggcaaggccaagagggagctagggaggtccttgtaacctttggttggggcactcttgtctgcttcaggagctccgggtcatttcgtgcctccacgagtttcatcgaacgtgtgtggacccctggctataccagcatcggacttgccccctctgcatgttcaacatcgtaggtaggaggtgaactcaagggctctcctgtgtgcgtacagatggatgtaggacatagctgccccagtgggaaagggtttctcttgtgaggctgaggagaagcagctgctgccatgttggcttcagcagcgcactgttcaagagcaccagcaccttgtctgtcggggaaggttgtccatactgaaaccatctttgttttcataaagagtgtgttttcacagtggtgttgcttctaaatctaatttgtttgcaaatttgttattcaaatattctggcaataaaggaccctgttctagtaaaattggcatcgcaattttctaaaagatggaagtgaaatcaacatcttaaggaaagaaccttatgtaggggctggagagatggctcagcagttaagaacaccgactgctcttccagaggtcctgggttcaaatcccagcaaccacatggtggcttacaaccatctgtaatgagatctgataccctctctggtgtgtctgaagacagctatagtgtacttatatataattaataaataaatcttaaaaaaaaaaaaaaagaatcttgtgctagtccagccaagagaacactgtgaactcatggtggccccgtgtgagagagccctattggctggtgggtggagtaggcagattttagagtagattttctttgttccccaaactgagctcagaatctatagagggtcagatgggtagctacacctttctgagttcattctctgtatgaagtctttacttgtgaaactaaatgtccatgttctctattctttttcccagagggagattcattttcccaggccccggcagcctctccatcttaccaggaaccaggcagaagactccacctcattcgccagcatcctggccacgcccactatcatcttccttctgcctatctgttggggccttccaggacttcagtcgcccggaccccaagacctagaccctttctgccctcccaggagccaagcatgggctctcggcatcagcgccttcccaggacttcacatctccgggccccagaagaacagcagcacttggcggtatctccacacccctatgcacagggctgggggctgaatcgcctccgatgtacctctcagcatcctgcagcttgcccagtggccctacgacgggccaggcctcatgagagcagcgggtctggagaaagctactgtacagaacgcagcggttacttggcagatgggccagccagtgactccagctcagggccctgtcacggctcatccagtgactcggtggtcaactgcacggacgtcagcctgcagggcatccacggcagcagctccaccttccgaagctccctgagcagtgactttgaccccttggtatactgnnnnnnnnnnnnnnnnnnnnnnnnnnnnnnnnnnnnnnnnnnnnncccacagtccatgcctgctgcttctcacactcagctggagccatctctccctgaccagcagctcatcacacccaacccaacagcttcttcaatgcttcccaacccacaacggcccagggctcttacagagccagcccctggcctagcagaagcttccagccctagccccagtcccaaacctaaccccagcggtcttttgaacttgcagaaatccagcctcactgtcagacacccacacagaaaacggcggggtggtccctcagaacccctgccaacctctctgcccccggacttgactgtgcacactgcttgcccggttttcccccactacagtccccgtctggcatacccttggcccccagaggttcatccattgatgttcagacctccaggtccggataggaggctgctacatgaagtcccaggcccctgttactcaagttcacagccagtgtggttgtatctgaatccctgccagcctctgggaccatgcttacctggagagggacattccaagtggacttttgacagcccagagggcaggagatgtccttactcacattgccaggtgctgccagcccaacctggtgagtgttcagggaagcaggtgttctgggaagaggagactctgtctggatattggaaggcaggtgaaaacagccgaggggttggtgaattgaggagattataacttacctgaagcacagaagtcataggtggttctcagcttccccaggggcccttgggctttggtaaaggaaccattaaggtacctggcagtgttggcacatgcatttaattccagcactagggaggcagagaaaggcagatctatgagttcaaggccagtctagtctactgagtgagttccagaacagccagggcagcacagaaaaaccctgtctcaaaaacaaaacaacaacaataacaactagtgagagagagagagagagagagagagagagctaagactcctcttccaagcattcttgttaataaggccagccacgatttcatgggaactctaaatcctcagctctaagccaaagctttgcacatttgtctacgtaaaccatccgtcctttccaagactcactaccccccagtccctcccacctttgagacacactgatggcacacctctttacagacagggcttgaaagcttctatcattcattcattcattcattcattcatttcctcctcctcctgattacatgctagctatatgccaggtcctaggcaggcttctgaggatgtagagcttgccacacaggagacccaggttcatggggagacaggcatgaaaacagtgtgtagaatcactatgtgcacggtcacggactgtgcttgatggttccctttggactctgtcaaactatgtccagtgctggcagaatcagaccaccttttgctctgaggtctgtgcctccctcttccttgatcctgacactcactgtctgctgtgcctctgccagctctgtcaacttctcagggtccgctgctgatggcccctacctatagggagtacagcccgaaggtcaaagcaggagcctccctctgacagagtcccaaagttgagaggcctgcacacctagtgttatgtcccatagagttgtgcagcacaggcccctctgtccctccacgccactgtcagggtcatcagcctttcagtagtctagagtcagatgctgtcttatgcccacaggcaggagaaacctaacctgctgtggccttcagtgctccagcaccgtctagctccatctagctccctgcccttcctctgccctctgctttgagttgggtgaacatgaattatggttcctgctgccctgaatgtcccactgacttccctgtccctacaaacccagtgctcaaccatttctgtacaactaacccgcacatcctcactgtcagaaagtctttcctcactgctgtgcaagatctgcgctcctccctcaatgtgtctctcaggaccctggttctctcccactgtcataatatccatgtgcacacatgccttctctgctagcctattctttttggatattctgtccagcaagtggtagcgagccaagttcacaatgaatgtctaataaatatttatcgggcgaatgcatgaatagtaagtactgatcacagtggtttgccgcgcgcgcgagtacttctctaggtttgtttttctctcccgtttcccagtggggcccctctcagttttcaacctaatcaccttcgcagacctatttcctgcatctccctctctgtggtcccttccctgccacagcctctacaggtgggagaagcaggagattcgctggaccctcggtgacctctcttctcccctctcttctcacacaggctcggaagaggagctggaggagctgtgcgagcaggctgtgtgacgtgagctggtcagatgaagcttcgatggcgagtgtgctccagatggctcagggttcgacctggccccggggtcccgctcctgggaggagcaggaccacagcaagcatctcctttcgccatgcttcctgggaccactggaaggagagtgctgatggcgagtgcaggcgggaggtgctatttcctgccccagctcccaagcttgtctgcagaacacacctacagtgcagaaagtcttgtgtccagccagccagccagccagccagtatccagtatgcatttgtggggtagactcctcaaggctgagtttttgacaggaagctataagtgaatatctagatgtaaaggtgctgctctttcctcaagccccgctgggtctccccctgctgggtctcctctgccccagcttcaagctcacacaagccagtgggttcactgaaggcgagatcacgtctcacctcctttcaaggcttcactgggggcaacttcagctatatcatttcctgtcttctacaaaagaagaaggagtttaggtgagccccagtcccaagagaggtctctctgtaccttctccctggctggtgctcagggaggagcggttcttccttcctgttcttacaccaatcttagcctgcaggcttggggagccaaggaatagaggtctgtcccagaggtggggactgttacagacctgcctgggatgaatcttttgattatcaaactccttgtcactcgggtaactccagttcctctgaggtagagaccaggaatggaggggaatcaatactccaagctttcctccctccaagtccaaggcaggcagaaaggaagtctactaaactgcacctgggaagagggggaatgggatgaaggcagaggaggcacaactacaggagtcctctctgagaggttcttggagcagagatggagaatggcgacatgtaacctcgtgggtctgcagggcccggaggcccaccttcccagtgtaagccatacaaaaccagcaacccaactgaaggtgtgcaagtgggagtggagcagaaagttggcccgggcagcttgtaccacgtgggtaagggctgatggtgcctcctgtggctttgtcccagcatcctgaccactgtcagcccctcaggcagtatccttgcctgcaatgtgaaggtgggggcaaaatggacatgggatcctccttgggaaccttctctcctcagagtcaatggggagactggcatccaggcacccacatgggtatttatatctgaaccagacagaaagatgcttgaatcaggcactatgttgaaaaaatgtatttatttgctaatatatttatccataaatatgatctggctttgtggttttgtttcattatgattttttcactcaggataacaattccatcttctctatttccttttgttggatttttgaggcccagcctgactcccagttcactgcacagctaagatataacctcagactggtcctctcccccctcccaattactgggatcataggcatttaccattattccctctggtttcggatgctattggtgatatcaaagctggtcagatagggtaggtttaaagccccagaaaggtcagagagagcagcgtgcctggtactcgtcatgattcagtcatttatctgtgctgggctgctggtgactctggtgcttcactgactgactttgtgaccttacaatattgtaagcaaatactgaaccttggaatgtgtgcatacacgtgcatgcactcacaggagtgtgagggcagcctaatcgatacagcaagtgccaggacagcccgagctacagaataaagactttcaaaacaaacaaacaaacaaacatacaaacaacaagggcctctcacttgaacttgcctggagtccctgggatctgcctatctctggcccccagtgctatggttagagtagcagaccatcaaatcccacttatatgtggtgggtcctgagccagctcctcagcaggatacctgccttttaccataaataaaatgatcctccttcagagatgatagaaggcttacatgagatagcacagtgaaaatgtattccaaactgaaaagagatttcccggtgctagaaagtatctaaaacccagtcactgaaccccatgtggatgcagtttgggataaagcctagaatcagtcttgctgtccctcagtttcaatgagaagggctggaaggacagaacagcgggattgcaactatttatatcccagcgctccaattcagataaacacaaatgaccaggcttttgcctacattccaagagcctttgctctgttcacaccgcaccagacctcgtatttctgtatggtttgctcaggatattatctcggtgccatttaaggagacaaggaggaattttgtgtcctacacagtaagcacattggcagctggggtggggttagagtatgagaagtgagatacctaatccacagatgttcccatggaattatgtctaaatgtgccgagagttttacaaagcgtaaattatgagccaggcgcgcaatcgagaggcttttaggaggaattaaatacgcgtttccctctatccaacacgcctcccctttccccgtcggcacggctcaagctagcattcctggggaccgcaaacgaaaccctatcacgctctcccagttacaagaaggggtggggcctcgtcgggtttttgtctctgcaggcgtccagaaaggcaagactcattgcctcgagccttaaaacaacctagcgcgaagcggcgggcttgtattctgagcattccggacactgagacgaggggcttgtgtcaaaaagtcaaatacccgggcgtggtggtgcgcgcccataatcccagaactccgaaagtgaaggcaggaagatcaggagttcaagatcaccgtcccgtactcagaggccaacttaggaattagcattgtctcaataaatgagcaaacaaaataaaacaagcagacaaaacaatctaggttttcctcgggagtctgaagagcactcaggccagagcattttgggctccatcaaaaggcccgcgtcgcgaggcgcagtcccgccagtcgccccgctccacgcttcctgcgcatgctccaacctcccccagctgccccgcccctacgggcgcatcagctcccagcgcgcggcgcccgtcttccgctcgctctcgcgaaccaggtgacgggcgcgcgcgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccggaagcggaagctgcgtgcccgacgcgtctggcattctgggtaatggtctgtttacttcctgcggctggaggaacctgtgttgtcgtatcggtgaggatggccctggagacggtaccaaaggacctgcggcatctgcgggcttgtttgctgtgctcgttagtcaaggtgtccgttggggccttggttgtaggagcgatcggggaggcgaaacgggagaaagagggtgaaatggggccagacacaggaaaggaaggctctgagattcggggagtgggaagcccgaaagcctaagggagccgttgtttccgtccacggaacgcgagccgggtggctgtgcctactgggggctgcgttgcagttctcggcataactgagcacaagtttgtctccccgacagacgttcggtgaacttgctgtggtggactggaaagacactaggagccagagcagccgagagagtagcaggagagggtacctgaccccaaagaggctagaaaatatgtaagctgaattagggacgcgagcaaaaaggtatgagggtggagtttaggaacagtttggagaggagagggtgttgggttgtatagaaaacgaagaggttggctttgttgaaatattaaggcgttgttcatgctcatacttgctttttttttttctttccagactatagaccagttcgaatatgatgggtgtgacaattgcgatgcatacctacaaatgaagggcaacagagagatggtttatgactgcaccagctcttcatttgatgggtaagcccctttcacgcgcctttgtttacttctgcacccagaaagttaatatgggatagatttttgaggtcataagactagctggtctcagcagttctgagagctagtctatgtgtccagcccagtagctgtaaacttttgtagtgtaagaccccctttcggggacccccgctctagtctcaggagtgtgagagcacccaaagaaacacgaggacccatcttgctgtaattacatgaggacgtttaattacggagctccggaccgacatgtatcccacacaggagataacggatgccggccacgaggctcgaaagcttgggggttttatggggtaaggggcttaggggtgtggaattgagcatagcgacacactattggcttattcaaacattaacagaaagattacatgtacgtgcagggtgtcagagttctgtgagtagttgactcagttcagatagccctgttatgtcctcacattcccctttatcttatggtcaagatgttcccaggaatgttttaactatggggcatacccaggtttgtttttctcttttctcagccccaggcagcctctaggctcacaaacaaccagcaatttctgagtactttatatgacttacaggtcttgaaatttcatctttctttcagtagctactgagtacttgacatgtggctagttcaaattcgaatatgcttaagtgtcaaatacataccagcaaacaaagattcagggtgaggaaaaaggatgtcaaatgatctgnnnnnnnnnnnnnnnnnnnntgtcgtacgcctttaatcccagcacttgggaggcagagacaggtggatttcaaaccaaaaaaaaaattaaaaaataaatattgaagttattttcatctttattgttttaagtagtggctaagaggactttttttttttttttacctcgagacagggtttctctgtgtagccctggctggcctggaactcactttgtagaccaggctggcctcaaacttagaaatccgcctgcctctgcctcccaagtgctgggattaaaggtgtgcgccaccacccaccccccttaagagaacttttttaatgtgtgtacttcttctgtagtcctatttaacaatgcttcacaactcttgtctgctccattatcgctgagactatgtttatgttatgtcctaatgcctgacacgggatgtacgaggtgtagatctttaatgttggagaggtggaagtgtgatacagcagtagaacacgtgactaccacatacaaagaacacatgactaccatgtacaaaaagccctgggtttaattcctaatgctcctccaaaagtgttggctacatgaacgatctgttttggaaatgaaggggtatagtttcagtagcctactccctcttacagtatcttagtgaatatggtgacttgcacctatagtcccatcatctgagagagagacaccagagaattggaaattcagagggaacctcagatacatagtgagtttgaggccagcctgagctacctgagaccctgtctgtctcaaacaagaccagctaagctatctcagcagggtaaggcggctgatggcaggcctgctaaccctgacctcaatccctggatcccacaaggtggcaggagagaacacacacacacacatacacgcacacgcacacacacacacgcacacacacactcacacgcccactcaccccaagagagttaactacaaaaaatgggagaagagtggtctggtctttgctcaaggtagcagcattgctaagtttcttctggtcagcaggccagttaaagacctcatataagctgggcttacgcctagtgtttgttctgtgagagtgggtctggtgtcctttagaggagaataaaatattgggcaaagagatgttgatttggctccctttggctagtccattgttagtatatgagtttaccctttcacaagtatttgtcatgaactgttgctagtcaattgctgtcttacaatgtatttatcaatacactagttcgtaagtactcgaatgctaaattattcacaaagaaaatgaacagaaagtaagctaaatctaagagagagagagagagagatgctgatttggagcctttagctcctgtgtgtgcagatgcgtatttctgtatttccatccctttgtttcctcaagccgttcaaggctgacaatgaatgacgaagctggttgtgttgatgcagccttcagtcctagctctcaagctgagcaggggacacaagtgtcgggtagccttctgctgcatcatgagacgacgcccccatctaaaaattaaaatgtaagtggagtcgctctcatctgtaagggaacacctgtgctagctgcgttgaaagatgttaagagttacacagtaagatataagcaagggtcactttgaatccttaccagtttaacctgtttaaacatcttaaagacatgctttgtttttaaattatgtgtgtgtgtggctatgtgcacatgaatgccagtgtcctcagatccccttggagttcgagttacaggcagctgtgacctgtcctgtatgggtgctgggagctactggggtcctcttcaaggacagtatgtgttgttaaccaccgagctgcctcttcagtttccaaaggtttcgttctttttaaagtttgctatttttattatatatataacagggatttttaaaatgccatggcttcttacctctggccatcgtgaagaacacacttatgtagattaactacagagctttgggtgtctgttagtagaatcgctgtatcagaatgtgataactggtcatctgagaaacctaaaaggagtacttttattttccaacatttatttattattatatgtgagtacaccgtagctgactttagacacaccagaagaggcaccagatctcataatagatggttgtgagccaccatgtggttgctgggatttgaactcaggaccttcagaacagcagtcagtgctcttacctgctgaaccatctcaccagcccctaaaaggagtactttaaggttccaggttttttgttcttctgttgtttagttgggttttttttttaaattttaattcattaacttagtaggttggttattgggtttttttgtttgtttgtttttttgggctttttgagacaggatttctctgtctcctggtgacctcgaactcacagagatccacctgcctctgtctcccgagctttgggattataggtgtgtattattcctggttttgttgtttgttgcttttgaagagccatcctgctgagtgtggattatatctttataattgttaccataatagagcaaccctctttttaaaattattttggaaacagggttatttttaagttggccaaatagaccttggaaaccttctgctttgcctccagactaactggaattgtgggttacctgatcaggcctgactagaactgtagggtctcagaggaagttgagacgaggtagaaaggacatttcaaatattatcactgagaaggtcagttatgaagggtagagaaagtacgggggtgggggtgggctgtgtaactgcctgttccgggatcagtctgcagagccacttgctatcttaccctcttccatcctggacgccagcactgttgccaggaaaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggattcattgttttgactcctttgcagcaggcgccagacccctagtgattgggctggttgtcgtcagtgctggacatccacaggtaaaaacttactggcccggcagtagtgtccgcacggctttaatcccagcacttgggaggcagaggcaggtggatttctgagtttgaggccagcttggtctacagagagagttctaggacagccagggctacacagagaaaccctgtctcgaaaaacaaaacaaaacaaaacaaaacctcttcttactggctgtccagggacataggcagaaaggctgtgtcactcccttcccggtgttagaagcttcccagcttccctgtggtgattttctcctcaggtgccttgctcgggctgttgctttggggagctgctgtggccccctccagcagggcaggcttgggctgacgctttgtcttcctctctagaatcattgcgatgatgagtccagaggacagctgggtctccaagtggcagcgagtcagtaagtatcttacacatgcacgtgaacgtgtgagagctcattctttctctctctctctctctctctctctctctcacacacacacacacacacacacacacacacactttcatgcatgcatcctacccctcttccatttttggcttaattctttcttgcttttcagtcttaactcaattcccattttaatctcctctcttcctcaggtaactttaagccaggtgtatatgctgtgtccgtcactggtcgcctgccccaaggtaatagttgtgacttcagcagtgagcatctgccaggcccagggcaagcctctgtctcccagtgccgaggatggggtggtgggcgtatttatccttgtgactgtctcatgggactgtttctttttctgtcataggaatcgtgcgggagctgaaaagtcgaggagtggcctacaaatccagagacacagcaataaagacctagctaggtgcaggccatagcatcttgttcttcacttctgtacttgttttcttgtggaactaaaccgtgggaccccaaagactccccgccctccatctccgaatcagcagactccacgaaagcagcacatcggccttaagtcatctcactttctctgcccactggtgaagtgggagtgtctgggcggattctcagaggctgtgtcaacagaggaagatgctgatttcccacctgtgttcagggttttgcctttgtctatgggcaggactttggttcaaataccaataaagcgagcctttggaacatacttaaagggtactgaggcctgtgccttgtgttccatttcctctcacagtgaggcctcacttgcctggtgggctctgaggcagctcagctgaggtcctttctctggcctgcctttaaggggtacagctgctatgctgtgcttgctgctgtatcgtgggaaggtctgctgtcctgaggcaaggaaactgtgctgactggaaatcagcgttctgtcctctagacctggtgcacactctcctttgaaggaacccggggctccttagtgccttcacccttgatgctcctacttctcctacttcctgtgtctcttttctatgctcttgctgtacctctgccagcttcagagttcacattccccttagtacccttagtggctgttgggtcttgatctgggtttttgtgtttccatggaaacacaaactcctcctaagaagggagccatccatgggtaatgccacattggccaagatgtgttgtttttataataacatatttaccatatatccttaagttgcagaaattgtatccccattttggtttctctttagttttcatctgtaaaataggagtgattattcctgtttaccctgtatgtttatttcagggttataaggcctggaaatgaagaataagaaaagtacatagcagcggggtggtggtggcgcatgcctttaatcccagcacttggaaggcagagacaggcagatttctgagtttgtgagttccaggacagccaagattatacagagaaaccttgtctcgaaaaaaccaaaggaaaaaaaaaaaaaagaaaaaaaagaaagaaaagaaaagtacatagctcccctaaaaggatcagatgtggcacatgcctgaaatccagcccccagaatctgaggttggggttagctcaagtcggctacaaagtgagaccccatctcaaaaagccaaatagtagtaaagagtactgtgtaaagagtactgtgtaaagtttgttgtctgactgtcctgctgttcttcggtatttacaccgtcttcaccattaggcgaaattggggactatggccagaaccttcttgggggagcaccaccttgctagcggaggtacctgcactaggctctgtctcagctgttgtcacctgctgaccctgtgagtgtagaaagcgagctggtgatgaccaggctacttatccagtcactggtccccactaggagtggtttcacctgcaccctcaagctttgagggaacagatcatcaccctcaattctaaactgagctgttgaaggagttctctagcccagccatctcaaagatgccatcgctagcgaattctccagtgagttccatttggaaggggccttggtggcttgtcagagtggaacttacctcctggagggaacgagaaagtttccccaagagggtctaggctgtggagccaacacctcagctttcactggctttttcagaagtcccctggaaagccccagttgctgttctgtgtacatgacccggatgtgactgtgtggtgagaatggaaacagttgtggggaggggaggcaagaagagcctgcacaaataaccacagtggggctgcttgagtcccatacctcttgggccccaactgtcaatctcacaggaagtgaaagacgtcgactgtcagccatggggagcatgggtcttgtcaaagtgtcctccacctgggagctgcttttccatgcctctcatcctgtggtactagaaccttctatattagctgctgcccagacaggcaagaaagtgctagcgtcctacccttggagctgaaagacgcttgagacaggagtttggttccggactctcagggtgggctgttctgtggcacaggggcctttcaaattccaggactgctgtctgcattctacctccttaagggtgcagtgcttgctaaagttagacctaccctagcttagctttaagtagaccctggtcttaggcactccctctgactccttcagtgctgggggttcaacctgaaacctcatcgtgcatgctaggcaagctgcctaccactgagctatctccagcccttgcacttttggggccatacctcactaattttctgtactggtgagaaagtcaactgtaatgcaggctggctttgaacttgggattccccctgcctcccaagtaactgggatggtaggcttgcatcacgaggcctggatcctcttggtgtcttgttcagtggtttgacccctgtcccttgagggggacaaggctcctctcctgttcaacgggtagattcagctcagacaaaactagcaacagcacctggcaagctgctttgagactgttgcctgatcctcaggttctgcccaaagctgaggggcacagtagcagcgcagtggtgaccgaaagctggtagagcaagagtcacaatgtctcagcagagagcagtttccctaagaataagggtgacaggatggcttgccagggtgggggcagaccctgttcttgaggtagccaccatgttcccctcagcctgtcttcaggcctggcacctgtcagacgactgatctctgagtatatcagaagcaggtgggcaatggtaaagacagacttcacttggaagtctagctcccactcagtatctataaagactttcatgtaaatagtatttggaagttgacaaaagcctttgacatccatgatctcatctgctctgaaactcctgggacatggtccttgtttagcaacagagacaagctgtgagggttaaagtggcttagccacgattaagtcgtggggccttagctcaaacaatataataaacacagttgagcactgatgtttctcacctggttactgcctatatgagggttaggcagaagtgtgagcattagcgttttctttgaggtcataacacctagtccccactacagaccgtgctgacctctctgcttaatgcctctagtccccagtctgaacttagccatgaggcaatggagtgctaggccagagaggaggccaaagggaaactgggccagttctcttcagcagcatcgtccattcaactcccaagtcctaagtacctgccaacctgtgcccacatttcccatcctcttccccattgtcttctctccctccctccatctgaacctaattgtggcccccaccacaacctgatgggacacagacccttgtgtatggcgaaaacatgtccctgctgagggcaagaacccctgcgtccccgacctgctacctctgccaaccatggccctatgacttcaaatcatggtgtctacacattttcttctcttcctttctcttctctaattttcgttttccttctattatctccttccttcttttttcttttttctttctttcgacagggtctcactattgtaacctttcctggtttatctagaactcactggaacagactgcagttgaattcaaagatcaaccttctgcctcccaagagctgggactaaaagtatgtgccactgtgcccagtgccgagcttctctacaaaacccagctgacaaagctattggaccccttggcaagacagatgtgcctgtgttaggccccagtgggagagagaacgcaggataccaaagtgccaggaagatgtattatttcccttctttctctcaaccaagcactctaccactgagctacactcccccgagttcgtaaactttggagacagttcatcaaattattcaaactggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccgtgtgtgtgtgtgtgtgtgtgtgtgtgtgtgtgtgttgctgaggtttgaatcagggatcttgtgcagagcaggcaatattctaccagtgagatctatacctagtcttatttttcaatgtattatgtactttgccatctgcacacaagaatcaggatacgacttaaacctctacttaactcaaagtcattgttataagcctccatatttgtggtaaaatgatttcaggactaattatttttttaccccttggattcacagcctgtcagctgtcgcgtctgtcattcattcatggctgtctcccttctagtttttcttgagctggaggaacagacggccacatttggtacatgctgtagtgtggcgggtgagtgagtaaggcttagatcaagaaaagcacatggctgcttgcctaggtctttggttgagtgcagagacctccatctgtgggagggtaagctccggactgctggggctgtagcgctgaaggcagagagaatattggagctagtggaggattattaaggcctccaccttatgagggacaggaccagaccacatcagcctgattccaggagaaaccatggctgtgagatgtgtcctcagaggtttttgcctcaaggtgctgccatcctctgtgaatgtcccaggaacaggaaccaaggaaacaccatactgccctgtgctgttgacatcaacatgagaactaggatgaaaactatcatcccgttgagttctggcgctccatctcaacacgccctttggggagaggacaggctctcacacatacagagctctgtgtgttgcttctgtctgtggacctcctgcctgcaaacagagggaagagcttcacgcaccaaggcagggcccctaattgctttccaaaaagtgcttctccttccttctccccatacccagcatctgccaccctcaattttttttcccctttggaaaaaaaaatacctgtagggccattaaccagaaaagggtggtagcgctggtggcgctggtgatgggacagtgtggtaactgtcgattgttccctccctcgggggttgaatagcaaaagttcgaagggaaaacacaactccgtacttgggaggggaacaagccctagaagggtgagggtgccagtaacaacttagtcttctctggaactctggacctgatggggactggatgacctgagaccacggagtgacgggaaagtccagagacaacctggcagcttccccatctcataaaggcagcttgccgcactttctctgggcagctgaagagactcacttcctcagctccgccccctagagaagcagcaagatggagggcgggtctcagacagagaggtggggcatgacttgggatccaggtttctgctgggctacatgaggtagtgaaggcaggcatgttcgtaaattagccaattatcagtctcttctaccgaaggagagaagaatcgcccactctctcctcttagaagtaccaggactggaattgaaccgatgccctggcaaaaggatctttcctgacgactgggggcaataacatggtgggaaattgccagtggcctgtggttccttcagagcaagtagactctcatgtggtaatttccaggttcaaaactacatcgggtcctcagttcccttctcacagacgagaacatttgagcagcacacggaattaacctttccccttgcccatcacagcgtgcttacaggctcaggggtaggggagggcagtcctccttgggttccttttgcctccaggaactccaacacgcagttggggccagggggagtgcgtagttgtgaatctgcagacctcagcatcaaggtccctttgggagtcaggcccctcaatacacagctatgttcactaaccctcagacccttaggggaggtgagctcggatcccctgccccccatctcccacctccatttgtctccagcctctcacctccccctcttggaaccacagccccatgacgctgacactcatgctccattggtctacgtggagcacatttgcccttatttggctaggccagctccaggctgggcctccacctccagcccagcccccacaggcttgtgtctctctcacttcgtctttttgaggtttggctgtggggcccagtgggcgtcacttcaaacgcactttctggttgagtcacttttaacggctcaatgctgtgaacgaacggctggggctgggactggggctctttgctccgtccccaggcaccctttagggttggtggctaaccctcccccatctgaccaccgaagagggctgggtggatggtgaccttgggcaggttttgcagaccactcggtgacccatttagtcacatccactgtccctacttacaagcctggggcagggaagtggaccctgagtccctcccatagcttttccagctttttccagctccttccttagatgggaatttgagaggacagacaggtcctcatgggagaactgcgtctttgggggcaattagaattgactcttttgggaggacagaaaaacggggtgcagactgtcggtctgacatttaggaagaagaaacttaacctggccgagattccagttcctcaattcgaaatggggatactgacatttgtcttactgggtcagctcgatcaaatgagatgcagtggaccctcctacggcacggagagtgcgacatggaagccaggctagctcctacacgtgatggtctcctcttccctcaccttatcttgtatttccagctgtgtcttgggcgtgaggaatcctgtggcaggcaggaggttgacagaagagttagagagccctctctggactttaggatgtctactgtacatccatgggtgaagacgtacagctgccctgtggtttggtgggtttagagcatgatactgttgcttcctcctactactaagggtcttggacctttgtccttgggaatactccagagtgaaaacaggtccttcagtggactctattctatagtcaagaaggcaggattcagtaacaggcccgaggctacactataaaagctccaagaatcttgtccctccattttgtgctcttggctgtcatcttatcaagggtaggatttaggttgattgacagatggtagcaagcactactctcccaaccccctctccttgtttgctttcctgtgtcagtgtgatcagaggagtcgaagcccaagcatacacatactcttcacattcactgtgtgtcctggcttctcttatggcatggagaggtgaatgtgtggagcccaggatggatcctacacatggcaggctctctctctctctctctctctctctctctctctctctctctctctctctctcacacacacacacacacacacacacacatacacacacaccaagggggggttggggagacagagaagagagagagagagagagagagagagagagagagagagagggagaggaaaatactgtttaatctggagccagaatagctatgcacattaggccttgcacccatgtgtagacagaactttcctttttctctgccagcatccctaggagatcccagaggagaatgctgcttctggttttgtaaccactcccacagctgtggcgagggtgcctctctccctttcacaagcacccccccacttcttccccagaccttctgcttcttcccagacgctgtggaaagaaccttgcccttggccctcacctcagcctgccttctgtttctctctgtgcttgcaacttgccttcctaagggccggtgtgctgcttgaatccccggtcctgtgatcccggagcggctgagccagagccctacaaaacagcttcccagacccagccatgtgtcgcatgtgttggagcggctccttgtctgacaagacatgagcatgaggttgaatctgaaagatgtctggacagaggaggcagaggccaagggagactgcctgtccattctcctggcctgatagggagcaaccctcttgctctcaaggcagtgaggtgacccaggacccccctaggtgctgagctgacctctgctggggactcagttggggcacttctagccactgacccttgctttgcttttgtgattggctttaccaagttttgtggtgctgggagatcagtttctctcctttgtgggaactcttgcttcaacgctggctccctcgagggtgggcctctcagccttctccacttcctgtttgtgagtggttagctcctgtggcttttttctcatcataagcaggttatctggcctgccatctctgcctgcttgtctgtctgcccactgagtgaggccccaggcccgtgcagctggggtgaagtcttggtttttatctcaatgctttcactctgggccttcaatccttctaaggcaaaggccttaacataggctttcgagagacctcttctctgcctcttctctttgcccagttaccccttccatgtcctctcccacttgagtgtannnnnnnnnnnnnnnnnnnncctccatagcaggcctgtgtgttttcttcaggcccgcagccctcatctcagcatccacggtggctgtccttagagttagttaggaaggcacgggaggaaaagactgggtttctggaactttctcagccctaatttcacttaggggaaatcccaggaaataagaatctcccagaaccaggggctggagatacagctgtgttggtagagtactggcctagtatgcactaagcctgtggtcccagcacttaagggaggggcaggaggatcaaagttcaaggtcagccttgattatctagcaagtccaaggtcagcttgagctacataggatccagtctttaaaaagggggtgggatgagtccaaagagatggctcagcagttaagagcatttattggctgctcttccaggggcatctgggttcagttctcagcaccagcatggcagctcacacctgtctatcactctaattccaggggaatccctacaccttcatatagacaaacatgcaggcaaaacaccaatgtaaataaaattatttacaataaaaataaattattaaaaaaaaaaacaccccacaaaaacaaaaaacaaccaagcagctaggcatggtggcgcacgcctttaatcccagcacttgggaggcagaggcaggccgatttctgagtttgaggccagcctggtctacaaagtgagtttcaggacagccaggaataaacagagaaaccctgtctcgaaaaaaacaaaaaacaaaaaacaaacaaacaaaaaaaccccaaaaaacccagccaagtatagtggtgtatacctttgatcttagcataggagaggcagaggcaggaggatctttgtgagtttgagaccagcctcttctacatagtgaattccaggataaccaggactacacggagaaaccctgtcatttaagtgaaaaccagaaaggaccttggaggatatttttccacagaatttaaacggtggcagctgcctcgtgtgtgcctcactgtgtctggatgcattcccaagggtggacttcaaattgtccgcttgaatttctctctcctcaaccaagaaagccattaagacctccccttccacatccagaccaccaccgatggtttcctttgtctcttcctggggagctcgggcagcaggaagcttttgggggcaacagagggggttaggcctgtcctttagtgacacctgtgtgctccaggacaactgtcagtcatgtcactggcccgtgtctttgcaggaggcagggatgtccaggagtggataggaggccctctagatgagctgttgtcctgagctggctgcatctactgtgtgtggctctagggtgtcccgcatcgcaacagctcacgggtgtgtaccccattcctcacggcacacacccactcttctatcacttactgtcctcacgtccttgcctaagattctgcccctttgcttgcctttc

SEQ ID NO: 1826 - DNA, 693 bp, Mus musculus
cggctggaggaacctgtgttgtcgtatcggtgaggatggccctggagacggtaccaaaggacctgcggcatctgcgggcttgtttgctgtgctcgttagtcaagactatagaccagttcgaatatgatgggtgtgacaattgcgatgcatacctacaaatgaagggcaacagagagatggtttatgactgcaccagctcttcatttgatggaatcattgcgatgatgagtccagaggacagctgggtctccaagtggcagcgagtcagtaactttaagccaggtgtatatgctgtgtccgtcactggtcgcctgccccaaggaatcgtgcgggagctgaaaagtcgaggagtggcctacaaatccagagacacagcaataaagacctagctaggtgcaggccatagcatcttgttcttcacttctgtacttgttttcttgtggaactaaaccgtgggaccccaaagactccccgccctccatctccgaatcagcagactccacgaaagcagcacatcggccttaagtcatctcactttctctgcccactggtgaagtgggagtgtctgggcggattctcagaggctgtgtcaacagaggaagatgctgatttcccacctgtgttcagggttttgcctttgtctatgggcaggactttggttcaaataccaataaagcgagcctttggaacata

SEQ ID NO: 1827 - protein, 128 aa, Mus musculus
AGGTCVVVSVRMALETVPKDLRHLRACLLCSLVKTIDQFEYDGCDNCDAYLQMKGNREMVYDCTSSSFDGIIAMMSPEDSWVSKWQRVSNFKPGVYAVSVTGRLPQGIVRELKSRGVAYKSRDTAIKT

SEQ ID NO: 1828 - DNA, 27189 bp, Homo sapiens
cattcaacaaatacaccaagctctattatgtgtcaggcactgttccaggtgctgagggtagtacagtgaacaagatgacaaaaaactcctaccctcaaagagcttttttattctagagggaaaaaacagacaataaacagactaaataagtaaaatctataatgttttagatggtgatatgtactacggagaaaaaatgataatgctgatagcaaagtggggagggagggaatgcaagggaacaaggttttttttttttgtttgtttgtttgtttgttttgagacagagtcttgctctgtcgcccagggtggaatgcagtggcgtgatctcggctcactgcaatctctgcctcctgggttcaagcaattctcctgcctcagtctcgcgagtagctgggagctactaatttttgtatttttagtaaaaattaacagggttaatttttaaaagcaagtccagagaaggccacattgagaagatggcattgcagcaaagaccctaaatgggagagggagtgatctgtgcaggtatctgaggagaaagggatctaggcagagagaacagtaaatgcaaaggccttaaggcagaaatgtgtctagtgtatctgaggaacagcatgaaggctgtggctggaacagagtgagacggcagagtagctggtgggggccccgttgtattggactgttgaggccatttgttttttactgtgggtgaaacaggagccactggagtgttgtgagagaaagggcatcacgatctgactgaagttttaatatgatcattcctgctgttgtaatgagaatagactacagggaggcaaagctggaaacagagaaaccatctaagaggctattgcaggaatccaggtgacagtaatggtagcttggattaggaaggcggcagttaaaatggtgagcaatagttaggctctgggtatattttgaaggcaaagccaacagatttagtaatggattgattgtgggatatgagaggactcaaggacggcaccaagatttttggcctgagcaattaagagaatggaattgccatttgctataatggggaagacggggaagacaggtatgtggttggagatgaacccatggttaataagatgaggcctataagtttgaaatgcttattagatatccaagttgaaatgtcaagcagcggttggataaaaagtttctctcatgggtcatcaaaggaagaaaagctaatggtataagcaggtgggtggactgggagagcttggcatgcttggcagagccacatatgagctccgaggagacgaactcctaaggatgttcaactggccatgtgatctacctgagtgactgggaacggagtccaagcttgggtccagagagggagggaaggggagcccatgccccaatctgagccccattcctcttcccaggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggtaaggcaggtcttgtggttcacctccatgaccagactggggagattgaagctgggggaggggtgggcaggcctaggggctggtatgggtaccctggctacatctgtttcccatgtgtcctgcatgaggcagagatcagggaccagcctgaagtttggtcacttttctgaccttccagtgaaagagcactattgtttgttgagagtgtaccacgtgccaggctgcagtggtgctttggatgcattatctcattttagacccatggcaatgaagggtggggttagattcatttttttatcttcattttacagcagaaaactgtctgttaagaaagttgcccaacgtcatgcagctaagtgcaaaatccaggtctatgtgatgccaaagctcataccattcctattctactgtgaggtcttttacaagtagataatagcaaggagaggcctaagggagttgggggatgtcctgattcctggcaattcctatggctacagaagcctttggtttggaccccctctttttctccaggagctacgggtcatttcctgcctccatgagttccatcgtaactgtgtggacccctggttacatcagcatcggacttgccccctctgcatgttcaacatcacaggtaggaggtgggccaaggactcccctctgtgtaggcagacaggtctagaatgtggcttccctttgggaaagggttgcagccttgaagctggggagaaagcagaactgccaccatagttgtatgggctgtacactgctccagagtgcctcactcgaggggaagcgtcattcaaaatgtaaatatctttatttatttattttttaattttaatttttattttttgagacggagtttcactctcattgcccaggctggagtgcaatggcgtgatctcggttcaccgcaacctcctcctcctgggttcaagcgattctcctgcctcagcctcccgagtagctgagattacaggcatgcgccaccatgcctggctaattttgtatttttagtagagacggggtttctccatgttggtcaggctggtctcaaactgctgacctcaggtgatctgcctaccttggcctcccaaagtgctgggattacaggcgtgagccaccgtgcctggcatgtagatatctttattattattattattattattattttttgagttggagtctcgctctgtcgcccaggctggagtgcagtggcgcgatcttggctcactgcaagctccgcctcccaggttcacgccattctcctgcctcagcctccggagtagctgggactataggcgcccgccaccatgcccagctaattttttttttttttggacttttagtagagacagggtttcaccatgttagccaggatggtctcgatctcctgaccttgtgacccgcccgccttgtcctcccaagtgctgggattacaggcatgagccaccgcgcccggccgtagataatctttattattgtaaaaattatttgtatttcatggcaagtttgttgattctaaatctgggtgatttatatgtttattattccaattttctggcaataaaatattctattctaacaaaatcagtatgttaacataattttctaaaagatgaaagtgaaataaatatcttgaggaaagagaacctttttctaaggtacccacaggtgccctatgggctaacagtggccctgggtgaaagagctccaaatggctgaggggaggtttagggattgacacgcatagtggccctcccagggcaggcaacctgactggagggaacaaaggagtcccagagcacaggcagcttaggcacgtccttgatcccccaaactctgagctcacaggctactcagggtcaaatagattagctacagccatgtctttctgaatgcattctctgtaggtttgtagagttaaacatctgtgctcttggttcttttttccagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggtgagttttcagagggaagtgggtgtggtagggagaggagactacagctgaatatttcaggacaggtgaagtcagccaacaaagggttgatggaagctgagaaggatacagcagagatgacaaccaaaatacttaaccatcgggacagcgtatcatgctggctagagtgcaggaacaccccacctctgccaggtgctacccctttagttggcagatcacagggaggtcccagggaggtgctggtgtggctgaggcatcagaaaggcacttggaaggccgggtgtgatggctcatgcctgtaatcccagaactttgggaggcctaggtgggtggatcccttgaggccaggagttcaagaccaacctggccaacatggtgaaaccctatctctactaaaaatacaaaaattagccgggtatggtggcgggcacttataatcccagctactcaggaggctgaggcaggagaatcgcgtgaacctaagaggcggaagttgcagtgagccaagatggcgccactgcactccagcctgggtaacagggtgagactccatctcaaaaaaaaaaaaaaaaaaaaaaaaagaggcatttggaatggtccccggggtagtagctcaaacataagtgtttctaaattttaataactggtttagttctaccaatgctcacagctcagtattagttctaaatacaaagaaggctaagaagtgttcctcggggggagctatagtagaaataattacacataaccataatacgaggctatataagaagagctatgtgaacaacgagaaaaaagagagagagagaaaccacaggtggttcccagcagccctgtggagccttaggttttcttctcttcccctgtggtaaaagaacaaggaggacttcccttcaacacatcattattaataagactgaccttaatttcttggggattcagtgcatccctatatcataagcagtgatcacgtaaattctcaactttaacatggtgtttacttgcccacatatctctcttttccattcaggaccttccaccttctactcttccccatcttcccccattgtatggatgacacagttctttgtctacagccatcactagaacccttccaacccaggaggtgacacaaaggtcctgaaatattcttcagtgtaggaattcttcctgcaggacctaggagctgccctcatccaattcattcatttattcatttcctttctccttccttcctttttttccttctgactatatgcctgctttgtgctaggttccaggctaggctctgaagacatggaacttgccaatcaggacatccaggtccatggggagagagccatgtactgcaagctttggctatgtgtttgtgattccatttggaccctattgtgtgtgtactttgagtgctgccagtaccacaccactatctcccttttctctcaaactcagaactagtttcagtgcctctctttttcttgcctttcacatctaatcagtgccagattctgttaactgtatcttggctagctttatcatgttcttttcaagtccagtactgatggccctgccagtgtcttaggtataccctaaagatccatgcaggagcctcctagctcttcccttccctcttacagggcctcgaaggctgagtgctgcccatccagtatgtcccataaagttgtgcaccacagctccactgctcacctaccctccctattgctgccagcgtcatctgccttacactaaactgtccagaaatcttcaaatgttctgtttgtccacagagaggaaaaatccaacctgctttggcctcaaaggttcctgcaccagccagcccccatcttccttctcaaccttattttctattctcttccctcccttccccaggcccatgctttagccaaactgggtaaacaattcttgtagttcctgtagcccagaatattctcctgccttctctattcccataaatctaattcttacctattcctacagaatcagctcatttatccccacttccaggaagcttttcctgattgctgcacttggacctggtctctctccttccttaatgcatctctcgtgactcctgtcctgtcccactggcgtaatggccatttgttttcatactttctctccaaaaaggttaccaggtccctgcttattctttttggtcttctatttggcacgtggtagcagaccaaattcacaacgaatccttaatatttattgggtgaataaatgaatagtaagtattggtaacacactggttgctatatatatttctttagatttgtttttctctcccctgtgtcccaactggggcccccttagctttcaatctaaccaccctttccagacagtctctgcttctccctccctgtggtcccctctcagccacactctgctgcaggcgagagaagcaggtccctggcctgaccctcaatgacctctttcctccccgctctctaaatacaggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaatgtggtctggtcttgtggttttgttctgtcgtgactgtcactcagggtaacaacgtcatctctttctacatcaagagaagtaaattatttatgttatcagaggctaggctccgattcatgaaaggatagggtagagtagagggcttggcaataagaactggtttgtaagcccctaaaagtgtggcttagtgagatcagggaaggagaaagcatgactggattcttactgtgcttcagtcattattattatactgttcacttcacacattatcatacttcagtgactcagaccttgggcaaatactctgtgcctcgctttttcagtccataaaatgggcctacttaatagttgttgcaggacttacatgagataatagagtgtagaaaatatgttccaaagtggaaagttttattcagtgatagaaaacatccaaacctgtcacagagcccatctgaacacagcatgggaccgccaacaagaagaaagcccgcccggaagcagctcaatcaggaggctgggctggaatgacagcgcagcggggcctgaaactatttatatcccaaagctcctctcagataaacacaaatgactgcgttctgcctgcactcgggctattgcgaggacagagagctggtgctccattggcgtgaagtctccagggccagaaggggcctttgtcgcttcctcacaaggcacaagttccccttctgcttccccgagaaaggtttggtaggggtggtggtttagtgcctatagaacaaggcatttcgcttcctagacggtgaaatgaaagggaaaaaaaggacacctaatctcctacaaatggtctttagtaaaggaaccgtgtctaagcgctaagaactgcgcaaagtataaattatcagccggaacgagcaaacagacggagttttaaaagataaatacgcatttttttccgccgtagctcccaggccagcattcctgtgggaagcaagtggaaaccctatagcgctctcgcagttaggaaggaggggtggggctgtccctggatttcttctcggtctctgcagagacaatccagagggagacagtggattcactgcccccaatgcttctaaaacggggagacaaaacaaaaaaaaacaaacttcgggttaccatcggggaacaggaccgacgcccagggccaccagcccagatcaaacagcccgcgtctcggcgctgcggctcagcccgacacactcccgcgcaagcgcagccgcccccccgccccgggggcccgctgactaccctacacagcctccgccgcgccctcggcgggctcaggtggctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaaggtgtcagtcggggacctggttgtagggcccatgggggaccaaggtcggggaaagagggcggaatggggctgtgggacagtaaagagaaaagttaagtctcagaactcagaggtggcagggggagtgagaagccgaaggaggccatcgtttacctcgtaggatcgcggacaggtcttgcagctgagggcaggggcggtcttacatgcctttgaatcctcagctcttagacgttcggtgaacttacgttggagccgaaagacactgggagtcagaggcgggtggggatccgctgctgagtgagtagtcggaaaggatgcctgaccctgagtagactagagaaaggaatagataaaacggaattgggaacgagagaggaaggagtgggagggtgggacttaggaatgaagctttgagagtagtaggtggggaaccttaggatacacagtcaacatagggaaacaagaaattgagcaggtcgaagtattgagaaagctactttttctcttggtcttgttcatgcttatctctccttttcctttatttttctttcactcccagactatagaccagtttgaatatgatggttgtgacaattgtgatgcatatctacaaatgaagggtaaccgagagatggtatatgactgcactagctcttcctttgatgggtaagccgcttcagtttccatcattcacttctgcattacccaacctgcacccagagaagtaaatgcagggcaagtgttaatcctagttgggcccagccattcgtttttgggggttattttgtgtgggtttttttttttttttttttttttgaatcagggttttgctctgtggctcaggctggagtgcagtggcatgatcatagctcactgcagcgtggaatgatcctctgacttcaacctcccagagtgctgggattataggtgtaagccactgtgtccagcctcaacagttattttgggacatactagtgctatgcatctaatacagtgaccactatccacgtgtagctactgagcacttgaaatgtgtctagtccaaattaagacatgcttttaagtataaaatataccccagatttcaaagacttaacatgagaagaaagaatgtaatcttaataatgtttgttaaatgcatgaaaattttttttgaaaatgaagggaagggaggtgtagtaatggtagatcattgcccaaaagctgttgctttttttttttttttttttttggacagacttttcgcccttgccactcatgctggagtgcaatggtgcagtctcggctcactgcaacctctgcctcctgggttcaagcaattctcctgcctcagcctcttgagtagctgggattacaggcacccaccaccactcccagctaatttttatatctttagtagagacggggtttcaccatgttggccaggctggtctcaaactcctgacctcaggtgatctgcccacctcggcctctcatagtgctgggattacaagtatgagtcaccatgcccggcccattttagccattttacttatttatttatttatttatttatttgagatggagtctcgctctgtcgcccaggctggagtgcagtggcgcaatctcggctcactgcaacctccgcctcccaggttcaagcagttctctgcctcagcctcctgagtagctgggattacaggcacctgccaccatacccagctaatttttgtatttttagtagagacggggtttcaccatgttggtcagactggtcttgaactgctgacctcgtgatccacccgcctcggcctcccaaagtgctgggattacaggagtgagccacagcgcccggctgcaatggcacgatctcagctcactgcaacctccgcctcctacctcagcctcctgagtagctgggattacaggcgcccaccaccacgcccagctaatttttgtactttttttagtagagacagggttttgccatgctggccaggctggtctcgaactcctgacctcaggtgatcctcccgtctcagcctcacaaagtgctgggattacaggcatgagccactgtgcccggtcgccatttctaaatacacaattcagtggcattagtgcatactcattgttgtgcaaccgtcaccaccatccatctccagaacttttttcatctgtacccattaaacactagctcctcgttctctcctccctcctgtccctgacaaccaccatgctttgtctctatgaatttggccaccttaggcacccttaggtacctatgggctcattcagtagcattttgtagcttctttcacttaacataatgtcttcaaggttcattcatattgtagtatgcaacagaatttccctcctcttttgagctgaataatattcccttgtatgtgtatagcatgttctgctgcccattcattcatcaatgatatcttgggttgtttctcccttttggctatttgtgaataatactgctgtgaacattggtatacaaatatgtgttcaagtccctgcttttcattattttcagtacagatgcacctcaacttccgaggagttacaacctaataagcccatcataagttgaaaatataagccaaaagtgcatttaacacacccaacctactgaatataataagttagcctacttcaaatgtgctcagaacgcttatgttactgtggctgaccagaagctgtggctcatggctgctgcgcagcatcatgacagaatattgtactgaattgctagcctggaaaagaacaaaatttaaaatttgaaaacgatttctattgaatgcatgtcacttttgcaaaatcataaatttgaaaaatcataagttgaactaaggtaagtcagggatcatctgtatatccacaagtgaaattgctagatcatatgatagttcagtgtttaattttttgaggaactgtcatactgtttagcaactgcaccattttccattcccaccaacagtgcccaaaggttctaatttctccccatcctcaccaacacttaattatttattaataatagccatcctgatgggtgtgactttggtgtcccatttcccccaatgaatggtgatgttgagcctcttaggtgcttatagccatttgtatatctttggagaaatgcctattcaaggcctttgctcatttttgacttcagtttggtttttttgttgttaggttgtaggaattatttgtataattctagtgcatattaggtcttaaagagtgggcaaattaaagatcggaagagggctagatgacctcaaccagaattggaagaggtagtactttcctcttaaggcaagaagtttgggatttttgaggaagttgaggtgagagagagagagaacattccaaataaagggagtgactagagcaaaggcttaggatgggaaaaaccaggatgtttttggagaacagtgggaattctgtttaggttaaatcataaggttgggctgtagggaccctaaggctaaaaagatagattgcaaaggacagagaagaatatacttgtggtcaggaggatggcctgcatacatgcctatctcccatcaggctgcagggctgggggctagtgttctgcttgtcacccctggaggtagggtcggttccacttaacagcgcatggctgagaatgtaggatttggatgggaagggaatcttctcaaataagaatccaagattgttactgagagaagaggggaggcatattgaggcagtcaacaaatgtcagtgcttacacccacacaataggcagtcagtaagcatttgattgaatgcgttgaatgacaaaaatgcttacccatcttgctcaagcagcatcttctagcccttgaatagccttaccattcctctggaatcacagctacctgggaaggactattaggataatgaggagagctaatgcttatttagcacctactctgtgctagtctttgtgctaggtgtttttcatgtattatctcaacctttgagtctcagcttactgatgaggttctgagaagggaaccccacatgtataggtcattagaggggtccccatatgtataggtcattaagaggaaaagtttagccaagttgaactcctttctagtaggaggatccgttgttttcactcaccctcctctttgcactaggccctagaccccttgtagttgtgttagttgtaactattggaccccttgtcctaaagccgtctcattttctagggaatgttaggctaaggatgtttgtgagctgagtgagataatcttttggggatggaaactgacctgtggctggccggccaaggacataagaatgaagaacttttgtcagtcctagctttgagtcagcctcatcccaacatcagaaggcagttttgccagctttccagtggagactcggtacttggctttttcctagattcctctctcagaattgagctcaggcccagggaggctcaggctgactctccatttcttttccctccctagaatcattgcgatgatgagtccagaggacagctgggtctccaagtggcagcgagtcagtaagtgttggcctgtctccttttggcttagttgtagtgttgttactgttcctcaggtccattagggagtctcaaatcagcaagatgagtgacctcagggtgggaaagatcgggttgtaggaaacacagggaagcagtgtcctgtgccttgtcatttaacacttgtagccaaaagagggaatagctcttctcttggagttgcatcacttctttagcttaagcttccatttgatcttgagtcttaactaacttcactgtaatcttgtatcttttttcttctctctcaggtaactttaagccaggtgtatatgcggtgtcagtcactggtcgcctgccccaaggtaataataatcataacagccaatgttcatttactgtaaagctctgtggaagtttttttatctgaattaatgccaattctcacattctatgaggttcagcattttacagatggggggaaccaggcacagagaggttaaatcacttgctggaggtcaccaggtagtaaatgaggagccaggattggaatccaggcattctggctccagaatttttgctgtttctgttttttattttttttagagacaaggtctcactatgttgcccaggctggactctaactcctgggctcatgtgctcctcccacctctgcctcctgagtagctgggactacaggtgcttggcttagaacctttgcttttgatgactacatgtatccctctttttcttctcattcttaccgaatacctgcctgggtcttcactagtaatgagtcaactaagcaggacctttttttttttttttttttttgagacagagtctctgtcacccaggctgaagtatagtggcattatcagagctcactgcagccttgaactcatggattcaagggatcctcccgcctcagcctcccaaatagctggcactacaggtgcaagccactacacctggctaatttttaaaatttttttgtagagatggggccttgctctgtagcccaggctagtcttgaactcctgacctcaagtgatccaccttgacctcccaaagtgctgagattgcaggcatgagccaccgtgcctggccaagcagacgattgataagtagtctaggaactccagtttgcttatagtacccccctcaaggtggcagctgagtggcctatcttacccttctgaatcttacctcacagaactgtttcttttcctgcttcaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcagagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctcctttttgggccatttttcaatacatagaatatgtgcacaatcagccaaaatagtaggggaaatgctgagaaccacaactgcagggtgagctgtgctgtgctagggcagagctgcctgtgctagggctttgtgtctcagccacctggtgttgctcttgagttgattttgcttgttacctgtggcctggagagtgtgggaaggaggagagatgcgacctgactctgattagtttgtctactccccttccttgtcctcacataggcctatgggagggaaactgggactggccgggctgctcatgtccactatggtcttcaaaccaaaaccattttctctggtgccttcaagctctgagggaatggtcagataaccccaactccaaactgagtttctcaaggatttccccagcccagcaaacagaaagctccgtgggtggtgatttctgttcaatttcaacctgaaagcaaccctgccaggctagagcttacgtcctggatggaagaagtgcgtttcagcaagtgcccaggctgtgcagccaacacccaactttcactagcttctcaaaaagtcccttggaaagccccagctgctgtcctgggtgtctgacccggacgtggctgcttggtgagaatggaaacagttgtggggaggggaggcaagaggagcttgcacaaataaccacattcaggctgcctcagccctacactgaactgggccctaactgacagtctcacaggaagcaaaagacatagcataggcattgatgcttgtgggggaagggtggcctgttttccttcctggactctacagactgtgccaagtgggctctccccgggagctgctgctgaattagctttcttgctttctctggtacttgaacatgcaggtggtgccactcagcaacccagacaggcagaaaggtgctggagtcccatcctctactgggaacccaaagaaactaagacaaggacttggttcacagctccctgggagtgggcggtcctggtactgctgccctgctttccatggctatgagggcagccatgagagctatgtcctgccccattggcccattgtgtctgtcagagtttcagtcccgtcctggctgccgaagttctgagtgcatagcatcttaagatctctccttgtcttgctcagtagtttggcttctctcctgaagagcaagcctcctccctagctcaacaaggacagatgcaagtcagacagagactaggaatagtagccaggctgccttccccttgcctgcccttgcctcattccctgcttcctccctgccacatactgtggaattagggtctcccagaacactgaggagctcagtggcagtgcattgataatgcagcctccagctcaagaaaggactggtagctgatagagcaagggtcaggatggtctggtcttggaggggagcagtttcaccagggttgggaactgaggctttgctcttggtgtggcttctgccttgttactcctagtctgtctgcagcctgctacttgatcctcaggtcccctccctgacatctggtctctatgaaagaggcaggtaggtcatgtttaagaacagactaataataactttgtctggaagtctggttcatgtttagtatcagtaaagcctttcatgtaaatatttttacagttgacaaaggtgctgggtgctgtggctcatgcctctaatcccagcaccttggggaggtcaaagcgggcagatcactttgaacccaggagtgtaagaccaacctgggcaacatggcaaaagcccatctctacaaaaaattagctaggcatggtggtgtacacctgtagtcccagctacttgggaggctgaggtgggaggatcccttgagtctgggagtttgaggctgcagtgagccgtgatggcgccactgcactccagcctgggggacagagtgagaccgtgtctcagaaaacaacaaaacaaacccaaatacagttgacaaagggctttcatatccagtatctcatttgattctcacagaaaccctggaactagttaacatccttatttggtgatgaggagactgagactcaaagagttaaagtgtcttgactgggcacggtggcttatgcctgtaatcccagcactttgggaggccaaggtgggtggatcatgagatcaggagttcaagaccagcctggccaagatggtgaaaccccgtctctactaaaaatataaaaagttagccaggtgtggtggcgggcgcctgtaatcccagctacatgggaggctgaggcaggagaagtgcttgaactcgggaggcggaggttgcagtgagccaagatcgtgccactgcactccagctagggtgacagagcaagactctgtctcggggcggggaagaaaagagttaaaagtgttttagccataatcaagtagtggagcctcagctcaagaaatataatgtccacactaagtttagggctactaactgtttgtgacatagttgtccacaaacacagcaagtttttttccctccataagtgttcaacagaaccagtgtgaggcattagctttcttctgagtgaagttattacaacacattgtccctacacgttgagcccaccaaccactctaatcccaccactctagtccctaagtctaaaattagccaaagagatggaggcagtggggcaatggcccagggaggggatccttgggatttactcaaggattcctgtgcagagcattgggaaaccagtctagcccttcatgagttacccctggctgcatcttctattccactccagcagctcttacgcacctgctgacctgtgtgccccacacctcccaacctctctttttcctcctcacctccctcaatctgcagactgatgatggcaccgtcacaccccactggaacactgagacttgtgcgatgaaaatacatgtatctaactaagggcagagtcctggccctgctgcctccaccagccaccaaccctgtgactttcccaagtcacctctaaaatgaagtttcttgtctaggaagtgcagttgacaaaactatgatgttaagggcaggatcgtggttagctgtgataggtggtggtggaggagggcatgagaagcacctaaggtgctggttatattttgtttctttctttccttccttccttccttcctttttctttcttttctttctcccttccttccctttctttctttcttttattttctttcactttttttttttttttttgagacagggtctcactttgtcacccagactgcagtgcagtggcatgatcatggctcactgcagcctcaacctcctgggctcagttgatcctcccacctcagtgcctcaagtagcggggtctacaggcatccaccaccacatccagctaatttttatattttggtagagacggggttttgtcatgctgcccaggctggtctcgaactcctgggctcaagccatccacccacctcggcctcccaaactgctgggactacaggcatgagccactgcgtccggccttttatcttgatcttgatgctagttatgtaggtcagttcactttctggaaatatattgttatatacttaggatttgttcactgttatacttcaaataaaaagtttgctttggctgggtgtggtggctcacgcctgtaatcccagcattttgggaggctgaggcaggtggattgcttgagctcagaagtttgagatcagcctgtgcaaagggcgatgccctgtctctactaaaaatttttttaaaattagctgggcgtggtggcacacgcctgtagtcccaactacttgggaggctgaggcaggaggatcacttgagcccaggaggtcacgggtgcagtgagtcccagttgtgccactgcactctagcctgggcaacagagcaagaccctgtctcaaaaaaaaaaaaaaaaaaatcaaatacaataatttaggcaaaagcaatttgagagttgtaaactatgtaaggaattgtcattatccaaggttgcctatctctaggtaagttctagataggtgtgacaagaatttcatccttccagcattgttgggtaatggtaataggtgttccaccacatatatcatacataaatacatcaaaactgaatcaaaacagaaacattttccttcaagcaccagggctttttttttttttttttttttccaaagacagggtcttgttctgtttcccaggcaggagcgcagtggcacgattgtagctcactgaagcctccagctcctgggctcaatcaatcctctcacttcagctcctagagtatctaacaatacaggtgcgcaccactccacccagctcattttgggggtatttttggtattttttgtagagacagggtttcaaattcctggcctcaagtgttccttcggcctcagcctcctaaaaggctaggattatatgcgtgagccactgtgcctggccaaggtttttttaaaattttaatctttatgttctcgttttttataagataaagtttggtttgggttttttttttgtttttttgtttgtttttctgtggttctttttttttagacagggtctcactatgttgcctagactggccttgaattcctgggctcaagagattctcccgcttcagcctcacaagtagctgggactacaggcatgtgccactacacctagcttaaatttttaaaaatgtgttatatacttccttgctatttggatacaagattctgaatgtgatttaacctgatttggttcaaagtcattgttgtaaacctccatttttgtatcatgtggtgaaatggttccgggactgactctttttctacctcttggattcatagcaacctgtcagctgtcacttctgttgctcatgtgtggctgtcccccttccagtcttgtctgacctaggagaacagacagccacacttggtaaaaattgctataggttgcaccaataaggtttagactggggagaagagcacatggctgcctgcctcagtcttggggtttcgaggccttcaccagtgggaaggtgaaatgcagagtctacagaggagtgaaggcagaccacagaacattaggactgggggagtcatgacttaggccagcccctcactttttagaggagaggactgagccccagagactggtcagcttgacttcaggagcgggtcgctgctactttgtatgtcctacactgcctagctcagtacctcttgtctaaagatgctgtgtttctctgccataagatcccaggaagcgggaactgagtgcagagaacactctgccttgtgctgctggtaccagcatgccagatcctctgagaaataggatggaaaacatttcccctctatgccttggcactcccccattctcaaccctctgccttccgggtagagggcagacattatgttgtcccgatagggaacttgaagtccaaggaactttccttgggggtctatctatggcggatagaggcctgggcctctaagagagagctggcctagcccattttgaaagcccctgtgtgctgcttccggcctatgcactcttcttcctgcaaactgagctcttgtgttacagagtgagcgtgagggaagggaaggagcagcttcagacagcagggtagggggacctcagtttctctccaaaatggatccctcatcccctttccaaacccagcaactaccaccctttcaaccccttcccccatcccggaaaatacctggaaggaagtgagcgctctggggccactagcaggaagtggggggttaactgtcacctcatccctgggggcttgagtagcagaaggcagagggggaaatgcaaatccatgcttgggagggagaagaactcctgagaggaagcaggtggcagccagagcccagacttcctcctgggccagtggtcccagcaggggctggagaggcctgaggcaagggagttatcacaggcactgaacaagacagcagtcggcccaccctgtgcaggcagctgcagcactttctctggtcagctgagtagactcacttcctctgccctgcaccccagagaggccgggagatggagggcggggtctcaggaggaggggtggggcatggtctggattcatggaaggtgaggagatgcaggagaaatgaaggggggtatgtccctggggaatcagctggaggcaggcaggcatcagtctcttctgcttttgcttagggactaagattcaggaatccctctggccttggcacctccccctaccttgttctagacaccaggggccaaaattgagaaccacatgatatccttgcaaagggatcgtttatagcacctggaaacaagaatctaagaagcagcctttggccttgtgcctctacactaatcatctattacatccctatggcaatttccaggttcaaaatgggccacctctattattgcatttgaccctcagtgccatcccacgaggcaatattattcccctttcacagatgagaaaactgagtttccattacatctctcgcccacagtcagtggcctggtgaagctgcactggtgcttcagcctttccccttgcacaacgctgctgtccctatggcctcccttcagttctccatggcagatggggatccagggcccataactggggcaggggcatgggggtcctccaggtttccctttttcttccttgaaccccatccagcctgcaggtggggctctggggttgcaggtccactgaccttagtaacaaaggctccttgggggtgagggcttccatgcctcctgtgttcacccaccctgggacccctcgaagaggtgccgggacccctgacacccacccccattttgtcccaggcttctcacctccccctccccagagccgcagccccatgacgcagccagccgctgttgccccattggcccgccctagtgcatttgcccttatttggccaggccagctccaggctgggtctccacccccggcccagcccccgcaggcctgtctctctcacttcgtctttttgaggtttggctctggggctctggggctctggggccctggcgggcgtcacttcaaacgcactttctggttgagtcactttttaacggctccagtgctgtgagctgctgctgctgctgggtccctggccttgggggccaaccctcccccatttgactgcttaataggctctgaaggaaagggctggggaggccatctgctgctggagagactctgcgggccacctggccacccagttaggcccctctgccccccaacccacaagcctgggccagagggtccgccctgggtcgctcccactgctttttccaacggggttgtgaggggagaacaggtcttcacagaagacctgttctttggggactttgaattgagctccctctggggaacagaaacggggtgcccgattttcaggaaggtgaaacttaacctcgctgagtttccggttcctcatctctgagatggggataccatcacttacctcactgggtcagcatgacgatcaagcgagattcagattgagtgtgtttcatcaagttctctagctgcctgggctgcctcccttccctcggccccgagtgcagaacgtggaggtgaacgggatgaatccaagctggttcgcagggcagtcctcactgagcagtctctttccaactctcaccaccttttccagctggtcctgggatgtgaggaatcctgttgggggcaggaggctggcaggaggaaatagatagctctttgccccttgtttccagacaagataaggggagaattctactagagccattcctagccaccctgccttctctgcattttgggaggtgtgccctcgagccagctgagaagataccatggctgcctgggggctgggcaggatttggaacacagatactgctgcttcctcctgcgaggtctctgggctcctgtgctcttggggacttcctagagcacaaacaagtcttttggtcaactccctccccatttttataggtgaagaaacaggctggggtttaggggcagattcagtgactggcccagaattgtaccataaataatcacagggtgaggattagacccctagtttcttgacacttaattttatcctctgcttggtgatcctgatgttgggatagggagtggggctgatgagggattgtagtgggttccaggcagaaaaccagctcttggaccccctccctgtccccgccacacatacacacacaatttatttgcagcagttggaactggagcaggtgcagctatgcaagttaaacccagcacctgtgtgtggagagagtccagagggagctttcatctctccacttgtgtccccagaagatcccagaggagaaagcttctggtttcacggccactcccacagcagtggtcagggtagccttcctcacacccacaccccctttccacccagcccgtcctgccttttcccagatgttgtggaaagaacccaacttggccctaacttgttttgtgacctcaggctgccttctgcctctctctgggcttgcagctctgtttcctgactcgggaccagttgctgcctaaccttgctgcttaaaagtccttgggtcttatgatcccaggagatctgagccagaaccctgccccagtgcgaagtgacctcctagtgtgggccactgtgcattggagctgccccttgccagacagagtagagcaggagagtatgaaattaaacctaggggagtctggtacgagcaggcaggggctgaggggcagccagtttgcccgccctccttgcctggaggccctttagcactccttgtgctcccaaggctctgagatgagacagatcttctgaggtgctgagatgatctctgtaggggacatgggctgtcttaggttcttaaggcacttgcctctcttggcacctgcttcccttggctgcccctccagggagatggggaagggtctcaacatttgggactattgactccaatttgctttagccccattttgcaatgctaggggctcagtttccctcctttgtggccaggcctgtccccaactgtagcttactggagggcgggtctgctctgccttctggacttcctgtttgtgagtggttaagtctgtggcttctctcttgttggctctttgtaaggcaggttatctgggctgccatctcccactggctgcttgcctgcctgtgagtgagggccccaggcccatgcagatggcagggaagggttggttttcttttctgccttcatgtgcggacaatgagcttgtgtcatttcttccaccctctgggcctgctctccttacaggcattaggccttcaaaagacaattttctccctgtttctcctccttgcccaatctctccttctaaaccctcttccacctgtactcacattctccaggaagccttctctgatgggactcctgtgactctaaggttgctactacagcatccaacatcccagccccttgggccctggcaactgccacctgggatggccttgtgcctgttgccgttactatgttaaatgtagatgtgtgtgtctacttcaccctcagattcagtgctcactagaagtaggaaccaagtgtccccatcagacctgaagctctgcccctgctttgggtacaagacactcacttgcactgacacacacactcgtacacactgcctatcaggctgggagtgcccaaggacaggtcctgtgtccttttctctgccggctcacctttgcctacccacagcctcagcttggcacacagagatggttgtcccccaggtcggtaaggtgggggtggcagtgagggaccatgagcctggagccctccaggattccaagcccagatccctctatcctgatgaagggctgttcccaccttgttcctgccgcccccgccccctacttcctctgagcaagaatctgaatgtcagaaccagggagggccgtgggggacttttgacagcaagtccaagtgagccaagg
